United States Patent 6,812,339 (POLYMORPHISMS IN KNOWN GENES ASSOCIATED WITH HUMAN DISEASE, METHODS OF DETECTION AND USES THEREOF) - sequence listing, part 86

SEQ ID NO: 33280 - DNA, 601 bp, Human
ctcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatgcagtccttcaataatttaaagaaatagaagctcagaactgaagtgaatttagttttgcctttaagaattctagagatgaaatggctccattgtcctatacttgttacatccattgagttgtccaggccttcccagctcgaacaccygcaggtgtatctaagaaataatgcataggcttaatgtattcacattgacataaataaattgccataaattgacagtcacgttaagattgtatgaccactttgtctagaataaacctttttttagcctgatttcttttttttttccaattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagt

SEQ ID NO: 33281 - DNA, 601 bp, Human
aaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgarttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgagg

SEQ ID NO: 33282 - DNA, 601 bp, Human
tttcaggctcttggggagggaaagaaaagtgtgtgagagaaaggctgaggcatcaagtccggagataatgcagaggacatgagcagcatgcatgaaaggccagcccactgggaacagagcaaggcctgatacctcatcattaggctcaggaggccaagccccaggtagagcccctcctctgataagggacctcagggatgtaagtgcaggacagactatgagggaagactcatggttctgtctgccctctgttgaggaggcccaggctccagtccggaccagggccaaggggcacaccctkacccaggaggatgcaggggcccagaaccaccactgactggtgcaagggtcctgggcagagatagcccagccctgctctgggagggcacacaaaccacccctcattcctgtcaagccagggatgtccctcaccatgatttccttgtcagcactctgtaagtccttctgggctgacttcagttctaacttggcctgatccaattcagagtagactgtctgcaactataagaaagtgtagggaatgaaagacaagccaagtggtagccttgtgccctgccccctcctgctgctccccagggag

SEQ ID NO: 33283 - DNA, 601 bp, Human
ttccacctgccccactggaattccagacagcttctcatgcttgcccctgtgggtcacccccttgggtggtaaggccttgggctctgtggtttgagatgatcctccctcaggcatgagcctcagaggcaaacatagaagaggaagttcagagtccctcgctcaggactctggtgggcaggccttcaaggtattgggagcaccctctccagcccagacccaccccttctggcatcactgcattctctctaacttgcattccaatacgtttgccttgaaaggtgatggtgaggaataatgagamaagagaaggggtttgcacagattgagtgctcaggtgagggaacaagaggtagctggaaccaaagccatggccaagcctaggcaaccctcactgccccatcagccactcagagctaacagcacagggcctgcagagctgtcttagctatccccctaccagcccatggacagtgccagcgactatcactcactgtgacttctctaggcaaagtttttcgtagtaaccatgctgggagctggagggccgggctgggggagtatccacatcaaaggtagcattgagatcaatatcatcacggaa

SEQ ID NO: 33284 - DNA, 601 bp, Human
ttgctaccaggcctcgccctctacaacaggggtgcccatgccccctgaggtttgggaggtaggacagcccagctggcttgccctcttgctcccttccacctccactgtctagcatctcagtttctttctctttctcttctttctctctgtacaaagtctttgaaaaagaggaaacctgcccagcccttgaccagcctcacctgaacagtacctgtatgaatgagtatagtccttgtctccacagtgaattacacttggcaaacctggccaaggagacagcctccctttttctggtcccacygtaccccagagcaggttccacctgccccactggaattccagacagcttctcatgcttgcccctgtgggtcacccccttgggtggtaaggccttgggctctgtggtttgagatgatcctccctcaggcatgagcctcagaggcaaacatagaagaggaagttcagagtccctcgctcaggactctggtgggcaggccttcaaggtattgggagcaccctctccagcccagacccaccccttctggcatcactgcattctctctaacttgcattccaatacgtttgccttgaaaggtgatgg

SEQ ID NO: 33285 - DNA, 601 bp, Human
taaggacaagagtgggatcagggcctgatgactgactcctctgctcctgccctaacggcctgtggtaaggctacatgacaaccaaggctccaggaaggacgagctgagttagggactcagaacttcactacctccttcactacctccacaggccatgaaggtggtggaaatgtctctgaaaggcctggcagcctgaagaccccaggtgtccaccttcaacctttacagcggaagaagggcaatgggaggaagccagagtacacagcagacactgacaggatccctgaggactacagcccaygggtcctaggtttgtttctcattgctaccaggcctcgccctctacaacaggggtgcccatgccccctgaggtttgggaggtaggacagcccagctggcttgccctcttgctcccttccacctccactgtctagcatctcagtttctttctctttctcttctttctctctgtacaaagtctttgaaaaagaggaaacctgcccagcccttgaccagcctcacctgaacagtacctgtatgaatgagtatagtccttgtctccacagtgaattacacttggcaaacctggccaaggagacag

SEQ ID NO: 33286 - DNA, 601 bp, Human
ctggcattttccctggtgggtgagaagatggtgatctaaggctggccctgtggcttctcaagccataaggacaagagtgggatcagggcctgatgactgactcctctgctcctgccctaacggcctgtggtaaggctacatgacaaccaaggctccaggaaggacgagctgagttagggactcagaacttcactacctccttcactacctccacaggccatgaaggtggtggaaatgtctctgaaaggcctggcagcctgaagaccccaggtgtccaccttcaacctttacagcggaagargggcaatgggaggaagccagagtacacagcagacactgacaggatccctgaggactacagcccacgggtcctaggtttgtttctcattgctaccaggcctcgccctctacaacaggggtgcccatgccccctgaggtttgggaggtaggacagcccagctggcttgccctcttgctcccttccacctccactgtctagcatctcagtttctttctctttctcttctttctctctgtacaaagtctttgaaaaagaggaaacctgcccagcccttgaccagcctcacctgaacagtacctg

SEQ ID NO: 33287 - DNA, 601 bp, Human
catgctatcctccattccccaccctgcttggcccaggctatgcctagaagcaagtcaaaggcaggtagaagcttgggctgaggctgcctgagatgcctcaagcactctggtccacagagacagtcaacaagtgaccgtggtctccaggcccagaaagagtctgaccacatctgatcatggctataaacaggagcctggcaacaggagcaggacctgctgacaggatcagtgggctggtcatgtcagctcccagtcgtaggagtggggcagggtgagggcaggaagagcagtctctgggtgycacactcaccctcacctgtttgtctgcccttacacctcaggctggtcccgaaagtggggctctgtccacaaaacccctgcctggacagtccttgacctacaagttgcaggcatgtgtctggccattggtcagactcactgttctcacgaccacaggaaggtgtccagcttggcctggaagagagaaggcactgtcttcaccctcaccctctgcttaaccttggtcttgggcttaacaggcaatgggcggatcatgactgtgtcagtctggaggagctgtcaaggaagaggcatggagaaa

SEQ ID NO: 33288 - DNA, 601 bp, Human
ggcagctgctgcatggggacaggtctgtctgccccacacgaatttcccatgaggtcaaaggctgtctgggtcactgcagtggccacagaggaggcccattgctgagttattcccaaatgaatgaatgaatgagtgagtgaatggatgcattcctctcattttacagatgagtaacccgaagcccctagaggagtggtcacctgcctgagggcacttctgtcccaccagcatcagaccaggtgtgtgcaggtgtgtgcgactccagggcccaggcccggggcagctggggtggggccttagsggggagcaggacctgggcccctcctcccacaggcactgtgggagccgccccagccatcacagtggtccccaccgataggccccccatatttgcccagccctgcaccaagctctttgctcccagtcacccattacccctcgcagcagccctgtgggggttcatccacagcacagagaggttgtcacctgcccaaggtcacggcagcatgtgatggagagtcgaactctggcctcttggctccccctcccatctttctccaggctctctatgggatgccgccatcagaatgtctcttcctca

SEQ ID NO: 33289 - DNA, 601 bp, Human
tcacctgcccaaggtcacggcagcatgtgatggagagtcgaactctggcctcttggctccccctcccatctttctccaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggtgtgkgcgtccccagcccagactcatggctggaccagtggcagtggccaggccatcagtgaccgtccatccagtacacaccatgtaccaggcatagcaggggatgtggggaagcggggcagacgagacccagccagaatgtggcactgacactctagcggtgcggtgtggatgctgcactcatgaacctaagaaggaacaacaaacaggatttccatgagttccgggctgtgactgtgatgtagagcggggggacggcgggacacggggctctttgccttggggtggtcaggaaaggagtcactg

SEQ ID NO: 33290 - DNA, 601 bp, Human
gcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggtgtgggcgtccccagcccagactcatggctggaccagtggcagtggccaggccatcagtgaccgtccatccagtacacaccatgtaccaggcatagcaggggatgtggggaagcggggcagacragacccagccagaatgtggcactgacactctagcggtgcggtgtggatgctgcactcatgaacctaagaaggaacaacaaacaggatttccatgagttccgggctgtgactgtgatgtagagcggggggacggcgggacacggggctctttgccttggggtggtcaggaaaggagtcactgctgctctgagaactgaaggaggggacggggagccctgtgcagacactgggaagtgagctcctggcagaggggccagcccgtgcaaaggctctgaggtctccagggggggtgagaacaga

SEQ ID NO: 33291 - DNA, 601 bp, Human
cccgagtggccctggccctcaaccccacactcgaccctgtgaccgacacctcctcactgacatggaaatggagacaaaccccagccttccacccctatcctgggtccagtgctggcctttcaccctccacccactggctccaagtcctaagaacccatgccaccccaacctgagcccccccacggcccatctgacagcccccacaccagcctccaagctctgctgtctcccgcagactcatgtcccgggggccatgctgctgtaccccggaccacactcctgtctcacccaaccttgagcytttccagagctcctggcagtggaagacagacccattcccagagggtgacagccccaagtggtcagggcttgggtgggggagcccggaggaggcacctgacacagaccaggggtccaggcaagcttctgggaggaggggacaccgaggcagagcccagggctgaggaggaggaggagaaattccagcagatgctggggaagccgggctttagtggagaaaatcactcctgtgaaacgctgggggctttttggttttgggtttttttttttcttcctgccatctagagcaaaatggcaaggt

SEQ ID NO: 33292 - DNA, 601 bp, Human
ctctgctgcctccatgtgaaatcataagagttgtggagccggtgtctgggtgtggcctggcatgaggctggcctggcctgagcccgtgctgggcctctgaagccagccttggagcctggactctctcccatggtcagtggggaccaggaggggccgcaggccaaggggaactcggccaggtttgcatccagcgggtggagatgggtgtgcctggggactcaccctcccggtgcccagcccagcctggcggggagaagccccaaggcccacaagttggccatagacacaagtgcagcctcartgtggtagcccactgaggggtccgtgtggtccttgcagggtgcttttgaatgctttgacttctttgcctccactgagaaagtgacagacttcacttccaaagccgtttctggcatctggtgacagaccagctggaggcgagtggcagctgcctccacgggcagggcactggctcttctgggccacaggccgcacccgacccacctcagctccacgccctgcctggctctgtggccacttgcatgtaggctttgcccccaccaaggtgtctccaaaaacccagcccctgcctggcttgcca

SEQ ID NO: 33293 - DNA, 601 bp, Human
aggcagagccgggagcagacagatgcctgtgtgctctgtatcagctgctgttaggtgctctaggtagaatgcaggcagggcaggggccggggagggcaggggctggcattttagatgatgggaggccagcagaagcctcactgagaagctgagttttgagcaaagacctgaaggagtggagggagggagccacagggaccctgagagctgatgttccaggcagagggagccgccagcggagaggccctgggcgcaggggggcgggggtgggggagacacccgtgtgtctggaaatggaacrggggcagagggggcctgcaggacacgactcagaccacagagggtggggaccgggtgactcgggatgcactggatgctctgcctggtccccatctgcatttgtatttgccacccggctcctgggacccccttgccctctactttgggaccaggcctttctgactctccctgtcccccactccttgttgttcatgggagcagagagtgtggttttggggctaaggaacactggcgcccacatgggaggaagtgccaggccaggccctggccccagcgccctgtcatttgcagccctcggggc

SEQ ID NO: 33294 - DNA, 601 bp, Human
ctggcattttagatgatgggaggccagcagaagcctcactgagaagctgagttttgagcaaagacctgaaggagtggagggagggagccacagggaccctgagagctgatgttccaggcagagggagccgccagcggagaggccctgggcgcaggggggcgggggtgggggagacacccgtgtgtctggaaatggaacaggggcagagggggcctgcaggacacgactcagaccacagagggtggggaccgggtgactcgggatgcactggatgctctgcctggtccccatctgcatttgyatttgccacccggctcctgggacccccttgccctctactttgggaccaggcctttctgactctccctgtcccccactccttgttgttcatgggagcagagagtgtggttttggggctaaggaacactggcgcccacatgggaggaagtgccaggccaggccctggccccagcgccctgtcatttgcagccctcggggctgattatggggtgggtcaatttctgcccttcctcccccaaacccctcagggcaggactattccaccagtgtgaggaacaggagaaaaacaaggggggcctct

SEQ ID NO: 33295 - DNA, 601 bp, Human
ctgggctccagggtacagtgtcctccagacctgcccctcctgggttccctgtgccccgccctggcctccactcctgggtgtccctcggcacagcccacacaaccaccaagagtatgtttctgacgttcaggcccaccccctccccgtccctccttagagaccctggcagtgccccgtagcaccctgacgataggaagcccaggtccctttgccgggtgtgtgaggcccctctcgaccccgttgcccatcacagtgccgggctgcaccatggagctcctcgcctgggttcctcatcctcccsccgacacacgcctcttctctcatccttgcccttgtccgggtctcagccctgtgattgaacgctctcttcccacctgccccccagcactagcccaggactgacctgagatgggcgtgtgcccaggggggcgcgcccccagaagggaggcgtgggcttcaagctggctctgaggcccacgtggctgtggcagtaggggagggcagtccaggtggccccagtgagcacaagcttaatgtggaactgcagggggagccaggggggtggcggtggctgggtctggcactggcagccctcccgcct

SEQ ID NO: 33296 - DNA, 601 bp, Human
gggtcgtgtcttccattcctcccactccagagtggggtcgagtggtctcagattcctcccactgcaaggcagggctgcgtccccctcggcaccccggggtgctgtccagctggctgctcaccccccaccccaccccgcaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaggggacgggcggcggggtacgggggcggcrggtttccggctgcggggcttccctgcctcttcccatcccctgtgagggtaggtgagctctgacccccaggtctgtgtcttgaggagctgggaacttcgtccctccctggtggagcagcccagagtcaggttccagctcagtggggactctgtgcagtgggagggcacaggctggcgggggctctgccatcagcacaggacactgggcccaggggcagggatctgggcagacagcgcagcccccgccacaggcttcttcctccactgaaaagctgctccctgcccagcacccagggcggtc

SEQ ID NO: 33297 - DNA, 601 bp, Human
ggcgatgtctatgggccacctgagattgtccacacacggttgtggggatgtttgctggaggcaggaagacccatagaaatcctcaaaaatcggaaagggacccacagttcctaagaaggtgtgagaggcctggttgtcgcaaaggcaggctgtgtcccctcacggccctagtgcagggctactttctgctccaaccgaactaaagacttgttccagggcagcagggccccagggcacaggcttttggggccacccctgttcccagctccggccctgcctttgctatctgcagtactcaggycagtgtccccaaaagccccagaggctgtcagggagggaaatggggggatcgtgggggaggtgacttgcccgagggcccccaccaggaggtggtggagctccccattggtctggctctagaccccagctctgaccctagaccccagctctgacctctgggccgcacattgtgtctgaagccaaggaatgacgcaggcagacgcccctgctcgccctcctgctgtgccagctcctctgaccccactgcctctgccctgtcccaggtgaagctgtcagactttgggttctgcgcccaggtgag

SEQ ID NO: 33298 - DNA, 601 bp, Human
gctaaaccatggaaatagggagtacatgagcccccagggtttgtcacttcctctggggccacatagtaagcgccatcacaggtgccatcactgtccctgtcccgtctacaccccaagatctagacacccatgacctccgccccctgccctcctgcacagtacatgccgccagccgacttggcagaggcggacactgcagccctacagcaaatgaacagtggggagcctcgccccctgaccctcccctccttctcgacaggtgtcgccatccctgaagggcttcctggaccgcctgctggtkcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaa

SEQ ID NO: 33299 - DNA, 601 bp, Human
ttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgtgcaaaggtccagccaccccgtcctccagccygcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcag

SEQ ID NO: 33300 - DNA, 601 bp, Human
gaccacctgacaccccagctccttcccaaggaggatgacaactcaagcctgatcctcctgtctcccagtccccaagtgagcatatgatgtgcaaaaatatcaccgcccgcgtccaggccgtcacgttccctagctgtaggctgacttccttgtctctttatttaaaaaaacaacgcaacccccaaaattttccccttaatggtggctactgattcctcctttaaaaaaaaaaaaaagcaggcaagcaaagtcacccagagattacagagatcaaaaacaaatccccccacagcagtgtttytcaaagtatggtcaccgtgggccaccccagcagtcacctgggatgtgagttcaagtgcacactctggggcctgactcaatctccagagcagcctgggaggctgcatttgtcacagtgatcctgggtgagtcctgtgctctaaagccactccgttgcagcattagaggcagcaactgagaaaaaacatcacttctgaaatgaaaactgagatcatagaatttttataagcatgatttgtaaaaagacagtgttgggctgcacagtgacttattaaagaaaaagattctgttccattgcccc

SEQ ID NO: 33301 - DNA, 601 bp, Human
cccatcaacagatggatggatagtgtagtacagccatacaatggaatattattcagaaattaaaaaaaaaaatggagccgtgatacatgctacaacatggataaaccttgaatacattatgctaagtgaaaggagccagacacaaaagaccacatattgtatgatttcatgcatatgaaatgcccagaatgggcagagccatagagacagaaacagatttgtcttttccagaggcctggggaggggagaatgggtacacgttttccctttggggtaatgacactgttccggaactggatcrtggtaatggttgcacaatatcatgaatacataaatatatcactgatggtaaatattttgtcatgtgtattgtaccacaattaaaaaaaaattttttggctgggcacggtggctcacacctgtaatcccagcactttgggaggccaaggtgggtggattacctgaggtcaggagttcgagaccagcctggccaacctggtgaaaccctgcatctactaaaaatacaaaaattagctgggcatggtggcaggtgcctgtaatcccagctactcaggaggctgaggcaggaaaatcacttgaa

SEQ ID NO: 33302 - DNA, 601 bp, Human
tgtatatgacatacaaagaaactagatatctagtagacagatgctaaaaaaaaaacaaccatggccgggcgcagtggctcacgtctgtaatcccagcactttgggaggccgaggcgggcggattgcctaagctcaggagttcgcgaccagcctgggcaacacggtgaaaccccacctctactaaaaatacaaaaaattagctaggcgtggtggtgtgcgcctgtagtcctagctactcgggaggctgaggcaagagaattgcttgaacctaggaggcggaggttgcagtgagcagagatcrcaccactgcactccagcctgggtgacagagtgagagtccatctcaaaacaaacaaacaaaaatataaaaacaaacaaacaaaaaacagccacgatccctgggtgctgggattacaggcaattattatactctcctttctacatatctgttccccctaaattttctcccataaacacagaaataaaagttgttagctaaagaacattttaaaattaggacagagagtccaaattagcccgtaagattgctgtgccttttgaagtaaattgattaaaatcagaattgtagccatacgaagag

SEQ ID NO: 33303 - DNA, 601 bp, Human
gtgcaaacctagcagaagtaattaatgcaagtcatcccacagccagatgcaaaacattctataataatgctgagaatccatgaagagctggatggagcttctctcgccaagggtccagatcactctggcaaaaagaacgaggactcggagacagagcagacgctgacttcccattgtatgcatttatgtgcaattaattcttttaaccatgtatagaattacttttcgttaaaaaacaaatcagagaaaaatgtatatgacatacaaagaaactagatatctagtagacagatgctaaaamaaaaacaaccatggccgggcgcagtggctcacgtctgtaatcccagcactttgggaggccgaggcgggcggattgcctaagctcaggagttcgcgaccagcctgggcaacacggtgaaaccccacctctactaaaaatacaaaaaattagctaggcgtggtggtgtgcgcctgtagtcctagctactcgggaggctgaggcaagagaattgcttgaacctaggaggcggaggttgcagtgagcagagatcgcaccactgcactccagcctgggtgacagagtgagagtccatctcaaaac

SEQ ID NO: 33304 - DNA, 601 bp, Human
gctgtgcaaacctagcagaagtaattaatgcaagtcatcccacagccagatgcaaaacattctataataatgctgagaatccatgaagagctggatggagcttctctcgccaagggtccagatcactctggcaaaaagaacgaggactcggagacagagcagacgctgacttcccattgtatgcatttatgtgcaattaattcttttaaccatgtatagaattacttttcgttaaaaaacaaatcagagaaaaatgtatatgacatacaaagaaactagatatctagtagacagatgctamaaaaaaaacaaccatggccgggcgcagtggctcacgtctgtaatcccagcactttgggaggccgaggcgggcggattgcctaagctcaggagttcgcgaccagcctgggcaacacggtgaaaccccacctctactaaaaatacaaaaaattagctaggcgtggtggtgtgcgcctgtagtcctagctactcgggaggctgaggcaagagaattgcttgaacctaggaggcggaggttgcagtgagcagagatcgcaccactgcactccagcctgggtgacagagtgagagtccatctcaa

SEQ ID NO: 33305 - DNA, 601 bp, Human; identical to SEQ ID NO: 28260

SEQ ID NO: 33306 - DNA, 601 bp, Human; identical to SEQ ID NO: 28261

SEQ ID NO: 33307 - DNA, 601 bp, Human; identical to SEQ ID NO: 28262

SEQ ID NO: 33308 - DNA, 601 bp, Human; identical to SEQ ID NO: 28263

SEQ ID NO: 33309 - DNA, 601 bp, Human; identical to SEQ ID NO: 28264

SEQ ID NO: 33310 - DNA, 601 bp, Human; identical to SEQ ID NO: 28265

SEQ ID NO: 33311 - DNA, 601 bp, Human; identical to SEQ ID NO: 28266

SEQ ID NO: 33312 - DNA, 601 bp, Human; identical to SEQ ID NO: 28267

SEQ ID NO: 33313 - DNA, 601 bp, Human; identical to SEQ ID NO: 28268

SEQ ID NO: 33314 - DNA, 601 bp, Human; identical to SEQ ID NO: 28269

SEQ ID NO: 33315 - DNA, 601 bp, Human; identical to SEQ ID NO: 28270

SEQ ID NO: 33316 - DNA, 601 bp, Human; identical to SEQ ID NO: 28271

SEQ ID NO: 33317 - DNA, 601 bp, Human; identical to SEQ ID NO: 28272

SEQ ID NO: 33318 - DNA, 601 bp, Human; identical to SEQ ID NO: 28273

SEQ ID NO: 33319 - DNA, 601 bp, Human; identical to SEQ ID NO: 28274

SEQ ID NO: 33320 - DNA, 601 bp, Human; identical to SEQ ID NO: 28275

SEQ ID NO: 33321 - DNA, 601 bp, Human; identical to SEQ ID NO: 28276

SEQ ID NO: 33322 - DNA, 601 bp, Human; identical to SEQ ID NO: 28277

SEQ ID NO: 33323 - DNA, 601 bp, Human; identical to SEQ ID NO: 28278

SEQ ID NO: 33324 - DNA, 601 bp, Human; identical to SEQ ID NO: 28279

SEQ ID NO: 33325 - DNA, 601 bp, Human; identical to SEQ ID NO: 28280

SEQ ID NO: 33326 - DNA, 601 bp, Human; identical to SEQ ID NO: 28281

SEQ ID NO: 33327 - DNA, 601 bp, Human; identical to SEQ ID NO: 28282

SEQ ID NO: 33328 - DNA, 601 bp, Human; identical to SEQ ID NO: 28283

SEQ ID NO: 33329 - DNA, 601 bp, Human; identical to SEQ ID NO: 28284

SEQ ID NO: 33330 - DNA, 601 bp, Human; identical to SEQ ID NO: 28285

SEQ ID NO: 33331 - DNA, 601 bp, Human; identical to SEQ ID NO: 28286

SEQ ID NO: 33332 - DNA, 601 bp, Human; identical to SEQ ID NO: 28287

SEQ ID NO: 33333 - DNA, 601 bp, Human; identical to SEQ ID NO: 28288

SEQ ID NO: 33334 - DNA, 601 bp, Human; identical to SEQ ID NO: 28289

SEQ ID NO: 33335 - DNA, 601 bp, Human; identical to SEQ ID NO: 28290

SEQ ID NO: 33336 - DNA, 601 bp, Human; identical to SEQ ID NO: 28291

SEQ ID NO: 33337 - DNA, 601 bp, Human; identical to SEQ ID NO: 28292

SEQ ID NO: 33338 - DNA, 601 bp, Human; identical to SEQ ID NO: 28293

SEQ ID NO: 33339 - DNA, 601 bp, Human; identical to SEQ ID NO: 28294

SEQ ID NO: 33340 - DNA, 601 bp, Human; identical to SEQ ID NO: 28295

SEQ ID NO: 33341 - DNA, 601 bp, Human; identical to SEQ ID NO: 28296

SEQ ID NO: 33342 - DNA, 601 bp, Human; identical to SEQ ID NO: 28297

SEQ ID NO: 33343 - DNA, 601 bp, Human; identical to SEQ ID NO: 28298

SEQ ID NO: 33344 - DNA, 601 bp, Human; identical to SEQ ID NO: 28299

SEQ ID NO: 33345 - DNA, 601 bp, Human; identical to SEQ ID NO: 28300

SEQ ID NO: 33346 - DNA, 601 bp, Human; identical to SEQ ID NO: 28301

SEQ ID NO: 33347 - DNA, 601 bp, Human
gttgcaatgtttcaagaacaagagaaaagtgacaacgtttggtttactttagtatattaggcatttttctaatgtgaactatacgaaagcaattctcattcaatgaaagaggcgccaaaaaattagagattaataagtcatcggtttctagcacgttgactgaaagaccagtgagttgtgcttgttgaattctgccctcactgcagatgtgcaggtcaaacccaaagtggtcaatgggaaagatgaagaaagatggatttccagggcatgggctcccgactagaatctgcccctcgctcaygcttctcccggcccctttagactctttagactgacatggtggagaatgtgtttgctgtggtagagaaagggagaaagtaatgagctgggccaaacagcagcactgaaagcttcccaagtcacactcagaccagacttttccagggattggaagatggagagagggaaaggaggtgcagacaccaagtaagggtttggtgcagggctctggaatgtccagaaggagcgggaagcaaaggtggcgggacactgcctgaaaggcgacaacctagtgtggccacaagagagtctgctatgcctg

SEQ ID NO: 33348 - DNA, 601 bp, Human
cccatttttcataaagaaaccaagaaataatattctaaaattggtagctggtgtcatgacccaaccccagatctggacagagtggttctccatcccatggacagatcctaccaggaggtcttcacgtaggtgaaggcctttgtgctgacctttttggttgcaatgtttcaagaacaagagaaaagtgacaacgtttggtttactttagtatattaggcatttttctaatgtgaactatacgaaagcaattctcattcaatgaaagaggcgccaaaaaattagagattaataagtcatcggwttctagcacgttgactgaaagaccagtgagttgtgcttgttgaattctgccctcactgcagatgtgcaggtcaaacccaaagtggtcaatgggaaagatgaagaaagatggatttccagggcatgggctcccgactagaatctgcccctcgctcatgcttctcccggcccctttagactctttagactgacatggtggagaatgtgtttgctgtggtagagaaagggagaaagtaatgagctgggccaaacagcagcactgaaagcttcccaagtcacactcagaccagacttttccagg

SEQ ID NO: 33349 - DNA, 601 bp, Human
tcgaattggatatgggccgtgagggtctggtgaccaggtgattaaaatcttgttgctgtctaccttccatccaacaggtaaatgcctcacgacggtggtttatattataataaagaatcccagagggttaagtgtggagagggtacaatgttcttattatactcttctcagtcgacatggagaatagaggagagcagaggaatgcccatcttacatacaactagagcgccgcttctcagcatgcctggcttgtcttgagcattcgctgaatgaatgcagattaatcagaacaacagacttmcctctgaaaacttaaattctgtagagtgcctatgtatcaatgccaaggttgctgaccggtaagacccctgaaaacgagcgatcacgggcttccctgacgacagggccattatagtgtcctcagattagatcttagcacaatggctttaacctgcttgatgaatgaataacagagggaagaaagaaaggaagtacgtgaagggggtaaagagaaggaggtgaggggatgaggggggaaagagtgacctccaaaaatggactggcccaaactgggccaacctgagctaccctggaagacgca

SEQ ID NO: 33350 - DNA, 601 bp, Human
tgctctgtcacccaagctggagtgcagtggcccgatcttggttcactgcaatctccgcctcccaggttcaagcgattctactgcctcagcctgccgaatagttgggactacaggtgtgcaccaccacatctggctaattttttgtatttttagcagagacggggtttcaccatgttagccaggatggtctcgatctcctgacctcgtgatctgcccacctcggcctcccaaagagctgggattacaggcgtgagccaccgtgcccgacccttatttgtaaagagttatttaaagcaaacaragaaatttctgaaattcgaattggatatgggccgtgagggtctggtgaccaggtgattaaaatcttgttgctgtctaccttccatccaacaggtaaatgcctcacgacggtggtttatattataataaagaatcccagagggttaagtgtggagagggtacaatgttcttattatactcttctcagtcgacatggagaatagaggagagcagaggaatgcccatcttacatacaactagagcgccgcttctcagcatgcctggcttgtcttgagcattcgctgaatgaatgcagattaat

SEQ ID NO: 33351 - DNA, 601 bp, Human
agaagggaattttttggagggttaaaaacaggttgatcttggtgatggtcacaagacactaaatttgtcaaaattcacagagctgtatatttccaaagggtgaattttactggatgtcaatcatacctcaataaacctgggaaaaggtggtggcgatgggccttgtagggatggcaaggattatggggataagacgatgtccaggctacgtgggggggcagctgatctgtaccccacttaacattagaagtgctctctccgacctacacaaggaatgcatcttgagccttctgtttaaacrctccttgtcaagactacctgcagctggaagtaaaatcacctaaacaagccaaggtcgctgatgtccttcgaatgttatggcttgtatttccaaaagggactttggctcagcccagatttttctgcatccatccactcatctagtaattgattggttttcacaaagggtagggaaagaaacccctggttggtgaattcgttggtacactgtttcggtgtgcccagctgtttatcaatcctgactagcagagcactgcctcccaccgcagaaattctccttggccaacagggtgctgagtgg

SEQ ID NO: 33352 - DNA, 601 bp, Human
atcagataatcaatcagggttgccagggaaagagggcaggagaagggaattttttggagggttaaaaacaggttgatcttggtgatggtcacaagacactaaatttgtcaaaattcacagagctgtatatttccaaagggtgaattttactggatgtcaatcatacctcaataaacctgggaaaaggtggtggcgatgggccttgtagggatggcaaggattatggggataagacgatgtccaggctacgtgggggggcagctgatctgtaccccacttaacattagaagtgctctctccsacctacacaaggaatgcatcttgagccttctgtttaaacactccttgtcaagactacctgcagctggaagtaaaatcacctaaacaagccaaggtcgctgatgtccttcgaatgttatggcttgtatttccaaaagggactttggctcagcccagatttttctgcatccatccactcatctagtaattgattggttttcacaaagggtagggaaagaaacccctggttggtgaattcgttggtacactgtttcggtgtgcccagctgtttatcaatcctgactagcagagcactgcctcc

SEQ ID NO: 33353 - DNA, 601 bp, Human
aagaagcagagtagtacgcccatgcaatgaaatacttcccggcaaggagaaggaacaaaccacacgcacacatcatgaatgactcaaaagcattaagctgagggaaagatgccagactcaaaaggcgacatcagtgtgactccatttatatgacattctagaaaaggcaaaattataggatcagataatcaatcagggttgccagggaaagagggcaggagaagggaattttttggagggttaaaaacaggttgatcttggtgatggtcacaagacactaaatttgtcaaaattcacagarctgtatatttccaaagggtgaattttactggatgtcaatcatacctcaataaacctgggaaaaggtggtggcgatgggccttgtagggatggcaaggattatggggataagacgatgtccaggctacgtgggggggcagctgatctgtaccccacttaacattagaagtgctctctccgacctacacaaggaatgcatcttgagccttctgtttaaacactccttgtcaagactacctgcagctggaagtaaaatcacctaaacaagccaaggtcgctgatgtccttcgaatgttatggc

SEQ ID NO: 33354 - DNA, 601 bp, Human
tgcaaacaagttgaagaccctgggccaagaacttccagggcgaaaggctcagtgtaaaaataaagaagcagagtagtacgcccatgcaatgaaatacttcccggcaaggagaaggaacaaaccacacgcacacatcatgaatgactcaaaagcattaagctgagggaaagatgccagactcaaaaggcgacatcagtgtgactccatttatatgacattctagaaaaggcaaaattataggatcagataatcaatcagggttgccagggaaagagggcaggagaagggaattttttggagkgttaaaaacaggttgatcttggtgatggtcacaagacactaaatttgtcaaaattcacagagctgtatatttccaaagggtgaattttactggatgtcaatcatacctcaataaacctgggaaaaggtggtggcgatgggccttgtagggatggcaaggattatggggataagacgatgtccaggctacgtgggggggcagctgatctgtaccccacttaacattagaagtgctctctccgacctacacaaggaatgcatcttgagccttctgtttaaacactccttgtcaagactacct

SEQ ID NO: 33355 - DNA, 601 bp, Human
gtttttgccctctgtctgattctcgctctaacctgctgcaatgggaattgcttcttcacctccaggaaagcctcaacaaaaatactcctgagggggagacaagagtcctccccggcaaatttcaacccagcagagtcctggcagcctcttcggctccctaccttgaggccccgggggctcaggcttcctggccctaatcttcacctggcctggatccagaaatgtctctggttcgcatagagaggtacccaactggtctcgggactcacctttcactgagcagggggcatgaacaagacayagcttagtggagtgtttacctcaggggtcacactcagcctggtctggccttaactgggtgtggtcctgtccctgccaccatgtaccaccatccagtggggtgcaggtacaggccaggctgtgtgatcaccagctaggcaaggctccagctgcgacaaggactccatcttcacgcctgtcctggctcctggggagtagactccagaacatactatcaaagatcggcgaatgagatccaaacggtcattacttgcactgtctttggggggtcctaggagaaactacctcattcttaacagct

SEQ ID NO: 33356 - DNA, 601 bp, Human
gcggtaacaggggtcaggggggtggtgcgggggcaggtgggttacagcctccactgggatcagggtttcaacagtgttacttataaattatattacatcaattttatttactgatctaggcagccagagggtggaaggatatacaatgtggaggaaacacattcataccggggtgaggagtgctggcgggagacacggctctttaacatgaaaaatgtataaagtatttagcaaaagttacagaaaacagatcaaacaagcaagtttattttgttagaaaattccactttcatagggtttgccgatgtgctcgtgtctgtgaaggggttgcttccggtcatctccttcctaacggaagggaagggatgctaagttggggcccctgtcactaaggatggctggcgtccctttgaatgtctgtccctgggtccacacagctgcctggaacccacgactcccgagagcccgtctgctgcaggtgatgctggaagggaagcgcccccacttgacagatgagtgcacggaggtcccgacaggggatgtgacttaacttcaggttatgggacaaaggaggccgcagagcagggccagtcctgtgctc

SEQ ID NO: 33357 - DNA, 601 bp, Human
tctcgagagcctaggagggatgccaagacaggtcacatgaagaatgtggcagccctccaggaaagagggtcgcctagggggacctagtgtctctggacagtttattttacatgggatgaatctaggcatctcgaggatacacacagagcagaagaaaaaaaaaacgagatgggatttaacttcctgaaaactctttataataatgcaggacaactgtatatagcaaacgccttcaaaatttaaactctttaaacatttaattcttcagcattaatacacacaaatgcggtaacaggggtcaggggggtggtgcgggggcaggtgggttacagcctccactgggatcagggtttcaacagtgttacttataaattatattacatcaattttatttactgatctaggcagccagagggtggaaggatatacaatgtggaggaaacacattcataccggggtgaggagtgctggcgggagacacggctctttaacatgaaaaatgtataaagtatttagcaaaagttacagaaaacagatcaaacaagcaagtttattttgttagaaaattccactttcatagggtttgccgatgtgctcgtgt

SEQ ID NO: 33358 - DNA, 601 bp, Human
taggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgytaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagttta

SEQ ID NO: 33359 - DNA, 601 bp, Human
ttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgctaggtcaatattgaaggaggggctatagccttgggccaccct

SEQ ID NO: 33360 - DNA, 601 bp, Human
tggagtgcagtggcaccatcatagctcactgcagcctcaaaactcctaggctcaaatattcctcctgccttagcctcccattacctcgaactacaggtgcaccacgccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacrtaacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttg

SEQ ID NO: 33361 - DNA, 601 bp, Human
aggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtggrcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggct

SEQ ID NO: 33362 - DNA, 601 bp, Human
cagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcratcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacat

SEQ ID NO: 33363 - DNA, 601 bp, Human
gggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattatycttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgca

SEQ ID NO: 33364 - DNA, 601 bp, Human
agtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaraggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccag

SEQ ID NO: 33365 - DNA, 601 bp, Human
aaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcytaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaag

SEQ ID NO: 33366 - DNA, 601 bp, Human
actgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaartttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcgg

SEQ ID NO: 33367 - DNA, 601 bp, Human
atttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgaaagtaatgagttataacttattcaataaaatgaaaatgtatgagtccatcctgatataaataactgaataaatgggagaaaaggaaaaggttttctttrtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattca

SEQ ID NO: 33368 - DNA, 601 bp, Human
aaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgaragtaatgagttataacttattcaataaaatgaaaatgtatgagtccatcctgatataaataactgaataaatgggagaaaaggaaaaggttttctttatggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaac

SEQ ID NO: 33369 - DNA, 601 bp, Human
aggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaaygcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcat

SEQ ID NO: 33370 - DNA, 601 bp, Human
ttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactat

SEQ ID NO: 33371 - DNA, 601 bp, Human
cccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttmtttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgtta

SEQ ID NO: 33372 - DNA, 601 bp, Human
ctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagaytgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaa

SEQ ID NO: 33373 - DNA, 601 bp, Human
ttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagrgggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaag

SEQ ID NO: 33374 - DNA, 601 bp, Human
acatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtasagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactct

SEQ ID NO: 33375 - DNA, 601 bp, Human
gagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatgggrcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtc

SEQ ID NO: 33376 - DNA, 601 bp, Human
aggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtg

SEQ ID NO: 33377 - DNA, 601 bp, Human
ggcttacactggcccagtgacaataaactccaacctcttaagaatccagcacctgcctacaccaacatccttaccgccatcgctttccccctttgccattacactgtggccacatcctccgccctcagggtcttcaaactttctgcctgaggcgcgcttttctcacaattttgcctggcttgcttctcgtcatagaggccttagcacggaagtcgcccgccccccaggctcccacttagagtagcggaccccacccaaccaccgcccggtaccctctcgctggcgaccctgggtgtccctrtcctaggtgggctccgcgggggcagtgacccagacccacaatacccaggacccgccacacgactgacattcgtcgggttcatacccgtgacaacgcccggccccactcgctctggccacctggaatgaagacaagtcggccagcgacaaagacaaacaaggaagtacacggactcctgaaaccccgacttcccacgaaccacccgacaccatgtcacgcctttcagctgcaaagggccaggctaaagcaagcactgcccgagtggtggcagtggacagcttcgggacaggccgcgctcgt

SEQ ID NO: 33378 - DNA, 601 bp, Human
tgagtcatctgtaaatggcttacactggcccagtgacaataaactccaacctcttaagaatccagcacctgcctacaccaacatccttaccgccatcgctttccccctttgccattacactgtggccacatcctccgccctcagggtcttcaaactttctgcctgaggcgcgcttttctcacaattttgcctggcttgcttctcgtcatagaggccttagcacggaagtcgcccgccccccaggctcccacttagagtagcggaccccacccaaccaccgcccggtaccctctcgctggcraccctgggtgtccctatcctaggtgggctccgcgggggcagtgacccagacccacaatacccaggacccgccacacgactgacattcgtcgggttcatacccgtgacaacgcccggccccactcgctctggccacctggaatgaagacaagtcggccagcgacaaagacaaacaaggaagtacacggactcctgaaaccccgacttcccacgaaccacccgacaccatgtcacgcctttcagctgcaaagggccaggctaaagcaagcactgcccgagtggtggcagtggacagcttcgg

SEQ ID NO: 33379 - DNA, 601 bp, Human
aaatccatgagtcatctgtaaatggcttacactggcccagtgacaataaactccaacctcttaagaatccagcacctgcctacaccaacatccttaccgccatcgctttccccctttgccattacactgtggccacatcctccgccctcagggtcttcaaactttctgcctgaggcgcgcttttctcacaattttgcctggcttgcttctcgtcatagaggccttagcacggaagtcgcccgccccccaggctcccacttagagtagcggaccccacccaaccaccgcccggtaccctctsgctggcgaccctgggtgtccctatcctaggtgggctccgcgggggcagtgacccagacccacaatacccaggacccgccacacgactgacattcgtcgggttcatacccgtgacaacgcccggccccactcgctctggccacctggaatgaagacaagtcggccagcgacaaagacaaacaaggaagtacacggactcctgaaaccccgacttcccacgaaccacccgacaccatgtcacgcctttcagctgcaaagggccaggctaaagcaagcactgcccgagtggtggcagtggaca

SEQ ID NO: 33380 - DNA, 601 bp, Human
ggaacacagccaaagacgctcaggttccaccgagagggcacgccaacatggtgacagccaaccgcaccgagctgagtccagtgcaatcacagattctgctcacttaattcccctgctggtgtccaagcagcccacctctccagaacagagaccccatgacggtgactgtaagtcacaaagacggcccctctttacaggcagctcctcctgaagccggaccagagagagaattcactaactgcctggagtttggtgacagtgatacttctccctgtagggcaataagctggcagtctcggtygattcccagtcttgcttgatttttagttaaaatttggaatgactcagtcgtcagggcctcattacctcagactactgacaaaaagcgatctccgggcagcgaggaggaggagcaactgccagtgcatcacagaaagctggtactacaaacatggctctattttaaataaagaggccagtctaatcagtctcacttatgatcactcgcactcctgcgtctctagagagaagagacaggacaaagctgtcacttagaactgcgaaaggtacacacaaccctaggttcacagctgggtaacat

SEQ ID NO: 33381 - DNA, 601 bp, Human
ttctgaggctggacatcagcccgctccccacaatgaaataaagttattttctcattctccaaaaaaaaaaaaaaaaaagaaactggaagagcagcatcacggccacggcccagacaggcaccaccacctgaacagaaggaaggatgggatgaccagcaggactggactcagccattacaggtggaacatgcagaggagaactgctgcagaggagaactgctgcagaggcccacagtgacgacgcctgggccttacactgaccaagaaggaacacagccaaagacgctcaggttccaccgasagggcacgccaacatggtgacagccaaccgcaccgagctgagtccagtgcaatcacagattctgctcacttaattcccctgctggtgtccaagcagcccacctctccagaacagagaccccatgacggtgactgtaagtcacaaagacggcccctctttacaggcagctcctcctgaagccggaccagagagagaattcactaactgcctggagtttggtgacagtgatacttctccctgtagggcaataagctggcagtctcggtcgattcccagtcttgcttgatttttagttaaaat

SEQ ID NO: 33382 - DNA, 601 bp, Human
attcgagggcggatcctctctggcgtggtgaccaagatgaagacgcagaggaccactgtcatccgccgagactacctgcactacatccgcaagtacaaccgcttcgagaagcaccacaagaacatgtctgtacacctgttcccctgcttcagggacgtccagatcggtgacatcgtcacagtgggcgagtgccggccttgccggcctctgagcaagacagtgcacctcaacgtgctccaggtcaccaaggctgccagcaccaagaagcagttccagaagttctgaggctggacatcagccygctccccacaatgaaataaagttattttctcattctccaaaaaaaaaaaaaaaaaagaaactggaagagcagcatcacggccacggcccagacaggcaccaccacctgaacagaaggaaggatgggatgaccagcaggactggactcagccattacaggtggaacatgcagaggagaactgctgcagaggagaactgctgcagaggcccacagtgacgacgcctgggccttacactgaccaagaaggaacacagccaaagacgctcaggttccaccgagagggcacgccaacatggtgac

SEQ ID NO: 33383 - DNA, 601 bp, Human
cctaggcagggatctgaactacacacctgtccttacacacagcacagaaccctctgaaaatcactttccaggaaaaacactgcgatctccaccaagcctgcccctcagctacaatcccagacacactccaagagaactgggggtcagccggccacgcccacctgggaatggagaagacacccacaaaacaaggggaggagcatcagcaaaatgatggctgcttatcacaggcttgcccctttgacagatgaattacaaactggcacggaggactacacgcggtggaatgtggactcgactrcgccactgaatactggtaccctgtacatctggtcctcttgaaaatttcctagcaaaagaaaacttgcgttttgctttgtgatgtctttgcttctgccttgcgggggtggggtgattatatggaaccgaccgtgtgtgcctacgcgtgcagaccctcctggcccctcaggtaaaggaaccgacggtgtgtgcctgcgcgtgcagaccctcctggccccgcaggtaaagtgtctcgtctaccccctctgccatcactgtacctcacgtggcctccaccacagcacgtcatgtctgccattgc

SEQ ID NO: 33384 - DNA, 601 bp, Human
ctgtgagtatctgctcataactataataatccaccattcctctctgccaccttgcatcctacaggccagagacagttatgagttcataacagtgttgttcagaatattaaaaggttacgtatgctattagtgtaaaactagcattaagggtttgtaaccagaaagcactgtgaatagaaatgtgtcctaacattagtaactataaatctcgcatagctaatcaagaaactactgtaaacaaaggatcctagatgtcttgactcagggtgcctggcacataaaaatatttaaagattaaagmaatgtctgaagcacagaagtgaaggaagttaccaaggctggtcaaaagctaatcctgtgtgcaacgaattctcaatctcatgtttgcgtctatgatcatctagtaacatctctcatccctggattttccgggtgggtgggtgataaatgggccttagagcctaggcagggatctgaactacacacctgtccttacacacagcacagaaccctctgaaaatcactttccaggaaaaacactgcgatctccaccaagcctgcccctcagctacaatcccagacacactccaagagaactggg

SEQ ID NO: 33385 - DNA, 601 bp, Human
actggtcacccgtaaaagaggaaacctatgggtggtgggtgtaacccagtccactgacacagtcaatgactcactgaagggcgtgcagacctgtgagtatctgctcataactataataatccaccattcctctctgccaccttgcatcctacaggccagagacagttatgagttcataacagtgttgttcagaatattaaaaggttacgtatgctattagtgtaaaactagcattaagggtttgtaaccagaaagcactgtgaatagaaatgtgtcctaacattagtaactataaatctcrcatagctaatcaagaaactactgtaaacaaaggatcctagatgtcttgactcagggtgcctggcacataaaaatatttaaagattaaagcaatgtctgaagcacagaagtgaaggaagttaccaaggctggtcaaaagctaatcctgtgtgcaacgaattctcaatctcatgtttgcgtctatgatcatctagtaacatctctcatccctggattttccgggtgggtgggtgataaatgggccttagagcctaggcagggatctgaactacacacctgtccttacacacagcacagaacc

SEQ ID NO: 33386 - DNA, 601 bp, Human
aagatgctgacccagccacactgggccctttcctgaaggagcttaatgtctgtatcggtgccaactaaagaacattctgctgggacagcgcagctctgaatctgtggagtaggtgtcacacagggcaactgagctttaaattttatttaaaattaatttgggccaggcgcggtggctcacccctgtaatcccagcactttgggaggccgaggcaggcagatcacctgaggtcaggagttcaagaccagcctggccaacatggtgaaacccccacctctactaaaaatacaaaaaatagccrggtgtggtggtgaacacctgtaatcccagctactcgggaggctgaggcaggagagtcacttgaaaccgggaggcggaggttgcagtgagctgagatcgcaccactgcactgcagcctgggtgacagagggagaccccatctcaaaaacaatttaaaaattacaataccagactcacaggcccccctctcagctagtgagtgactctgcccaaggccacggctcctgccggcagccccaccccttcaggttggacaactcagatccagagaaacaaaactttaaaaagcaggtgccatggg

SEQ ID NO: 33387 - DNA, 601 bp, Human
caaactttttcattcagcaaataatcctggagcacccacaacatcctaggttttgaggctaagatgctgacccagccacactgggccctttcctgaaggagcttaatgtctgtatcggtgccaactaaagaacattctgctgggacagcgcagctctgaatctgtggagtaggtgtcacacagggcaactgagctttaaattttatttaaaattaatttgggccaggcgcggtggctcacccctgtaatcccagcactttgggaggccgaggcaggcagatcacctgaggtcaggagttcragaccagcctggccaacatggtgaaacccccacctctactaaaaatacaaaaaatagccgggtgtggtggtgaacacctgtaatcccagctactcgggaggctgaggcaggagagtcacttgaaaccgggaggcggaggttgcagtgagctgagatcgcaccactgcactgcagcctgggtgacagagggagaccccatctcaaaaacaatttaaaaattacaataccagactcacaggcccccctctcagctagtgagtgactctgcccaaggccacggctcctgccggcagccccacc

SEQ ID NO: 33388 - DNA, 601 bp, Human
ctttgggccgggcacagtggctcacacctgtaatcccagcactttgaggctgaggctgaggcgggcggatcacgaagtcaggagatcgagaccatcttggctaacacggtgaaaccccgtctctactaaaaatacaaaaaattagccgggcgcggtggcgggcgcctgtaatcccagctactcaggaggctggggcaagagaatggcatgaacccgggaggcggagcttgcagcgagccgagatcacgccactgcagtccagcctgggcgaaagagcgagactccgtctcaaaaaaaaaamaaaaaaaaacaactttgaattaagtgaaaagctcacagtggtctcaacgccacatcctccctcaacaccacgtcctccctcaacaccaggtcctcctgtgaccagcacacagaggaacctcacgacttacactggactttgtcctgctggtcaggtggcaccagtgggcccgggggcttcagtggggcctcggggagagacgaggggccactgtgggatctgtcctcctggaggccatcttgctcggccgacgcgccgtccatggtcaggacgacaccagctgagctgacgctgaggggc

SEQ ID NO: 33389 - DNA, 601 bp, Human
gtttagcaggaatgtgcctgatctaaaggtggcatcattcagttactaaaacatactttgggccgggcacagtggctcacacctgtaatcccagcactttgaggctgaggctgaggcgggcggatcacgaagtcaggagatcgagaccatcttggctaacacggtgaaaccccgtctctactaaaaatacaaaaaattagccgggcgcggtggcgggcgcctgtaatcccagctactcaggaggctggggcaagagaatggcatgaacccgggaggcggagcttgcagcgagccgagatcrcgccactgcagtccagcctgggcgaaagagcgagactccgtctcaaaaaaaaaaaaaaaaaaaacaactttgaattaagtgaaaagctcacagtggtctcaacgccacatcctccctcaacaccacgtcctccctcaacaccaggtcctcctgtgaccagcacacagaggaacctcacgacttacactggactttgtcctgctggtcaggtggcaccagtgggcccgggggcttcagtggggcctcggggagagacgaggggccactgtgggatctgtcctcctggaggccatcttgctc

SEQ ID NO: 33390 - DNA, 601 bp, Human
agtttttaaaatgagccaggcaacagggcgcggtggctcacgcctgcaatcccagcactttgggaggccaaggtggggggatcaccagagattgggagttcaaaaccagcctgatcaacatggaaactccatctctactaaaaatacaaaattagctgggcgtggtggcacatgcctgtaatcccagctactcaggaggctgaggcagaagatcgcttgaacccgggaggcggaggttgccatgagccgagatcgcaccattgcactacagcctggacaacaacagcaaaactccgtctcaaaaaaaaaaaaatcagctaggcgtgctgacacgcatcgatagtcaccgctaccccagagaccaaggcaggaggatcacttaagcccaggagttcatggctgccgtgagctatgattacaccactgcacttcagcctgctcaatggagcaacaccctgactctaaaaacagtaataaaatgtttaaaatagaaaaaggggcggaggctgagattaacccagcgtcttgctcgagggcacattgctcctgagcagcagatctaagagcaggttccacggccgcgggtctcagaactcttgat

SEQ ID NO: 33391 - DNA, 601 bp, Human
aggctggagtgcaatggtgcgatctcggctcaccacaacctctgcctcctgggttcaagcgattctcctgccacagcctcctgagtaggtgggattacaggcatgcaacacgacccctgacgactttggtatttttagtagagacagggtttctccatgttggtcaggctggtctcgaactcccgacctgaggtgatccgcccacctcggcctctcaaagtgctgagattatgggcctgagccaccgtgcccggcagcaagtgccttttaacaacagaaagaactgggttcaaagctggarccgtgccgagcactctgaggcaggctcagctctcaccacgctgcaacttgccctggcttcacagcaggttctcgtgaccccgctgggagaacctgaaacgccggcaccgtggagttacaggcagtacccagccacaggagctcagccgtcgtggggtcacgagaccccgagtgcatttctttgctcagttacatttggggtccgctctgacgcacagctcatctcagctcctgcagtaacaagtcacattacgataaggctctggcggtactcaaatggctgaagcctggcgccaggcct

SEQ ID NO: 33392 - DNA, 601 bp, Human
gcatgatctcggctcacagcaacctccgcctcccaggttcacaccattctcctgcctcagcctcccaagtagctgggaatacaggcgcccgccaccacgcctggctaattttttgtatttttagtagagacggggtttcaccatgttagtcaggatggtctcgatctcctgacctcatgatccacccgcctcggcctcccaaagtgctgggattacaggcgtgagccaccgcgcccggccttttttttttttttttttgagacggagtttcattcttgttgcccaggctggagtgcaatgrtgcgatctcggctcaccacaacctctgcctcctgggttcaagcgattctcctgccacagcctcctgagtaggtgggattacaggcatgcaacacgacccctgacgactttggtatttttagtagagacagggtttctccatgttggtcaggctggtctcgaactcccgacctgaggtgatccgcccacctcggcctctcaaagtgctgagattatgggcctgagccaccgtgcccggcagcaagtgccttttaacaacagaaagaactgggttcaaagctggagccgtgccgagcactct

SEQ ID NO: 33393 - DNA, 601 bp, Human
acctgggaggtggaggttgcagtgaaccgagatcgctccagcctgggcaacagagtgagactccgtctctcaaaaaaaaaaaaaaaaaaaaacattaaaaaaaaaaagtagccgggcatggtggcacgtgcttttaatcccagttactcgggaggctgaggctggagaattgcttgaactagggagacggaggttgcagtgggccaagactgcaccactacacacctgcttgggtgacaaagcgagattctgtctcaaaatacacacacacacacacacacacacacatatatatatatattttttttttaactgctcattgacaatacgccagatcacctaagagctctgatgggagatgtacaaggaggtgaatgtcgctttcctgcctgcagacacaacatcccttctgcagcccatggatcaaggactagttttgactttcaagtcttattacttaagaaataccttctgtaagggtacaactgccatagtcatagtgattcctctcatggatctgggcaaagtaaactgaaaaccttctggaaaggattcaccattctagatgccattaaaaacattcatgattcatgggtggagg

SEQ ID NO: 33394 - DNA, 601 bp, Human
aacctgggaggtggaggttgcagtgaaccgagatcgctccagcctgggcaacagagtgagactccgtctctcaaaaaaaaaaaaaaaaaaaaacattaaaaaaaaaaagtagccgggcatggtggcacgtgcttttaatcccagttactcgggaggctgaggctggagaattgcttgaactagggagacggaggttgcagtgggccaagactgcaccactacacacctgcttgggtgacaaagcgagattctgtctcaaaatacacacacacacacacacacacacacatatatatatatwttttttttttaactgctcattgacaatacgccagatcacctaagagctctgatgggagatgtacaaggaggtgaatgtcgctttcctgcctgcagacacaacatcccttctgcagcccatggatcaaggactagttttgactttcaagtcttattacttaagaaataccttctgtaagggtacaactgccatagtcatagtgattcctctcatggatctgggcaaagtaaactgaaaaccttctggaaaggattcaccattctagatgccattaaaaacattcatgattcatgggtggag

SEQ ID NO: 33395 - DNA, 601 bp, Human
tcccagctactcaggaggctgaggcagagaatcactggaacctgggaggtggaggttgcagtgaaccgagatcgctccagcctgggcaacagagtgagactccgtctctcaaaaaaaaaaaaaaaaaaaaacattaaaaaaaaaaagtagccgggcatggtggcacgtgcttttaatcccagttactcgggaggctgaggctggagaattgcttgaactagggagacggaggttgcagtgggccaagactgcaccactacacacctgcttgggtgacaaagcgagattctgtctcaaaatccacacacacacacacacacacacacatatatatatatattttttttttaactgctcattgacaatacgccagatcacctaagagctctgatgggagatgtacaaggaggtgaatgtcgctttcctgcctgcagacacaacatcccttctgcagcccatggatcaaggactagttttgactttcaagtcttattacttaagaaataccttctgtaagggtacaactgccatagtcatagtgattcctctcatggatctgggcaaagtaaactgaaaaccttctggaaaggattcaccattc

SEQ ID NO: 33396 - DNA, 601 bp, Human
tctcagcctcctgagtagctaggattacaggggtgtgccatcacatccggctaattttttgtatttttagtagagacggggtttctccacgttggccaggctggtctcaaactcctgacctcaagcaatccgcccgccccaccctcccatagtgctgggattataggtgtgagccactgcacccagccagattaaagtatttaaaaacataaccttaaaggtataagaagaacacgctggtcattttattgatcttcttctactgaagagatccttttgaaacatgacataggctgggcgygatggtgggtgcctgtagtcccagctactcaggaggctgaggcagagaatcactggaacctgggaggtggaggttgcagtgaaccgagatcgctccagcctgggcaacagagtgagactccgtctctcaaaaaaaaaaaaaaaaaaaaacattaaaaaaaaaaagtagccgggcatggtggcacgtgcttttaatcccagttactcgggaggctgaggctggagaattgcttgaactagggagacggaggttgcagtgggccaagactgcaccactacacacctgcttgggtgacaaagc

SEQ ID NO: 33397 - DNA, 601 bp, Human
gtctcagcctcctgagtagctaggattacaggggtgtgccatcacatccggctaattttttgtatttttagtagagacggggtttctccacgttggccaggctggtctcaaactcctgacctcaagcaatccgcccgccccaccctcccatagtgctgggattataggtgtgagccactgcacccagccagattaaagtatttaaaaacataaccttaaaggtataagaagaacacgctggtcattttattgatcttcttctactgaagagatccttttgaaacatgacataggctgggcrcgatggtgggtgcctgtagtcccagctactcaggaggctgaggcagagaatcactggaacctgggaggtggaggttgcagtgaaccgagatcgctccagcctgggcaacagagtgagactccgtctctcaaaaaaaaaaaaaaaaaaaaacattaaaaaaaaaaagtagccgggcatggtggcacgtgcttttaatcccagttactcgggaggctgaggctggagaattgcttgaactagggagacggaggttgcagtgggccaagactgcaccactacacacctgcttgggtgacaaag

SEQ ID NO: 33398 - DNA, 601 bp, Human
cattcggggccactacctgtctccacgtcttggtggtagtggtcccccgggcccagctgtcttttatctctttgtcttgtgtctttatttctacactctctcgtctccgcacacagggagaaaacccactgaccctgtggggctggaccctacatgcacgcccctcaacagagcagctaccccacccccatctagaacccaggccctctgcggccattctaacttatttctcagtttatcctttttgttgttataaatgttatacttcccactaatcttacaactgctaggataactcttsatttttcatacttgcatttttattttttttttgagatggacccaggctggagtgcagtggtgcaatcttggctcactgcaacctctgccgcctgggttcaagcgattctcctgtctcagcctcctgagtagctaggattacaggggtgtgccatcacatccggctaattttttgtatttttagtagagacggggtttctccacgttggccaggctggtctcaaactcctgacctcaagcaatccgcccgccccaccctcccatagtgctgggattataggtgtgagccactgcacccagc

SEQ ID NO: 33399 - DNA, 601 bp, Human
aaaaacacccactacttagcagagtttagagaagactctactcctccacctcttgtggagggcctgacatcagtcaggcccgcgcacagttatccggaggcctaaccatcaacctgtgatgctgtgcttcagtggtcacactcctagtctgctttcatgttccatcctgtacacgtggctctgccttttagataacagtagcaaaattagtgaaagtactaaaagtctctgatatgcagaaataatggcataagctgtctctctctctccctctctctctacctcagctgccaggcagggragggccccctgtccagtgggcacgtgacccacgtgaccttacttatcattggagatgactcacactctttaccctgccccttttgctttgtatccaataaataacagcacagcctgacattcggggccactacctgtctccacgtcttggtggtagtggtcccccgggcccagctgtcttttatctctttgtcttgtgtctttatttctacactctctcgtctccgcacacagggagaaaacccactgaccctgtggggctggaccctacatgcacgcccctcaacagagcagctacccc

SEQ ID NO: 33400 - DNA, 601 bp, Human
ggaagacgcccattgccaagcagaccatggtctagcggtagcatcagtgtcaaggaaaaacacccactacttagcagagtttagagaagactctactcctccacctcttgtggagggcctgacatcagtcaggcccgcgcacagttatccggaggcctaaccatcaacctgtgatgctgtgcttcagtggtcacactcctagtctgctttcatgttccatcctgtacacgtggctctgccttttagataacagtagcaaaattagtgaaagtactaaaagtctctgatatgcagaaataayggcataagctgtctctctctctccctctctctctacctcagctgccaggcaggggagggccccctgtccagtgggcacgtgacccacgtgaccttacttatcattggagatgactcacactctttaccctgccccttttgctttgtatccaataaataacagcacagcctgacattcggggccactacctgtctccacgtcttggtggtagtggtcccccgggcccagctgtcttttatctctttgtcttgtgtctttatttctacactctctcgtctccgcacacagggagaaaaccca

SEQ ID NO: 33401 - DNA, 601 bp, Human
aatctcagctacttgggaggatgaggcaggagaatcacttgaacccaggaggtggaggtcgtaataagccgagatcatgccactgcactccagcctgggtgacagagtgagaccctgtctccaaaacaaaaaaaaatttcttcaaaaaggaagaacattctgttgaactataaccaccttaaatccataatttcctccgcctgcccacatctgcttgcacgtgtgggcggcaagccacccaggtgccgaggcaagagactgaggacgcgaactgttccagtataataaagtatataaaataagaatagttataccagatatagatcttagatatgattatatatgaatatcattaatcattagtttgcagcaattactttttattccaatattataataatcctcactctacaatcataacctaggaaaaaccaggccatacagagataggagctgaggggacacagtgagaagtgaccagaagacaagtgcgagccttctgttatgcccagacagggccaccagagggctcctgggtctagcggtaacgccagcatctgggaagacgcccattgccaagcagaccatggtctagcggtag

SEQ ID NO: 33402 - DNA, 601 bp, Human
tctactaaaaatacaaaaaaatgagccaggcatggtggcacacacctgtaatctcagctacttgggaggatgaggcaggagaatcacttgaacccaggaggtggaggtcgtaataagccgagatcatgccactgcactccagcctgggtgacagagtgagaccctgtctccaaaacaaaaaaaaatttcttcaaaaaggaagaacattctgttgaactataaccaccttaaatccataatttcctccgcctgcccacatctgcttgcacgtgtgggcggcaagccacccaggtgccgaggmaagagactgaggacgcgaactgttccagtataataaagtatataaaataagaatagttataccagatatagatcttagatatgattatatatgaatatcattaatcattagtttgcagcaattactttttattccaatattataataatcctcactctacaatcataacctaggaaaaaccaggccatacagagataggagctgaggggacacagtgagaagtgaccagaagacaagtgcgagccttctgttatgcccagacagggccaccagagggctcctgggtctagcggtaacgcc

SEQ ID NO: 33403 - DNA, 601 bp, Human
cgtctctactaaaaatacaaaaaaatgagccaggcatggtggcacacacctgtaatctcagctacttgggaggatgaggcaggagaatcacttgaacccaggaggtggaggtcgtaataagccgagatcatgccactgcactccagcctgggtgacagagtgagaccctgtctccaaaacaaaaaaaaatttcttcaaaaaggaagaacattctgttgaactataaccaccttaaatccataatttcctccgcctgcccacatctgcttgcacgtgtgggcggcaagccacccaggtgccraggcaagagactgaggacgcgaactgttccagtataataaagtatataaaataagaatagttataccagatatagatcttagatatgattatatatgaatatcattaatcattagtttgcagcaattactttttattccaatattataataatcctcactctacaatcataacctaggaaaaaccaggccatacagagataggagctgaggggacacagtgagaagtgaccagaagacaagtgcgagccttctgttatgcccagacagggccaccagagggctcctgggtctagcggtaa

SEQ ID NO: 33404 - DNA, 601 bp, Human
gcatttgaatcttcagttctgtaatcggccagagaccggattttgcttgatttggaagtttttttctccctaggatgtgccggaagccccaggctgcccaccttaggcccccgagggacactggtgcgcaggaaggaatattcttttgtcatagccagggtactggcccttggtaagttttctgggtttaacatgagctcaggatcaagcgtgctaaaaagtctcgttttggttgcaggttgactggactgagaagaaaacaaaagtacaaaaattacatttaaaatccacaagcagcatwcttaaaactgccattcagaaaggtggcaccgatcactactccctccgctgacaaccagagagcaccacctccccagcccctcaccacacagggtgcggccaggcctccgatccgtggtggtctcactgccgcaaggccccactctagtgaccagcatgaccacctctggtctaaagcacactcttcagtgactgtgacctcaacacgtttaaaacacatcccagcaagtacctcctcatcagacttctgtagggaccagccccacagggtcagtgggtctccccctgtgtgcggcgacga

SEQ ID NO: 33405 - DNA, 601 bp, Human
tgtgcgagccatcctcattttccttcacactcctccacattctccaaattccacacacccctgctgctctctcccaattttttaaaattaagtaagagatttaagtagagagctgaggcttgcatgatgcacggatgaacattcctgccaacagttggcacctcacgcagtgggaactgttacagaaacatgagacatgcaagcgtcgtgcagcttagtgacaagtctatgtaaacgggagactggatattttagtaacacagaccattgctgatctaattctactgattaaaaagcagcrgacttgttatgaattaaatgttcatgtcaagactaaggatagaatcaggaagaaaagctgtgtatcgcctgttccagtgcggagagccgtgggcccgggaagcaacatctcaggccaggccctctgcctgccctgcccgtctctgcccaccccgccccctctgttggccccacccacctctgctaccgccccacccacctctgcccgccccacacccccctctgttggccccacccacctccacccaccccgcccacctctgctgtccccaccacctgctgcagatgctgtctctccgac

SEQ ID NO: 33406 - DNA, 601 bp, Human
ctcgcctccagtgacaaggcttccagctgtccttcgagtcgcattttctctttgagcacctgcagcatctcctcctgtgtttctgctgcagagctctccaaggacacgctggggacaaaggcacgggtcaggcctgtgcgagccatcctcattttccttcacactcctccacattctccaaattccacacacccctgctgctctctcccaattttttaaaattaagtaagagatttaagtagagagctgaggcttgcatgatgcacggatgaacattcctgccaacagttggcacctcacrcagtgggaactgttacagaaacatgagacatgcaagcgtcgtgcagcttagtgacaagtctatgtaaacgggagactggatattttagtaacacagaccattgctgatctaattctactgattaaaaagcagcagacttgttatgaattaaatgttcatgtcaagactaaggatagaatcaggaagaaaagctgtgtatcgcctgttccagtgcggagagccgtgggcccgggaagcaacatctcaggccaggccctctgcctgccctgcccgtctctgcccaccccgccccctctgttg

SEQ ID NO: 33407 - DNA, 601 bp, Human
agccttctctttaagtgcctgaaaagatcccaacaaccacaatgattttaagaaaacgagtcacttccatccagtgtattaacaggaacacaaccagcgagtcagtcagggcctgacaggggaccccgagacccccaggcgctctcccaaggcctgacagaggaccccaagacccccaggcgctctcccaaggcctgacaggggaccccaagacccccaggcgctctcccaaggcctgacaggggaccccaagacccccaggcgctctcccaaggcctgacagaggaccctgccccgagamccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacagaggaccccgagacccccaggcgctctcccagcacagccgtcacagaaaaaggcgactttccaaacag

SEQ ID NO: 33408 - DNA, 601 bp, Human
aataacactggacttttgaggcaggatcaccgcagatactccagggtccaaggtcaatctccaagacctaattcattcccctggatgtgcacacaaaaatgtacacaattccacaagttcaactaaaacttgtatttcctttagaaaagcagcctccttatgtgtaaactataaaccaatgcaaccctcacaggcacagtcacatgccgacagagctgtcagcaccagggaggagggcgtggcggggaccagtcagggaaggagggtgtggcggggaccagtcgaggaaggagggagcagyggggaccagtcgaggaaggaggagggagcagcaaggaccagtcagggaaggaggagggcgtggcgggggccagtcgaggaaggaggagggagcagcagggaccagtcagggaggggagggcgtggccagggccagcctcacctgtgttgtccttgctgagcatgctcctctgcatgtcctctaccttggccataagcctctggtactgctcctcggccacctgcaagtcgttgttggacgacgccaggctggcattttttgcctccagcatgttctgcaggtcagtcatggctcgctcca

SEQ ID NO: 33409 - DNA, 601 bp, Human
agggaggcagctggaccgacgcactgcatccagggagaaaaggttgccagacggacagtcaaggagctgttcttgaatattttaaatggaatctgcaattctgtggaataagtgggcagctctatactcccaaataacactggacttttgaggcaggatcaccgcagatactccagggtccaaggtcaatctccaagacctaattcattcccctggatgtgcacacaaaaatgtacacaattccacaagttcaactaaaacttgtatttcctttagaaaagcagcctccttatgtgtaaaytataaaccaatgcaaccctcacaggcacagtcacatgccgacagagctgtcagcaccagggaggagggcgtggcggggaccagtcagggaaggagggtgtggcggggaccagtcgaggaaggagggagcagcggggaccagtcgaggaaggaggagggagcagcaaggaccagtcagggaaggaggagggcgtggcgggggccagtcgaggaaggaggagggagcagcagggaccagtcagggaggggagggcgtggccagggccagcctcacctgtgttgtccttgctgagcatgctcc

SEQ ID NO: 33410 - DNA, 601 bp, Human
aatccactgccctacttgtactctctgggcgagccctatagggaggcagctggaccgacgcactgcatccagggagaaaaggttgccagacggacagtcaaggagctgttcttgaatattttaaatggaatctgcaattctgtggaataagtgggcagctctatactcccaaataacactggacttttgaggcaggatcaccgcagatactccagggtccaaggtcaatctccaagacctaattcattcccctggatgtgcacacaaaaatgtacacaattccacaagttcaactaaaacytgtatttcctttagaaaagcagcctccttatgtgtaaactataaaccaatgcaaccctcacaggcacagtcacatgccgacagagctgtcagcaccagggaggagggcgtggcggggaccagtcagggaaggagggtgtggcggggaccagtcgaggaaggagggagcagcggggaccagtcgaggaaggaggagggagcagcaaggaccagtcagggaaggaggagggcgtggcgggggccagtcgaggaaggaggagggagcagcagggaccagtcagggaggggagggcgtggccag

SEQ ID NO: 33411 - DNA, 601 bp, Human
cgggctttgtcttcaatcttcccaccctgcttcgccctctccttcccactcctgttcacgcttgctctgagcaggccaaccacagtcttctccgtgtctgctgggcactggagtgtgagctctgggactggcccgggcggggactgagggggtggaaggcgtgctgccaagccacatggaagcccgccgcggcttccgcaatccactgccctacttgtactctctgggcgagccctatagggaggcagctggaccgacgcactgcatccagggagaaaaggttgccagacggacagtcaargagctgttcttgaatattttaaatggaatctgcaattctgtggaataagtgggcagctctatactcccaaataacactggacttttgaggcaggatcaccgcagatactccagggtccaaggtcaatctccaagacctaattcattcccctggatgtgcacacaaaaatgtacacaattccacaagttcaactaaaacttgtatttcctttagaaaagcagcctccttatgtgtaaactataaaccaatgcaaccctcacaggcacagtcacatgccgacagagctgtcagcaccaggga

SEQ ID NO: 33412 - DNA, 601 bp, Human
ggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggcagagtatcctgccctcctcagcgggcgcctaggatgactcacgtactctgctgctccacacgtgtccatgaatactgagtttgtggttcaaacaaatttaatcaagtcggcaaattcacacttaggaaatctgtgaaaatggtcatggacgccgaggctctg

SEQ ID NO: 33413 - DNA, 601 bp, Human
cgggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggcagagtatcctgccctcctcagcgggcgcctaggatgactcacgtactctgctgctccacacgtgtccatgaatactgagtttgtggttcaaacaaatttaatcaagtcggcaaattcacacttaggaaatctgtgaaaatggtcatggacgccgaggctc

SEQ ID NO: 33414 - DNA, 601 bp, Human
gccgggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggcagagtatcctgccctcctcagcgggcgcctaggatgactcacgtactctgctgctccacacgtgtccatgaatactgagtttgtggttcaaacaaatttaatcaagtcggcaaattcacacttaggaaatctgtgaaaatggtcatggacgccgaggc

SEQ ID NO: 33415 - DNA, 601 bp, Human
gttggccgggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggcagagtatcctgccctcctcagcgggcgcctaggatgactcacgtactctgctgctccacacgtgtccatgaatactgagtttgtggttcaaacaaatttaatcaagtcggcaaattcacacttaggaaatctgtgaaaatggtcatggacgccg

SEQ ID NO: 33416 - DNA, 601 bp, Human
tgaagtacatcttctccatgaaacacctcacatcctctctgtgtttaaaaacactagacagtgttggccgggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatsgcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggcagagtatcctgccctcctcagcgggcgcctaggatgactcacgtactctgctgctccacacgtgtccatgaatactgagtttgtggttcaaa

SEQ ID NO: 33417 - DNA, 601 bp, Human
atctcaaagacaaatgaatttttaaaaacaaaaagaaaatttaaaaaaatagaaacaggatgaattgaaaaaaataaaccaaaagaaaaaaatgaagtacatcttctccatgaaacacctcacatcctctctgtgtttaaaaacactagacagtgttggccgggcacagtggctcacgcctgtaatcccagcactttgggaggctgaggcgggcggatcacctgaggttgggagttcgagaccagcctggccaacatggagaaaccctgtctctaataaaaatacaaaattagccgggcgyggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggc

SEQ ID NO: 33418 - DNA, 601 bp, Human
caacccatctcaaagacaaatgaatttttaaaaacaaaaagaaaatttaaaaaaatagaaacaggatgaattgaaaaaaataaaccaaaagaaaaaaatgaagtacatcttctccatgaaacacctcacatcctctctgtgtttaaaaacactagacagtgttggccgggcacagtggctcacgcctgtaatcccagcactttgggaggctgaggcgggcggatcacctgaggttgggagttcgagaccagcctggccaacatggagaaaccctgtctctaataaaaatacaaaattagcygggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaag

SEQ ID NO: 33419 - DNA, 601 bp, Human
tagccaggcggggtggcatgcatctgtggtcccagccacttgggaggctgaggcgggcggatcccatgagcccaggagtttgaggctgcagtgagccacaactgcactgctgcactccagcgtgggcaacagagcaacccatctcaaagacaaatgaatttttaaaaacaaaaagaaaatttaaaaaaatagaaacaggatgaattgaaaaaaataaaccaaaagaaaaaaatgaagtacatcttctccatgaaacacctcacatcctctctgtgtttaaaaacactagacagtgttggcygggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaac

SEQ ID NO: 33420 - DNA, 601 bp, Human
taacagtggccggacacgggggtgcagggggcatggggggtgcagggggcacaggggtgcacgcccaggagatccagaccagcctgggcaacacagcgagatcccccaccaccaaaaaaaaaaaattagccaggcggggtggcatgcatctgtggtcccagccacttgggaggctgaggcgggcggatcccatgagcccaggagtttgaggctgcagtgagccacaactgcactgctgcactccagcgtgggcaacagagcaacccatctcaaagacaaatgaatttttaaaaacaaaaakaaaatttaaaaaaatagaaacaggatgaattgaaaaaaataaaccaaaagaaaaaaatgaagtacatcttctccatgaaacacctcacatcctctctgtgtttaaaaacactagacagtgttggccgggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactaggga

SEQ ID NO: 33421 - DNA, 601 bp, Human
cgtgggactcccatgtcagaaggttgggggggggcccacgggacacgtcctgcatacgacacgtcctacatgggacacggggtgggctggacagcaggttaaaaacaaaaacatgcctgtgaactctaaaaacagaaaaatctcaggaaaaagcaccgttctacatgaagacaagaagcgtgacctgccctggaaggtagatgtgggccgtacctggatgtgggccatctcaccctgcagcctgacgcgggcctcctgtgccagggcgagctgctgctggtaccactgccggacactctgyagggacgagatctccgcctgcgacgccttcagcttgctggtcagcgtcgtccgctccagctgcacctgctgaagctggctctgcaaggctgtcatctgctgtcgcaggtcgtgcactgaaatggggcaagcacagcggctcaggccagcgacggccaacgggggagtccgcagctccgcgcgtgcgggacacaaggcgggactctcaggggagaccaagaatgagtcagttccggttattccccatagctgactccatgaagtcgccgtgaacacggcattagtgggcgctgagagatgc

SEQ ID NO: 33422 - DNA, 601 bp, Human
acagcagagtggggaggctgaggtgggagggtcctgagacccaggcagatgaggattcacaggcacgcaacactgtgccgagtcaggaggccagggtgggagggtcccgagacccaggcaaatgaggattcaccggcatgtgtcaccatgcccagcaagagaggctttggaactgaaaatgctggcagaggctgccgtgggactcccatgtcagaaggttgggggggggcccacgggacacgtcctgcatacgacacgtcctacatgggacacggggtgggctggacagcaggttaaaaacaaaaacatgcctgtgaactctaaaaacagaaaaatctcaggaaaaagcaccgttctacatgaagacaagaagcgtgacctgccctggaaggtagatgtgggccgtacctggatgtgggccatctcaccctgcagcctgacgcgggcctcctgtgccagggcgagctgctgctggtaccactgccggacactctgcagggacgagatctccgcctgcgacgccttcagcttgctggtcagcgtcgtccgctccagctgcacctgctgaagctggctctgcaaggctgtcatctgctgtcgc

SEQ ID NO: 33423 - DNA, 601 bp, Human
aaaaaaaaccaaaaacaaaaagactgaggctgaccaaaggtactcttcagcatctctgaggtcatcctaattagtctaggtgctgagactcggatcgaggtgcactcgaaccattcgcctgtcggtctgggcgtctccagcacacgaagcagttgctgtgggccgaggcacaggcctggacggacacacactcccacatatgcgggaccaagctggacatgggctgtgcccgctaacgagtggacgggagaggaaagagttttccaacaggacgtagaaaatgcaaggcctgctgggaagacgtggtccccgtgtatcactgagggctcaggcagcagggaaaggaaaagctccaaccgggaagagaaccccactggcaccgcacgcctgtgagacatcacagcagagtggggaggctgaggtgggagggtcctgagacccaggcagatgaggattcacaggcacgcaacactgtgccgagtcaggaggccagggtgggagggtcccgagacccaggcaaatgaggattcaccggcatgtgtcaccatgcccagcaagagaggctttggaactgaaaatgctggcagaggctgccgtggga

SEQ ID NO: 33424 - DNA, 601 bp, Human
tcgggatcacctggggcctgggtccagcctgaagggctgcagggacttacctgctccagctgctgctccagggatgccgccgagtccgccatcctctgcagccgctccctctcaccttcaaactcttccagcctcctctgaaggtcctcctccaccatcgtctttgcctcctgaatctgcatgaaggctgcttcctgatccaacatgtcagcctgagcccaggaaacttgtttttaaaaaggcaggaaaccttaatagtgaacagcagccggtggccccgtgctctgcagagaaacccacygccctggcatgggccccatccacctcctcatcctgtctaccgactgcagactgagggcccaggatgggcagcttggccgccccccaaccaggagaccgaggccaggcccagcccaggccagcaaccccatgagaaggacttggacccactggtgagcagagcctccccgactttctcgtgtggcgacagctgcctcctttcgggagtgagacccggacatgctctcacaagagcggtgcttggtgctaccgggtaagagaccagaggcccccgcagtgaacacagcctcacatcggggta

SEQ ID NO: 33425 - DNA, 601 bp, Human
ccagcactgtgggagaccgaggcgggtggatcacttgaggttaggagtttgagactagcctggccaacatggcgaaaccccatctctactacaaatacaaaaattagctgggcatggtggcgcacacctgtaatcccagctactcaggaggctgaggcacaagaattgcctgaacctgggaggtggaggttgcagtgagcgcagatcatcccactgcactccagcctgggcaacacagcgagactgtttcaaaaaaaaaagaaagaaagaaagaagcaaataatcagcatcattcctgcamggagggttctgattcaaaacaaaacacagcagaatgcattacctggccggatttgatagctaattcttctcttaacttctctaaagtttccgacgtttcctcggtaccttcttccaagcgtcttgctcctctgtcaagctcctccttgccactcttggccgcctgcaaagccgcctccaagatgatcttctcgttctgcaggaggcagatcgtgtcctccctggaggcggcctcgccctgcagctcccccagcctggcctgcagctcatcgtagtgtgtctgcagggcatcgagggactg

SEQ ID NO: 33426 - DNA, 601 bp, Human
gggctccacacggacccaccccacgggatctccactcggagggctccacacggaccgaccacacgggacctgcactcggagggctccacacagacccaccacacgggatctgcactcggagggccccacacagacccaccccacgggacctgcactcggagggctccacacagacccaccacacgggatctgaactcggagggctccacacagacagaccgcacgggacccgcactcggagggctccacacagacccaccgcacgggacccgcactcggagggctccacacagacccaccscacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccacacgggatctgcactcggagggctccatacagacccacggcacaggacctgcacttggagggtcccggaggactcaggaatccatgtgtttgtgaaacac

SEQ ID NO: 33427 - DNA, 601 bp, Human
gggctccacacagacccaccccacgggacctgcactccgagggctccacacagaccgaccgcacgggacctgcactcggagggctccacacagacccaccacacgggatctgcactcggagggctccacacggaccgaccgcacgggacctgcactcggagggctccacacggactgaccgcacgggacctgcactcggagggctccacacggacccaccccacgggatctccactcggagggctccacacggaccgaccacacgggacctgcactcggagggctccacacagacccaccmcacgggatctgcactcggagggccccacacagacccaccccacgggacctgcactcggagggctccacacagacccaccacacgggatctgaactcggagggctccacacagacagaccgcacgggacccgcactcggagggctccacacagacccaccgcacgggacccgcactcggagggctccacacagacccaccccacgggacccgcactcggagggctccacacagacccaccgcacgggacccgcactcggagggctccacacagacccaccgcacgggacccgcactcggag

SEQ ID NO: 33428 - DNA, 601 bp, Human
cagagcctcgggccccacacagacccaccgcacaggacctgcactcagagggctccacacagacccaccccacgggacctgcactccgagggctccacacagaccgaccgcacgggacctgcactcggagggctccacacagacccaccacacgggatctgcactcggagggctccacacggaccgaccgcacgggacctgcactcggagggctccacacggactgaccgcacgggacctgcactcggagggctccacacggacccaccccacgggatctccactcggagggctccacacrgaccgaccacacgggacctgcactcggagggctccacacagacccaccacacgggatctgcactcggagggccccacacagacccaccccacgggacctgcactcggagggctccacacagacccaccacacgggatctgaactcggagggctccacacagacagaccgcacgggacccgcactcggagggctccacacagacccaccgcacgggacccgcactcggagggctccacacagacccaccccacgggacccgcactcggagggctccacacagacccaccgcacgggacccg

SEQ ID NO: 33429 - DNA, 601 bp, Human
gggctacagcagggggacacatctacacagatgttacactgagggctccaggaggggccacatctgcagagatgttacactgagggctccagaaggggccacatctgcagcgatgttacactgagagctccaggaaaggacacatctgcagagttgttacactgagggctccagaaggggacacatctgcagagatgttacactgagggctccaggaaaggacacatctgcagagttgttacactgaggactataggaggggaatgtgtctgcacagatgttacactgagggctccaagasggggatgcatgtgcatgaatattacactgagggctacagcagggggacacatctacacagatgttacactgagggctccaggagggggatgcaactacacagacattacactgatggctccaggagggcacacatctgcacagatgttataggaagaagcacttgtgttctgacgggaactggtggttcctaaggcctgggctctccctcctcaccactgacagcatgaaggcacagtgagtggcagggaggtgggagaggggatgaggccaggggacactgcagcccagggctcggcaa

SEQ ID NO: 33430 - DNA, 601 bp, Human
gtctcaaaaaaactaaattacaggccgggcgtggtggctcatgcctgtaatcccagcactttgggaggccaaggtgggcggatcacgaggtcaggagattgagaccatcctggctaacacggtgaaaccccgtctctactaaaaatgcaaaaaaaaattagtcgggcgtggtggccggtgcctgtagtcccagctactcaggaggctgaggcaagagaatggcgtgaacctgggaggcggagcttgcagtgagccgagatcgcaccactgccctccagcctggggtacagagcgagacttmatctcaaaaataaaataaaataaaatacagcagcgctcacaacgctgcttcaggggtcaccctcgctcagaaataaaacacagcagcactcacaatatagcttcggggtcacccttgctcagatcccataaaatccaacaggaggtactggcttcactgacacaaaatttatattccatgtctttttggataaccaaaatttgtttcaatgctggaactctatgtgcatttttcaaagacattttaaatggcaaacccaacctgtgtgttaacaacactgcacaacacacagctccctgg

SEQ ID NO: 33431 - DNA, 601 bp, Human
ggcagttggaggttgcagtgagcggagacagcactactgcactccagcccgggcgacacagccagactctgtctcaaaaaaactaaattacaggccgggcgtggtggctcatgcctgtaatcccagcactttgggaggccaaggtgggcggatcacgaggtcaggagattgagaccatcctggctaacacggtgaaaccccgtctctactaaaaatgcaaaaaaaaattagtcgggcgtggtggccggtgcctgtagtcccagctactcaggaggctgaggcaagagaatggcgtgaacckgggaggcggagcttgcagtgagccgagatcgcaccactgccctccagcctggggtacagagcgagacttcatctcaaaaataaaataaaataaaatacagcagcgctcacaacgctgcttcaggggtcaccctcgctcagaaataaaacacagcagcactcacaatatagcttcggggtcacccttgctcagatcccataaaatccaacaggaggtactggcttcactgacacaaaatttatattccatgtctttttggataaccaaaatttgtttcaatgctggaactctatgtgcatt

SEQ ID NO: 33432 - DNA, 601 bp, Human
tacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggaggttgcagtgagcggagacagcactactgcactccagcccgggcgacacagccagactctgtctcaaaaaaactaaawtacaggccgggcgtggtggctcatgcctgtaatcccagcactttgggaggccaaggtgggcggatcacgaggtcaggagattgagaccatcctggctaacacggtgaaaccccgtctctactaaaaatgcaaaaaaaaattagtcgggcgtggtggccggtgcctgtagtcccagctactcaggaggctgaggcaagagaatggcgtgaacctgggaggcggagcttgcagtgagccgagatcgcaccactgccctccagcctggggtacagagcgagacttcatctcaaaaataaaata

SEQ ID NO: 33433 - DNA, 601 bp, Human
taaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggaggttgcagtgagcggagacagcactactgcactccagcccgggcgacacagccagactctgtctcaaaaaaamtaaattacaggccgggcgtggtggctcatgcctgtaatcccagcactttgggaggccaaggtgggcggatcacgaggtcaggagattgagaccatcctggctaacacggtgaaaccccgtctctactaaaaatgcaaaaaaaaattagtcgggcgtggtggccggtgcctgtagtcccagctactcaggaggctgaggcaagagaatggcgtgaacctgggaggcggagcttgcagtgagccgagatcgcaccactgccctccagcctggggtacagagcgagacttcatctcaaaaata

SEQ ID NO: 33434 - DNA, 601 bp, Human
atgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccacttcaggggccgcccttgttcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggaggttgca

SEQ ID NO: 33435 - DNA, 601 bp, Human
aaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccacttcaggggccgccattgctcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggaggt

SEQ ID NO: 33436 - DNA, 601 bp, Human
caaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccacttcaggggccgcacttgctcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggagg

SEQ ID NO: 33437 - DNA, 601 bp, Human
acaaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccacttcaggggccgtccttgctcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggag

SEQ ID NO: 33438 - DNA, 601 bp, Human
aacaaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccacttcaggggccgcccttgctcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttgga

SEQ ID NO: 33439 - DNA, 601 bp, Human
caagctggcttcaacaaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccrcttcaggggccgcccttgctcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaac

SEQ ID NO: 33440 - DNA, 601 bp, Human
tctgtgaccgcgaccatctgctccttatcgaactgcaacgactttggaagggaaggagggcgtgaggagcggcactgccacccccagcctgtctccccttcctggctccagcccatcacccccaccaaaggcactgctcaggctcgccctggaggacttgggccttgagaaaaatcctgagagagacgtctgccttcttacaaaccactcttttttttttttattgagatggagtctcactctgtcacccaggctggagtgcaggggcgtgatctcagctcactgcaacctccgcctcccrggttcaagtgattctcctgcctcagcctcccgagtggctgggactacaggtgcccgccaccatgcccagctaatttttgtatttttagtagagacagggtttcaccatattggtcaggctagtcttgaactcctgacctcgtgatccacctgcctcggcctcccaaagtgctgggattacaggtgtgagccactgcacccggccacaaaccactcattactgagaccaacaagcatttccaaacactgtccagagcatcagaggcacaacaggacatgactggttcataggaaagcctgt

SEQ ID NO: 33441 - DNA, 601 bp, Human
gaaatactaagttgtcagtgcaaggacgtgaattggagaataataaataaaatgcggatgaactcactcaggtagaatgttatgcctaccacgaaaggtgacagagcacggagggccacggcctccacggaaggctctgctcagagccctccagaaagggcacccgcttgttctgggccaccgcagcatggctacctctaaacgctccctgaaccctgtcaatcgctgaccccatgccctcactcctgcttctcagtgagtgcggaggctgcttttcctcctgagatgcgaggaggcgcasaggcagctggaacgcgagcggaccagggcaggccctccctctgccccaagggagcagctgaacttctctgagccaaggagatttcttgaggaaaatcaggtgaacgccacaggccacaggccatgtggggttcatgagggagacgcgaggcaatgctcagtcactgtgggttcctggtaacctcgaagatgagcgggagtttagagagttgccacctcccacgcgagctcggccccgctaggctttaggggacaactgctgatggagagcccttccctgcactgaggggctggtgaccct

SEQ ID NO: 33442 - DNA, 601 bp, Human
cccacttgctgcctcgatggtaccaggcccttgccaagcatgttccagtaccacctaacttaacccttacatgagaaggttctcattcacctcaatttggcctcattttgctgaggatcaaaaaggtgagaaatttgccaaaagtcaccacttgcgaggggtgaagcccggacggacacaagacatcggctcgcagctgtgctattcctcagctgcaacagcgtggcgaggggccagctctgcccggcctttgcgacctccccaccccagcccttagtgagcccaaagaaaatggcaactraatcaatctccccaacattttacaaagcaaccaggtgagaggaagcacttgatttatttattgaatttcagacacagagtctctatcgcccgggctggagtgcagcagcaaaatcatgactcactgcagtttcagcctcacctcccaggctgaggcgatcctcccacctcagtgtctcaagcatctgtgtccacaggcacgtgctaccatgcctgggttttatttttgtattatttgtaaatacagggtctaattatgttgcccaggctggtctcaaactcctgtgctcaagcgatcctc

SEQ ID NO: 33443 - DNA, 601 bp, Human
cacacgctgcacacacacatgctcacacctcacacatgcacggatacatgcaggcacaggtgtgctctcacaccccgcccacttgctgcctcgatggtaccaggcccttgccaagcatgttccagtaccacctaacttaacccttacatgagaaggttctcattcacctcaatttggcctcattttgctgaggatcaaaaaggtgagaaatttgccaaaagtcaccacttgcgaggggtgaagcccggacggacacaagacatcggctcgcagctgtgctattcctcagctgcaacagcgyggcgaggggccagctctgcccggcctttgcgacctccccaccccagcccttagtgagcccaaagaaaatggcaactgaatcaatctccccaacattttacaaagcaaccaggtgagaggaagcacttgatttatttattgaatttcagacacagagtctctatcgcccgggctggagtgcagcagcaaaatcatgactcactgcagtttcagcctcacctcccaggctgaggcgatcctcccacctcagtgtctcaagcatctgtgtccacaggcacgtgctaccatgcctgggttttat

SEQ ID NO: 33444 - DNA, 601 bp, Human
aagaaacagcgaaaacttaggccaggcgcagaggctcacgcctgtaatcacagcacattgggaggccgaggcagggggatcacctgaggtcaggagtttgagaccagcctggccaacatggtgaaaccccgtccctactgaaaatacaaaaattagccactatcgtggcacatgcctttagtcccagctactcaggaggctgaggcagaaggatcgcttgaacccaggaggtggaggttgcagtgagctgagattgtgcccctgcactccagcctgggcaacacagcgagactctgtctcaaaaaaaaaaaaaaaaagaaaaagaaaagaaaagaaacatcgaaaactaaaacacagcaatgggctggacgcagtgactcacacctgtaatcccagcactttgggaggtcaggggtttgagaccagcctagccaacatgatgaaaccctgtctctaccaaaactacagaaattatccaggtgtggtggcgatcacctgtagttccagctactcaggagaatgaggcgggagaatcacttgaacctgggaagtggaggctgtggtgagccaagattgtgcactccagcctgaatgacagagt

SEQ ID NO: 33445 - DNA, 601 bp, Human
gtgaactgagcacacgcaggggctccagcctcacctcagagagcccagccctgcaccaacagctggggactcagggctgtgggtcacccagacccctgagcctgttcctcccctcggagagcccagccctgcaccaacagctggggacccagggccgtgggtcacccggactcctgagcctgttctctcggctgcaggccgggtgggctaggagtcagcacaggtgactgaatctggatgagattctcggagtgcgcacagccccaccaactctcacaccgttgctggcgtgagtttgacragtttgaatacctgaaggttcaactggactaggtctgcctccctcttggccaaagctgtttctaggatgctgttgtgttcccgcagagctgcgttggactgaccgaggcccgtaagcttccctttctcgtgctctaattcaagagccaacttcttgtttgactcctcaaggcgttttatcttcttcctaaagcctctggattcttgaagctgaaacataccaatgtcactgtaaaattacctgcactggtgagtggagttcacataccccagaaacaggtgagttttcaacaagaaacag

SEQ ID NO: 33446 - DNA, 601 bp, Human
cttctccctctccttctctagtgaggcctgcagggcctggacaagatgcttcatctggcgatcctcctcttctttgcgctgcaaaactgcctgcacctagatcagattgcaggaggacagataaggaaggacgtcgaattacaaacacacaaggctgctacagcaggcaacgtgacacacgccacatcacaggcacacgccagggaggtagagggaacttcactgctgaagaatctgtgacaaaacagaatcctaggttgcgggagcatgatcacagggccgcactcaagaacgtggcacrcctgtgggccccacggctccagaggccagggcaggaggatcgctggagcccaggaggttgaggatgcagtgagctatgatggtaccaccgcactgccctccactccgggcaagagccagaccctgtctcaaaaaaaaaagaatgggccgggcgcggtggctcacacctgtaatcccagcactttgggaggccgaggcaggcggatgacagtcagaaaatcgagaccatcctggctaacacagtgaaaccttgtctctactaaaaatatgaaaaattagctgggcgcggtggtgcacgcct

SEQ ID NO: 33447 - DNA, 601 bp, Human
cctctggaacgccctgtgagacggaaggtggcacgcacctgctccttgaggctgttcaccttctccctctccttctctagtgaggcctgcagggcctggacaagatgcttcatctggcgatcctcctcttctttgcgctgcaaaactgcctgcacctagatcagattgcaggaggacagataaggaaggacgtcgaattacaaacacacaaggctgctacagcaggcaacgtgacacacgccacatcacaggcacacgccagggaggtagagggaacttcactgctgaagaatctgtgacaaaacagaatcctaggttgcgggagcatgatcacagggccgcactcaagaacgtggcacacctgtgggccccacggctccagaggccagggcaggaggatcgctggagcccaggaggttgaggatgcagtgagctatgatggtaccaccgcactgccctccactccgggcaagagccagaccctgtctcaaaaaaaaaagaatgggccgggcgcggtggctcacacctgtaatcccagcactttgggaggccgaggcaggcggatgacagtcagaaaatcgagaccatcctggctaacaca

SEQ ID NO: 33448 - DNA, 601 bp, Human
cgacatacaggacaccactcccagcacaatataaatacacatgcacgcggagctcattggccccaggccctcacagctgcactgccatttaatctaacgccaccttctacggaccagagcaggtgctctgcggcctccgtcaccaacaactgcaacacacctttgctctgtgtaactgctggaaggaggctggtgtgtgaaggaccctgcatagatttctaggcactggagcgtcctctggaacgccctgtgagacggaaggtggcacgcacctgctccttgaggctgttcaccttctccytctccttctctagtgaggcctgcagggcctggacaagatgcttcatctggcgatcctcctcttctttgcgctgcaaaactgcctgcacctagatcagattgcaggaggacagataaggaaggacgtcgaattacaaacacacaaggctgctacagcaggcaacgtgacacacgccacatcacaggcacacgccagggaggtagagggaacttcactgctgaagaatctgtgacaaaacagaatcctaggttgcgggagcatgatcacagggccgcactcaagaacgtggcacacctgtgg

SEQ ID NO: 33449 - DNA, 601 bp, Human
cacacaccacagcccttgcacggacacccccccgcgcacatacacctcaggcacacacgtgtacagacatcacaactcttgcacgcacagccccccgcatgcacacaacccaggcacacacgcgtatacagacatcacaacccttccacgcacagcccgcgtgcacacacaccccaggcacacacgtgcgcacacacaccacagcccttgcacggacacccccccgcgcacatacacacacacaccccaggcacacgtgtgtgcagacatcacacttgcacgcacagccccccgcgtgcacacaccccaggcacacgtgtgtacagacatcacaacacttgcatgcacagccccccgcgtgcacacacaccacaccccaggcacacgtgcacgcacaccccccatgtgcacacacacggcaagcgtactaggagtagctgctctgtgccaggtatggcggaggtagccagcaagcagcagcgttctaacagaggagcagggcccagacagggcacctgggggtcaggatgggcctctgctggcgacgtgaccaacgtgtcagtgaacacctgaagcagggcaggggccagccacgaaaaga

SEQ ID NO: 33450 - DNA, 601 bp, Human
cttttttacaagttcaattcaaacgggatttaaaggaaaagtgatgtgttctttcctgcctttctctagagacaaccagttatttcttgtgttcctcctagaaattttctacatatacatcagcatcaaatgcatgcacacacaccacagcccaggcacacacgtgcgcacacacaccacagcccttgcatggacaccccccccgtgcacatacacacaccccaggcacacacgtgtgtgcacacacaccacagcccttgcacggacacccccccgcgcacatacacctcaggcacacacttgtacagacatcacaactcttgcacgcacagccccccgcatgcacacaacccaggcacacacgcgtatacagacatcacaacccttccacgcacagcccgcgtgcacacacaccccaggcacacacgtgcgcacacacaccacagcccttgcacggacacccccccgcgcacatacacacacacaccccaggcacacgtgtgtgcagacatcacacttgcacgcacagccccccgcgtgcacacaccccaggcacacgtgtgtacagacatcacaacacttgcatgcacagccccccgcg

SEQ ID NO: 33451 - DNA, 601 bp, Human
gaattgtgaagcaattacttttttacaagttcaattcaaacgggatttaaaggaaaagtgatgtgttctttcctgcctttctctagagacaaccagttatttcttgtgttcctcctagaaattttctacatatacatcagcatcaaatgcatgcacacacaccacagcccaggcacacacgtgcgcacacacaccacagcccttgcatggacaccccccccgtgcacatacacacaccccaggcacacacgtgtgtgcacacacaccacagcccttgcacggacacccccccgcgcacatccacctcaggcacacacgtgtacagacatcacaactcttgcacgcacagccccccgcatgcacacaacccaggcacacacgcgtatacagacatcacaacccttccacgcacagcccgcgtgcacacacaccccaggcacacacgtgcgcacacacaccacagcccttgcacggacacccccccgcgcacatacacacacacaccccaggcacacgtgtgtgcagacatcacacttgcacgcacagccccccgcgtgcacacaccccaggcacacgtgtgtacagacatcacaacacttgc

SEQ ID NO: 33452 - DNA, 601 bp, Human
tgtgaattagaccccgcccattgccaggacagccatgtttgagggctggcggggcccaggcactcactgaaggtcgtcggcctcggcctgcagcttctgcaccaggtgttccttggcctgcagctccttcttcacctcactcagctccaaggaggccgccttgaagtggcggcggttatgcccggcttccaccttggcagcagccacctaggaggaaggaagccacgttgtccatgccctgcgtgacacccacagctttatgacgtgctgggcgcagggggtgaacgcactcccggccccrtgcatgtcctggctgccggcgtgtgcttctccacaggcctgtcaagttccttgtaaagatgaaaccacctgacccggagctcggcacgcagcaagtgcacacttatgtggctgctgctatctgttgaatgaacacatttattcgagatttctcggtctaaatagtttttatagtcttcttccagtgtattcacagcctggacaacatagcaagaccctgtctccacaaaaaataaaaaaattagcagggcatggtggtcccaggtactcaggaggctgaggtggaaggatcacttgagct

SEQ ID NO: 33453 - DNA, 601 bp, Human
tcgctgtgctgaaggtgtgaattagaccccgcccattgccaggacagccatgtttgagggctggcggggcccaggcactcactgaaggtcgtcggcctcggcctgcagcttctgcaccaggtgttccttggcctgcagctccttcttcacctcactcagctccaaggaggccgccttgaagtggcggcggttatgcccggcttccaccttggcagcagccacctaggaggaaggaagccacgttgtccatgccctgcgtgacacccacagctttatgacgtgctgggcgcagggggtgaaygcactcccggccccatgcatgtcctggctgccggcgtgtgcttctccacaggcctgtcaagttccttgtaaagatgaaaccacctgacccggagctcggcacgcagcaagtgcacacttatgtggctgctgctatctgttgaatgaacacatttattcgagatttctcggtctaaatagtttttatagtcttcttccagtgtattcacagcctggacaacatagcaagaccctgtctccacaaaaaataaaaaaattagcagggcatggtggtcccaggtactcaggaggctgaggtgga

SEQ ID NO: 33454 - DNA, 601 bp, Human
caaaatatagatgaccctcgctgtgctgaaggtgtgaattagaccccgcccattgccaggacagccatgtttgagggctggcggggcccaggcactcactgaaggtcgtcggcctcggcctgcagcttctgcaccaggtgttccttggcctgcagctccttcttcacctcactcagctccaaggaggccgccttgaagtggcggcggttatgcccggcttccaccttggcagcagccacctaggaggaaggaagccacgttgtccatgccctgcgtgacacccacagctttatgacgtgcygggcgcagggggtgaacgcactcccggccccatgcatgtcctggctgccggcgtgtgcttctccacaggcctgtcaagttccttgtaaagatgaaaccacctgacccggagctcggcacgcagcaagtgcacacttatgtggctgctgctatctgttgaatgaacacatttattcgagatttctcggtctaaatagtttttatagtcttcttccagtgtattcacagcctggacaacatagcaagaccctgtctccacaaaaaataaaaaaattagcagggcatggtggtcccaggtact

SEQ ID NO: 33455 - DNA, 601 bp, Human
tgtggaaggcgttcgtcctggcaggccctctgctgtgcactgcgtgctgcagccatgcttggtgcccacagtgtgcactcgggcagtcctcacgaagcacctgagactcacacttcactggcacccctcacagatcccagagactcactttgccggcacccctcacagatcccagagagtgccggccccgagaccacagtgcatgggacccacagagccaagcatcagccccgcgccgggccgccccttcccgcctctgacctgaagctaagtactcctgctggggcgctttctctcttgsggggaggacacggggcagtgagtgaggctcaggattctggagacggaggctgggtgccttctactcctatgattcactcaagtactcggcaatttgcaaaatatagatgaccctcgctgtgctgaaggtgtgaattagaccccgcccattgccaggacagccatgtttgagggctggcggggcccaggcactcactgaaggtcgtcggcctcggcctgcagcttctgcaccaggtgttccttggcctgcagctccttcttcacctcactcagctccaaggaggccgccttgaagtggcgg

SEQ ID NO: 33456 - DNA, 601 bp, Human
tcctagcgtaaaaaaacaagaaagaagggaatcgccacgctcctccagtgtgctgtgccctcccgctgggaaatgctgcctgtggaaggcgttcgtcctggcaggccctctgctgtgcactgcgtgctgcagccatgcttggtgcccacagtgtgcactcgggcagtcctcacgaagcacctgagactcacacttcactggcacccctcacagatcccagagactcactttgccggcacccctcacagatcccagagagtgccggccccgagaccacagtgcatgggacccacagagccacgcatcagccccgcgccgggccgccccttcccgcctctgacctgaagctaagtactcctgctggggcgctttctctcttggggggaggacacggggcagtgagtgaggctcaggattctggagacggaggctgggtgccttctactcctatgattcactcaagtactcggcaatttgcaaaatatagatgaccctcgctgtgctgaaggtgtgaattagaccccgcccattgccaggacagccatgtttgagggctggcggggcccaggcactcactgaaggtcgtcggcctcggcctgca

SEQ ID NO: 33457 - DNA, 601 bp, Human
tcccagcactttgggaggctgagatgggcagatcacttgaggtcaggagatcgagaccatcctggccaacatggtgaaaccccattgctactaaaaatacaaacattagcctggcatagtggcgcacgcctgtaatcccagctactcgagaggctgaggcaggagaatcgcatgaacctgggaggcggagcttgcagtgagcggagagtgtgccactgcactccagcctgggcaacaaagcgagactctgtctcaaaaaaaaaaaaaaaaaaaaaaacaaagattggattatgatattcartatctatgtacacatcctatggtgggatggctatccaaaaaaacaagtaaaaagccaaaggtacagataaaatttcatttctgcggaaaagtaaagctcttactgaatggaacagggaagtgagaaactgcagccggcctggccaggcgcggtgccgcagaccctgtcacacagctgctcccagttacgcagcctctccctgtcacccgcagagagcagcatcggtggccgctcagaagccacgacctacaagtaacccttcagacacgttcaaagctcctcgccgagagcctatcaggc

SEQ ID NO: 33458 - DNA, 601 bp, Human
agtacaggtgctcctacacacgagtacaggcgctcccacagacaatggtaaagattttcacttggggaacaggagtgtgaggtttgttaccgcctgcgacctacacctggctgactccaggggaaaccgcgggagtcgctgcagggagcccctggtctgctctcctcctcctcctccaccggcctctccctgtgcccccccaaaggtcagatcagatatggggcctcagtgtccttgtgcctcctgatggccgtcaggcctgaccaagggtccaagctgccccttcccagtggccagccayggtggaatcacacagggccagtggcctgagaggaagagaccagcaggaaggaaagatcctcagcaacaaagtaaaaccagaacaacagaggacctttctgtgtaagaatatttggctttagaaggtaaataaaataattatatttcttagaattttctgactatccctaaatcctgcaggtaaattattcccaacaaattttcaaaaggcaatcaataataagtaggttcttcttcaataacatgagcatatgcttcttaaagactgggtgacaggccgggcgcaggggctcacgcctgt

SEQ ID NO: 33459 - DNA, 601 bp, Human
gtctcttccggaagtcgcctctgcttgccacatgatgctggtgtaaccacaaaagatccaggacttctcgatgactgcagaagtacaggtgctcctacacacgagtacaggcgctcccacagacaatggtaaagattttcacttggggaacaggagtgtgaggtttgttaccgcctgcgacctacacctggctgactccaggggaaaccgcgggagtcgctgcagggagcccctggtctgctctcctcctcctcctccaccggcctctccctgtgcccccccaaaggtcagatcagatatggggcctcagtgtccttgtgcctcctgatggccgtcaggcctgaccaagggtccaagctgccccttcccagtggccagccacggtggaatcacacagggccagtggcctgagaggaagagaccagcaggaaggaaagatcctcagcaacaaagtaaaaccagaacaacagaggacctttctgtgtaagaatatttggctttagaaggtaaataaaataattatatttcttagaattttctgactatccctaaatcctgcaggtaaattattcccaacaaattttcaaaaggcaatcaataa

SEQ ID NO: 33460 - DNA, 601 bp, Human
accgtgttagccaggatggtctcgatctcctgacctcgtgatccacccacctcggcctcccaaagtgctgggattacaggcgtgagccaccacatccggccctattattttttaaaatgtttaattgaacttaatttttttaaggagacagggtctggctttgttgcccaggctggtcttgaactcctaggctcatgatccttccgcctcagcctcccaaagtgctaagattaccagcatcagccaccacacccgtccagttttttattttattttatttttgagacagagtctcgctctrtcacccaggcgagagtgcagtggcatgatcttggctcactgcaaccttgcctcccaggttcaagcaattctcctgcctcagcctcctgagtagctgggattaaaggcctgcgccactacacgcagctaatttttgtatttttagtagagacgaggtttcaccatgttggctaggctggtctcaaactcgactcaaacgatctgcctgcctctgcttcccaaaatgctggaattacagacatgagccactgtgcttggcctttattatcatattttttatatttgaatgacattttgaaag

SEQ ID NO: 33461 - DNA, 601 bp, Human
cagggtctggctttgttgcccaggctggtcttgaactcctaggctcatgatccttccgcctcagcctcccaaagtgctaagattaccagcatcagccaccacacccgtccagttttttattttattttatttttgagacagagtctcgctctgtcacccaggcgagagtgcagtggcatgatcttggctcactgcaaccttgcctcccaggttcaagcaattctcctgcctcagcctcctgagtagctgggattaaaggcctgcgccactacacgcagctaatttttgtatttttagtagrgacgaggtttcaccatgttggctaggctggtctcaaactcgactcaaacgatctgcctgcctctgcttcccaaaatgctggaattacagacatgagccactgtgcttggcctttattatcatattttttatatttgaatgacattttgaaagaacttgcgtacacatttttaatttgatccttatggtaacactgtgagatagtcaaagcagacgtattagacctattttataggttaaagaaccgaagctcaaaagcgaactgacctgctcacagttttatgtctagtaatgggccgga

SEQ ID NO: 33462 - DNA, 601 bp, Human
cggaggtatgtctggaagctaagtcttcccagtttgtgtgctcctccgcctcccctctgccccccacccccacccccgcagaccacgctgtaaatccctgggacttaatcttgttcctctcaacctaagctattttttcatatcttgttcctctcaacctaagctattttttcataaagtcataaaaaccagttaaacgtaaccattcatcagtaaacaaaatccttaattaaaaacataatgatcagaatagaaatctgattaaggaattgttaacttgttaggcatgataatgatatckagactgtttttaaaaaattcttatcttttagaggtacatactcaattcttaatggataaaagcatagatgtctgtcaaaataatctagtagggaaagggtattgctgtaaacctttggttacagcaaattggtcctgagttgataattatgaaagaagctagcttatgggtccatagggattcattatattctctctacttttgtatagatttaaattttcccataaaaatattttaaaaaatagtccgggcatggtggctcacgcctgtaatcccagcactttgggaggccgaggtggg

SEQ ID NO: 33463 - DNA, 601 bp, Human
acagcaaattggtcctgagttgataattatgaaagaagctagcttatgggtccatagggattcattatattctctctacttttgtatagatttaaattttcccataaaaatattttaaaaaatagtccgggcatggtggctcacgcctgtaatcccagcactttgggaggccgaggtgggtggaatcacgaggtcaggagatcgagaccatcctggctatcacggtgaaaccccgtctctactaaaaatacaaaaaaattagccaggcgtggtggcgggcgcctgtagtcccagctactcrggaggctgaggtgagagaatcgcttgaaaccagaaggtggaggttgcagtgagccaagattgtgccactgcacttgagcctggacgacagaacaagactctatctcaaaataaataaatacaataatataaaataattatattattatagtttggttaaaacattagttgactatggtcagttcattgttggggcagaagtgggagatgcgggggtatatgtgaatgaggatagccttgagttgattgttggtttaactaagtgtttattactctccacttttatatatgtttgaaatcc

SEQ ID NO: 33464 - DNA, 601 bp, Human
gaacaagactctatctcaaaataaataaatacaataatataaaataattatattattatagtttggttaaaacattagttgactatggtcagttcattgttggggcagaagtgggagatgcgggggtatatgtgaatgaggatagccttgagttgattgttggtttaactaagtgtttattactctccacttttatatatgtttgaaatcccccatttaaaaaatcagtacaaggccaggtgcggtggctcatgcctgtaatcccagcattttggaaggccaaggcaggcagatcatgagrtcaggagatcgagaccattttgcctaacacggtgaaaccccatccctaccaaaaatacaaaaaaaaaaaaaaaaattagccggatgtggtggcgggcaccccagctactcgagaggctgaggcaggagaatggcgtgaacccaggaggtggaggttgcagtgagctgagatcgtgccactgcaccccagcctggggcgatagagcgagactccgtctcaaaaataaataaataaataaaataaaataaaaaatcagtagattgtgaaaaaacatagtaacttggatggagggcattgaat

SEQ ID NO: 33465 - DNA, 601 bp, Human
aataattatattattatagtttggttaaaacattagttgactatggtcagttcattgttggggcagaagtgggagatgcgggggtatatgtgaatgaggatagccttgagttgattgttggtttaactaagtgtttattactctccacttttatatatgtttgaaatcccccatttaaaaaatcagtacaaggccaggtgcggtggctcatgcctgtaatcccagcattttggaaggccaaggcaggcagatcatgagatcaggagatcgagaccattttgcctaacacggtgaaaccccrtccctaccaaaaatacaaaaaaaaaaaaaaaaattagccggatgtggtggcgggcaccccagctactcgagaggctgaggcaggagaatggcgtgaacccaggaggtggaggttgcagtgagctgagatcgtgccactgcaccccagcctggggcgatagagcgagactccgtctcaaaaataaataaataaataaaataaaataaaaaatcagtagattgtgaaaaaacatagtaacttggatggagggcattgaatgctacctctgtgtagtttcttggctagtgttttggcctgtaa

SEQ ID NO: 33466 - DNA, 601 bp, Human
caagtcatacaagaatacaagttccctgagggcagagaccttatctctcttatccatgttggtatgtcctgctactagtaagtatttgtttagttaaccagtcatcataaagtaccgtaaggattttacaaatgctagatgatttctgggaatgtggtcaaaatttaaatactttcagcatacttctgtttccacatgtttccaacatgtggaagttcctaataacttcaagaataatttttgtgacttaagtacaagtctttatggcatggttttagcctatctttctttcctgaaacarttcctatttaacagtgatggtaagtttcgtaagaacagggacagtgtttcttttgttcattgctgtgtctcccaagcccagcccatattgggtcctcacaagtatttgctgagtgaacttttagtgcaacttatagaaccctttctaatgtgtttttctctctctcccaccaaccttctcaaccctagcctcacagcatggaaccacaggttactctaaatgtgacttttaaaaatgaaattcaaagctttctggtttctgatccagaaaatacaacttgggctgatatcgaagctatgg

SEQ ID NO: 33467 - DNA, 601 bp, Human
gagggcagagaccttatctctcttatccatgttggtatgtcctgctactagtaagtatttgtttagttaaccagtcatcataaagtaccgtaaggattttacaaatgctagatgatttctgggaatgtggtcaaaatttaaatactttcagcatacttctgtttccacatgtttccaacatgtggaagttcctaataacttcaagaataatttttgtgacttaagtacaagtctttatggcatggttttagcctatctttctttcctgaaacaattcctatttaacagtgatggtaagttycgtaagaacagggacagtgtttcttttgttcattgctgtgtctcccaagcccagcccatattgggtcctcacaagtatttgctgagtgaacttttagtgcaacttatagaaccctttctaatgtgtttttctctctctcccaccaaccttctcaaccctagcctcacagcatggaaccacaggttactctaaatgtgacttttaaaaatgaaattcaaagctttctggtttctgatccagaaaatacaacttgggctgatatcgaagctatggtgagtgttactttattttgtttctcct

SEQ ID NO: 33468 - DNA, 601 bp, Human
ctctgaaaccctttggtaaaaatctacgtttacctggttatatctgatgataactaaaaagggaaagaaatggtagatcttaaaagatgatctgaggtagttgtctgccttccagcaaatacctgttcatactgtcctatcagtgacagtgagacccgtctcaaaaaaaaaaaaaagattggattcagaaagaagttagatcttgtttgccaaaagatgtgaaaatcagttatctttcttttcctagtagttaaatgagctgacagcttgccttttttcttccttgtaaattttaaattgwataagtataatacatgcccattttaagaagagaaaccatctcaagcagttaatagccctccattctcccccccctcatctgttactcccaccttctttgggtaaccaatgttaacagccctgtatgtactttaaattttccatgttcatgcagatatcatactaggatcatactataaacattatttggccaggcacagtggcacacgcctagaatcccagcactttgggaggccaagatgggtggaccacttcagctcaggagtttgagaccagactgggcaacatggtaaaaccccat

SEQ ID NO: 33469 - DNA, 601 bp, Human
aagttagatcttgtttgccaaaagatgtgaaaatcagttatctttcttttcctagtagttaaatgagctgacagcttgccttttttcttccttgtaaattttaaattgtataagtataatacatgcccattttaagaagagaaaccatctcaagcagttaatagccctccattctcccccccctcatctgttactcccaccttctttgggtaaccaatgttaacagccctgtatgtactttaaattttccatgttcatgcagatatcatactaggatcatactataaacattatttggccrggcacagtggcacacgcctagaatcccagcactttgggaggccaagatgggtggaccacttcagctcaggagtttgagaccagactgggcaacatggtaaaaccccatctctaccaaaaaaatacaaaaattagctgggcctggtagcaggcacctgtggttccagctactccggaggttgaggtgggcgaattgcttgagtgctggaggttgaggctgcagtgagccaagatcaagccactataatccagcctgagcgacagagtgagacccatctcaaaaaaaaaaaaaaaaagatat

SEQ ID NO: 33470 - DNA, 601 bp, Human
agccctccattctcccccccctcatctgttactcccaccttctttgggtaaccaatgttaacagccctgtatgtactttaaattttccatgttcatgcagatatcatactaggatcatactataaacattatttggccaggcacagtggcacacgcctagaatcccagcactttgggaggccaagatgggtggaccacttcagctcaggagtttgagaccagactgggcaacatggtaaaaccccatctctaccaaaaaaatacaaaaattagctgggcctggtagcaggcacctgtggtyccagctactccggaggttgaggtgggcgaattgcttgagtgctggaggttgaggctgcagtgagccaagatcaagccactataatccagcctgagcgacagagtgagacccatctcaaaaaaaaaaaaaaaaagatatttttcgttttttttttttcttatcttgaaacttcaggagatatccatctatacacataacttatacactgttctacaggataaactctgtcctatacaaatgtgagattaatgggtcacaaagcattttatttgaaattttaatagattctgccaaatgctt

SEQ ID NO: 33471 - DNA, 601 bp, Human
tactataaacattatttggccaggcacagtggcacacgcctagaatcccagcactttgggaggccaagatgggtggaccacttcagctcaggagtttgagaccagactgggcaacatggtaaaaccccatctctaccaaaaaaatacaaaaattagctgggcctggtagcaggcacctgtggttccagctactccggaggttgaggtgggcgaattgcttgagtgctggaggttgaggctgcagtgagccaagatcaagccactataatccagcctgagcgacagagtgagacccatctcaaaaaaaaaaaaaaaaagatatttttcgttttttttttttcttatcttgaaacttcaggagatatccatctatacacataacttatacactgttctacaggataaactctgtcctatacaaatgtgagattaatgggtcacaaagcattttatttgaaattttaatagattctgccaaatgctttgcagaacaattgtagcagcacacagaaatacatgacagtgtcctgaagttttgacaacactggatgttatggctttaaaaaacatttgctgttccctaccccacaccccacccaaa

SEQ ID NO: 33472 - DNA, 601 bp, Human
ggctttaaaaaacatttgctgttccctaccccacaccccacccaaaacacacacacacacacacacacacacacacacacacacacacacagtttgggtattctgatgagatgtcatctcattgcttcaatttgcattgttctgacccccagaaagtttgaaagtcttctgatgtatttgttaggtgttctgatttcctcttgtatgaattttatgtatatttttacctgggttgttaattgtatcattagcagttttgctggtactctgggtgtgttgcagatattaaccctttgttatrggttattaaggttgtttgttgtttgtcttttgattttgtgggttttttttactttgacttctgtgtacattataacctgcctttaaatatgtatctcttttataggtaaaagtttcatttgatctgaatactattcaaataaaatacctggatgaggaaaatgaagaggtaaaatatattatggcacttattgctaggtgttcagaatagggatcttatttctccagtgatatgggctttaataattcaaaatagtgtttagcttatttgtgtggtggtttaaatatatttgataactga

SEQ ID NO: 33473 - DNA, 601 bp, Human
ttgttaggtgttctgatttcctcttgtatgaattttatgtatatttttacctgggttgttaattgtatcattagcagttttgctggtactctgggtgtgttgcagatattaaccctttgttatgggttattaaggttgtttgttgtttgtcttttgattttgtgggttttttttactttgacttctgtgtacattataacctgcctttaaatatgtatctcttttataggtaaaagtttcatttgatctgaatactattcaaataaaatacctggatgaggaaaatgaagaggtaaaatayattatggcacttattgctaggtgttcagaatagggatcttatttctccagtgatatgggctttaataattcaaaatagtgtttagcttatttgtgtggtggtttaaatatatttgataactgaatattctaagaagacttgcagcatctgagatggagttgagaaatggagaagcaacactgaagaatatctcagagataactttcacttaaaaaaaaaaaaaggaaacagggtctcactgtgttgctcaggccagtcttgaactcctgggcccaagcagtcctcccacctcagcctccc

SEQ ID NO: 33474 - DNA, 601 bp, Human
tttgatctgaatactattcaaataaaatacctggatgaggaaaatgaagaggtaaaatatattatggcacttattgctaggtgttcagaatagggatcttatttctccagtgatatgggctttaataattcaaaatagtgtttagcttatttgtgtggtggtttaaatatatttgataactgaatattctaagaagacttgcagcatctgagatggagttgagaaatggagaagcaacactgaagaatatctcagagataactttcacttaaaaaaaaaaaaaggaaacagggtctcactrtgttgctcaggccagtcttgaactcctgggcccaagcagtcctcccacctcagcctcccaaagtgctgggattataggtgtgagacacccaccatgcctggcctggcctgagagaacctttttttttttctttttttttttttgtgagatgaagcctcactccataacctaggctggagtgcagtggtgcgatctctgctcactgcaacctccagctcctgggttcaagtgattctcctgtctcagccttctgagtagctgggattacaggtgtataccaccacgcctggctaatttttg

SEQ ID NO: 33475 - DNA, 601 bp, Human
agtagctgggattacaggtgtataccaccacgcctggctaatttttgtatttttagtagagacggtatttcaccatgttggccaagctggtctcgaactcctgggctcaagcgatcagcccacctcggactcccaaagtgctgggattacagttgtgagctaccacacctggccaagataacttttaaaattatatagtgaccttaagttcacatatagcacaagctaccacttagtttataataatacaaatataatggctaagctttttttttttttttttttaaagagggtctcactstgttgcccaggctggtgtgcattggcatagcttgctgcaacctagagctcctgggttcaaggaatcctcccatctcagccttctgggtagctaggacatacctctctgcatctggcaaaattttttaattctttggagggatggaatctcactttgttgctcaggctaatggctaagctttattgagtggttacagtgtgtcagactagccacagtaccatgtattgagtacattattatcatcactattttactcatgaggaaactgaggcacagagaggtgaaaataacttgtccaaa

SEQ ID NO: 33476 - DNA, 601 bp, Human
agtggttacagtgtgtcagactagccacagtaccatgtattgagtacattattatcatcactattttactcatgaggaaactgaggcacagagaggtgaaaataacttgtccaaatgcacaaaaacttggaagtagtaaagtagccgttcagtccataccctctggctgtagaactcaagctcctaactgttatattgcactgccttttaatgtatctgaaataaaggagggcacagtagataagcaataaaatttcttaagtgttattcatgactagcaagtgatatggaaaagctgaaygcttggcctgagtttttgtctgtcctatggggctggtcctagtaacagaaatgctcaactgatgagacacttataattcactgttgctttttttccttttataggtatccatcaacagtcaaggtgagtccctaagagagtctgttcagccttatttaaaaaccttaatctgctcattgaggcatttctatttatactcaaaccttattgcagtattaattttagagtgacattgcactgatggacattagttacctaggggattttattgtatagcagttttttatatacaggatgatg

SEQ ID NO: 33477 - DNA, 601 bp, Human
cataccctctggctgtagaactcaagctcctaactgttatattgcactgccttttaatgtatctgaaataaaggagggcacagtagataagcaataaaatttcttaagtgttattcatgactagcaagtgatatggaaaagctgaatgcttggcctgagtttttgtctgtcctatggggctggtcctagtaacagaaatgctcaactgatgagacacttataattcactgttgctttttttccttttataggtatccatcaacagtcaaggtgagtccctaagagagtctgttcagccttrtttaaaaaccttaatctgctcattgaggcatttctatttatactcaaaccttattgcagtattaattttagagtgacattgcactgatggacattagttacctaggggattttattgtatagcagttttttatatacaggatgatgcctttgaatggaccctaaggacagctttaatgggaggttctcatatttaagatgccagtcctctgaaattaatatgcctcccagttcaacacatataagtattcccatggtgttgcatttgtttctgacttggtatatatgttaatatcaactt

SEQ ID NO: 33478 - DNA, 601 bp, Human
caacaaaaagggagtttgtcagcaaaaagatagttgctgttcatatataataagctaagaattctttaaagtcaggattagctgtacatttaacaaatttttattgtatatattgaaggtgcacaacatgatgttatgaaatacatatacagtaatgcatcgcttaatgacagagatttgtactgagaaatgcatcaattaggtgattttgtcattatatggacatcatagagtgtacttacacaaacctagatggtatagcctagtacacacctaggatatatggtataacctattgctyataggctgcgaacctgtagagcatgttactgtgctgtatactatagacagttgaaacacaatggtatttgcatatctaaacatagaaaaggtacagtaaaaatgtggcattataatcttatgggatcaccatcatacacatggttgaccaaaatgttatgtggcaatggttactgtagtgaagcaaattaacatatctatcatctcattatagtggccctgtggtgccctgagccctccccagaaaccagccataatctactcatttagcaaaaatcatgaatataatttacgattattt

SEQ ID NO: 33479 - DNA, 601 bp, Human
tccaacatctattatttctttttttttgaaacggagtctcactctgttgcccaggctgtggagtgcagtggcgcgatctcggcttattgcaagctctgcctcccgggttaacaccattctcctgcctcagtctcctgagtagctaggactataggcacctgccactacgcccagctaattttttttatttttagtagagacagggtttcaccgtgttagccaggatggtctcgatctcctgacctcatggtccgcccgccttggcctcccaaagtgctgggattacaggcgtgagccaccrcgcccggcctccaacatctattatttcctgacttttttttttttttttttttttttgagacagagtcttgcaccttcgccctggctggagtacagtggcgtgatcttggctcactgcaacctctgcctcccaggttcacgtgattctcctgcctcagcctcccgagtagctgggattacaggcacacaccaccacacctggctaattttttgtatttttagcagtgacagggtttcagtatgttggtgagactggtctggaactcctgaccttgtgatccgcccacctcggcctcccaaa

SEQ ID NO: 33480 - DNA, 601 bp, Human
cgcccggcctgatttgcatttctctaatgaccagtgatgatgagctttttttcataggtttgttggccgaataaatgtcttcttttgagaattgtctgttcatatcctttacccactttttgatggggttgtttttttcttgtaaatttgtttaagttccttatagattctggatattagccctttgtcagatggatggattgcaaaagttttctctcattgtgtaggttgcccgttcactctgatgatagtttcttttgctgtgcagaagctctttagtttaattagatcccattgtcarttttggcttttgttgccactgcttttggtgttttagtcatgaagtctttgcccctgcctatgtcctaaatggtattgcctaggttttcttctagggtttttatggttttagatcttatgtttaagtctttaatccaccttgagttaatttttgtataaggtgtaaggaaggggtccagtttcagttttctgcatatggctagccagttttcccagcaccgtttattaaatagggaatcctttccccattgcctgtttcagtctatccaatttctagatttatttctcattgtctttgttg

SEQ ID NO: 33481 - DNA, 601 bp, Human
atggatggattgcaaaagttttctctcattgtgtaggttgcccgttcactctgatgatagtttcttttgctgtgcagaagctctttagtttaattagatcccattgtcaattttggcttttgttgccactgcttttggtgttttagtcatgaagtctttgcccctgcctatgtcctaaatggtattgcctaggttttcttctagggtttttatggttttagatcttatgtttaagtctttaatccaccttgagttaatttttgtataaggtgtaaggaaggggtccagtttcagttttctrcatatggctagccagttttcccagcaccgtttattaaatagggaatcctttccccattgcctgtttcagtctatccaatttctagatttatttctcattgtctttgttgtaagatttgcacatttatcagagatttgggaattagtgtgctcctctctctgacttttgaaactggtaatagtttacttctgtagaaggggagcaggctagagactttgttttcctttagtacgccttcatactgtgactttttaaaaaattatatacttgtatgatttcacaaaagaaacctcaaaataa

SEQ ID NO: 33482 - DNA, 601 bp, Human
ccttgggttcttgtccctcagaagtctcaatgcctacttcagaagaaacattgtttttgccagaaaaccagttcagctggcatattgcttgcaacaactgccaaagaaggattgttggtgtccgctaccagtgtaggtaagcagttgcttgggagtagctagctagtgatagaccttacagcttttacctccctggctttctgtgtaggtaaagggaaattaattgtaccctgtttctgagcattagatgttgtagctgtgagttggaagcacaagctactcttcacccacatgctttgtrtgttgtaactattcagattgttgtgttcaaatgtgcatttggattagcaaagccaggcaaaattatgttcccctgaacggacaaaattagatcactaagggtagttcctcggttgttccaaatgcctttttttttttttttttggtgacagggtctctgtcacccaggctggagtgcagggtgcaatcatggttcactgcagcctcaccctcccaggctcagacaatcctcccacttcagcctgccaagtagctgggatcacagactgccttttaattatttttttggagatggggtctc

SEQ ID NO: 33483 - DNA, 601 bp, Human
aaatgtgcatttggattagcaaagccaggcaaaattatgttcccctgaacggacaaaattagatcactaagggtagttcctcggttgttccaaatgcctttttttttttttttttggtgacagggtctctgtcacccaggctggagtgcagggtgcaatcatggttcactgcagcctcaccctcccaggctcagacaatcctcccacttcagcctgccaagtagctgggatcacagactgccttttaattatttttttggagatggggtctccctatattgcccaggctagtctcaaactmctggactcaaatgatcctcttctccatggcctcccaaagtgctgggattacagacatgagccactgtgcctggccccatgtactttcacatcttaccttcctcccatagattttcatttaaaatggatatgggttaagtgttattatcctcattttattaatgaggaaaattgaggcatggcatagtcagatggcatgctcaggttacctgctagttggtactggagcaaacatagaagtatggtcttatatctccctaccccaggtacttcctattctgccattgtgtattgtgccatt

SEQ ID NO: 33484 - DNA, 601 bp, Human
ttgagacagagtcttgctctgtcacccaggcggtagtgcagtggtgcgatctcggctcactgccagctctgctttcgggttcacgccattctcctgcctcagcctcctgagtagctgggactacaagcacccgccaccacgcctggctaattttttgtatttttagtagagatggggtttcaccgtgttagccaggatggtctcgatctcttgacctcgtgatccgcccgccttggactcccaaagtgttgggattacaggcatgagccacacagcacccggcttttttttttttttttttgagatggagtctcgctctgtcgcccaggctggagtgcagtggcatgatctaggctcactgcaacctctgcctcccgggttcaagtgattctcctgcctcagcctcctgagtagctaggattacaggtgcatgccaccatgcccggctaatttttgtattttttcagtagagatggggtttcatcctgttggtcaggctggtctcgaactcctgacctcatgaatccgcccgccttggcctcccaaaatggtgagataacaggtgtgagccactgcgcctgcctggcgtggtcttagtatt

SEQ ID NO: 33485 - DNA, 601 bp, Human
caggcatgagccacacagcacccggcttttttttttttttttttgagatggagtctcgctctgtcgcccaggctggagtgcagtggcatgatctaggctcactgcaacctctgcctcccgggttcaagtgattctcctgcctcagcctcctgagtagctaggattacaggtgcatgccaccatgcccggctaatttttgtattttttcagtagagatggggtttcatcctgttggtcaggctggtctcgaactcctgacctcatgaatccgcccgccttggcctcccaaaatggtgagatwacaggtgtgagccactgcgcctgcctggcgtggtcttagtattattaaagggtggtttggtagttttttgtttgttttgtttttgagacggagtcttggagtctcgcctgttgcccaggctggagtgcagtggcgcgatctcggctcactgcaagctccacctcctgggttcacgccattctcctgcctcagcctcccgagtaactgggactacaggtgcccgccaccacacccagctaattttttgtattttttagtagaaacagggtttcaccgtgttagccaggatggtctcgatct

SEQ ID NO: 33486 - DNA, 601 bp, Human
taatttttgtattttttcagtagagatggggtttcatcctgttggtcaggctggtctcgaactcctgacctcatgaatccgcccgccttggcctcccaaaatggtgagataacaggtgtgagccactgcgcctgcctggcgtggtcttagtattattaaagggtggtttggtagttttttgtttgttttgtttttgagacggagtcttggagtctcgcctgttgcccaggctggagtgcagtggcgcgatctcggctcactgcaagctccacctcctgggttcacgccattctcctgcctyagcctcccgagtaactgggactacaggtgcccgccaccacacccagctaattttttgtattttttagtagaaacagggtttcaccgtgttagccaggatggtctcgatctcctgacctcgtgatctatctgccttggcctcccaaagtgctgggatgacaggcgtgagccaccgcgcctggccaagtttcgtagttatttttgacacttgttttgtttccttcttcagaaagatagaaaccactaaagttcaaaatggcggggtccctctcttcattggaggcaatctggaattgaagca

SEQ ID NO: 33487 - DNA, 601 bp, Human
aacatccatctctcctgaaataccctgtgtatgttccctaaatactaatgaagtcttgccctggttgctacttagtgaacagttttttaatgcaatttctctgtattagtggggcagagtgtttactgcttaaagttatccaatgttaattttctggttttgactattatagttaatataagttatcgtcattaggggaagctggggaatgtgaattctctctgctgtttttacaactttttctataactgtaaaaatatatcaaaaacattgttttttaaaatatggaggtacagcagcrtttttatttttgggggcattgtcagcctgcctcttcagttctgttgaaggcctaaaatttgtctcaatggtttgtctctataggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggtggaagattcagcactttgaagggcaagggacagagggagagagcacaggagagaaggtggtagag

SEQ ID NO: 33488 - DNA, 601 bp, Human
ggatcttctgactgcccaggtggaagattcagcactttgaagggcaagggacagagggagagagcacaggagagaaggtggtagagccataggcagtaatcaggaaatcagagatatgcccactttgatctagtcaggtatatttaatgggaaggagatcacccatggaagcaagtttgtaaactagatgtttcctctttgaattgggaactcaatcctgtacttccccacaaactccctttagttgcctcttcaccttggcctagctaattctccttcatacctgctgcattttctcttycctgctattgggttatttcaacatctaattcccatttaactcttcttgttttcacttgtctggggacaggcatgaatttgaacagagttgaatacgaaatgatgtggaaatggtctacaggtcccatcaagacatggctccagcatgcactccaaacagcctaacattgtctttttttataggacctgctgtcctttgagctgttggatataaacattgttcaagagttggagagagtgccccacaacacccctgtgggtaagaatgtcactcatttcatcttgttcgtcttactaatag

SEQ ID NO: 33489 - DNA, 601 bp, Human
agctgggcatggtggcacatgcctgtaatccgaactactcgggaggctgaggcgggagaattgcttgaacccagaaggcggaggttgtggtgagctgagattgcaccattgcactccagccaggacaacaagagcaaaactccgtctcaaaaaaaaaaaaaaaaaaaattagcttggcatggtggcctgcacctgtggtcccagctaccagggagactgaagtgggagaatctcctgatcccaggaggcagaggctgcagtgagccaggattgtgccattgctctccagcctggatgacaragtgaaacccaatctcaaaaaacaaacaaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacag

SEQ ID NO: 33490 - DNA, 601 bp, Human
caaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaamaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgat

SEQ ID NO: 33491 - DNA, 601 bp, Human
aaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaaaaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgatgatatgatgctttctcttgattgatggttctcctgtcttcattctccagatgtgactccctgcatgtctcctctg

SEQ ID NO: 33492 - DNA, 601 bp, Human
cagtttgtgtgtgagacagtaatccgatcccttaccttggatgctgccccagaccacaaccctccttgcagacagaagtccttgcagagtgagtgtccttgcatttcccctacctagcagggtggcacctgaattgtgactgccagacttgactagttagatgtgctcttcttcactgagactgaagggagagtgatcttagttagaagttctgatcttggcggggcgtggtggctcaagcctgtaatcccagcactttgggaggccaaggcaggcggatcacaaggtcaggagatcaagwccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcata

SEQ ID NO: 33493 - DNA, 601 bp, Human
tgatcttggcggggcgtggtggctcaagcctgtaatcccagcactttgggaggccaaggcaggcggatcacaaggtcaggagatcaagtccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggattctgcagtaaggaatcttcctgtaatttgacagagctccttagcagagacccctatgggtagctgagttgtctgctttctccaagggcagcagtcccagaaacagtggatagaagcaggagtaccaacaaagtt

SEQ ID NO: 33494 - DNA, 601 bp, Human
gtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggrttctgcagtaaggaatcttcctgtaatttgacagagctccttagcagagacccctatgggtagctgagttgtctgctttctccaagggcagcagtcccagaaacagtggatagaagcaggagtaccaacaaagtttctcaaggttaaattctgctgtaataaatacctttataggccgggcacagtggctcacccttgtaatcctagcactttatgaggctgaggcgggtggatcacctgaggttgggagttcgagaccagcctgaccgacatggagaaaccccatctctactaaaaata

SEQ ID NO: 33495 - DNA, 601 bp, Human
aaaccccatctctactaaaaatacaaaaaataagctgggtgtggtggcgggcgcacctgtaatcccagctactcgggaggctgaggcaggagaatggcgtgaacctgggaggtgcagcttgcagtgagctgagatcatgctactgcacttcagcctgggcaacagagtgagactccatctcaaatcaatcagtcatgtatatctttatatttttttccacatgtgtgtacaaatacataacaaaaaggtctggaaagacagtaccaaaatgttcacagctgttattctgataggatttatrggtaattttttttttttttttgagataaggtctcactcgcccaggctaaagtgcgagtagcaagtttatggctcattgcagccacaacatcctggggtccccctacctctgtttcccaagcaactgggaccacagccacatgctaccacaatgagctaaatttttttttttttgtagagatgggatttcgccacgttgcccaggctggtcccaaacttctgagctcaagcagtctgcctgccttggcctcccaacgtgctgggattttaggcgtaagccaccacacctggcctgggtagc

SEQ ID NO: 33496 - DNA, 601 bp, Human
cccaggctggagtgcagcagcgcggtctcggctgactgcaacctccgccttcccaggttcacaccattctcctgcctcagcctcccgagtagctggcactacaggcgcccgccaccatgcccgggtaatttttttgtatttttagtagagatggggtttcaccgtgttagccaggatggccttgatatcctgacctcatgatctgcccacgttggcctcccaaagtgctgggattacaagcgtgagccaccgtgcctggccctgggtagcttttttctatccttttttaccctctcaaacrtgattggccagttttctcccatgactgcatcatctttgtaaagaagaggaggagatagacatataatcctgcaatactcatctcctaactttttctctttttatagcactgttagtgtatcagttttggtttaaactctactcagtatattaaccatcacataaaaaggaaaaaagggatggagctgcctccttttatgattcatagagcttcttggaaacctgagtgtttctgcctaccttgtttctgtgagctttgattctattttgttttgcatagtcttcaaacttagaatatggt

SEQ ID NO: 33497 - DNA, 601 bp, Human
ggctggagtgcagcagcgcggtctcggctgactgcaacctccgccttcccaggttcacaccattctcctgcctcagcctcccgagtagctggcactacaggcgcccgccaccatgcccgggtaatttttttgtatttttagtagagatggggtttcaccgtgttagccaggatggccttgatatcctgacctcatgatctgcccacgttggcctcccaaagtgctgggattacaagcgtgagccaccgtgcctggccctgggtagcttttttctatccttttttaccctctcaaacatgaytggccagttttctcccatgactgcatcatctttgtaaagaagaggaggagatagacatataatcctgcaatactcatctcctaactttttctctttttatagcactgttagtgtatcagttttggtttaaactctactcagtatattaaccatcacataaaaaggaaaaaagggatggagctgcctccttttatgattcatagagcttcttggaaacctgagtgtttctgcctaccttgtttctgtgagctttgattctattttgttttgcatagtcttcaaacttagaatatggtcata

SEQ ID NO: 33498 - DNA, 601 bp, Human
cagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccytcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttgattattgagagctggttgtgtttttttttttttttttttgagacagggtctcagtctgttgcccaggctggagtgcagt

SEQ ID NO: 33499 - DNA, 601 bp, Human
tggattctggatttaaagaaatatttgttttagttggccttaaattatctgagtatagtctgtctgcttatattttgattattgagagctggttgtgtttttttttttttttttttgagacagggtctcagtctgttgcccaggctggagtgcagtggcacaatcttggctcactgccacctctgcctctgaggctcaagcaatcttcccacctcagccccctgagtagctgggactataggcatgggccaccacacctagctaatttttgtatttattgtagaagcggggttttgccacrttgtccaggctggtcttgaactcctggccttaagcgatccaactgcctgggtctcccaaaatgctggaattacaggtgtgagccactatgcctggctgagagccagtttttaaacacaaacatccctggaccttccctccttgttttattgactcttcagtaaaggcagcaaaaactcaacccaaacagtcataattaggaagttaaatccattatgggaaaaaacactataaaaccaaactaattatttttaattctctggtgaatctatctgaatcattcttgtctcctaatagtagg

SEQ ID NO: 33500 - DNA, 601 bp, Human
tcctggccttaagcgatccaactgcctgggtctcccaaaatgctggaattacaggtgtgagccactatgcctggctgagagccagtttttaaacacaaacatccctggaccttccctccttgttttattgactcttcagtaaaggcagcaaaaactcaacccaaacagtcataattaggaagttaaatccattatgggaaaaaacactataaaaccaaactaattatttttaattctctggtgaatctatctgaatcattcttgtctcctaatagtagggaaaatgctggagccttgactrtaatgtaaaccattctccccaaaagctagacatttccgtttattgacaccacttgatgtaggtggggacatgaccagactgaagccaacatttctagcttgcctgtggctaaagaggaaaatggggtagaatgtagcccttatgatggaaccctaaatccagacatgtgatctggatcagaaatgtgaagcctctgtagagaatttggcactgctgtgctgtgtttactatttctccactgttgccataagtgccttttcaatttactttccatattgtgtctttctgaaaggagctctc

SEQ ID NO: 33501 - DNA, 601 bp, Human
cactgctgtgctgtgtttactatttctccactgttgccataagtgccttttcaatttactttccatattgtgtctttctgaaaggagctctccttgtgtacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccrggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgc

SEQ ID NO: 33502 - DNA, 601 bp, Human
cttgtgtacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccaggcgtggtggctcacacctgtaatcccaacactttgggaggccaaggcaggcggatcatagggtcaggagttcgagaccagcctggccaacrtagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgcccttcactctctccatgctcctcctgcatactctaatttctattctctggctgaatatattgttagacctcatagaggtagtggaaagaaca

SEQ ID NO: 33503 - DNA, 601 bp, Human
aggccaggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaac

SEQ ID NO: 33504 - DNA, 601 bp, Human
ctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatacttwaaaaaaaaaaaaaaaagacttcaaacactgtgatcagattgccacctgcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggg

SEQ ID NO: 33505 - DNA, 601 bp, Human
gcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggctttgagcarcactgaacaaacggctaaagctgatgtttaagagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccagcctggctgacaagtgaaacaacatcaaaaaaaaaaaagagtgtt

SEQ ID NO: 33506 - DNA, 601 bp, Human
ctgccactttctaactatatgactttagccaagttacttaagggaagaaaagagaagaatgtattattgatgatctattaatattttctatagagagaagctattccaggtgttggcactatggcatgaataaaacaccagttcttggccgggtatggtggctcttacctgtaatcctagtactttgggaggccaaggtgggaggattgcttgagcccaggagtttgagaccagcctgggcaacatagtgagacccccatctctacaaaaaaatttaaaaattagataagtatggccggtrcagtggctcacacctgtaatcccagcactttgggaggccgaggcaggccggatcacaaggtcaggagatcgagaccatcctggccaacatggtgaaaccctgtctctactaaaaatacaaaaattagctgggcgtggtggcaggcacctgtagtcccagctactcgggaggctgaggcaggagaattgcttgatccagggagtcagagcttgcagtgagccgagatggcaccacagcactccagcctggcgacagaacaagactccatcttaaaaaaaaaaaaaaaaaagtatgatggca

SEQ ID NO: 33507 - DNA, 601 bp, Human
gatggcatgcacctacagtcccagttacttgggaaactaaggtgggaggatcacttgagcaccggaggttgaggctgccgtagtgagccacaatggagccactgcactccagcttgggtgactgagcgagaccctgtctcaaaaaacaacaacaaaaaagacactgagtcttgcccagaaactatgggaaacaagtgaggtgcatggatacttaaagtacatagtaagatactatgctggccgggtgtggtggctcatgcctgtaatcccagcactttggaaggctgaggcgggcggatcrtgaggtcaggagttcgagaccatcctggccaacatgatgaaaccccgtctctactaaaaatacaaaaattagccaggcatggtgatgtgtgcctgtaatcccagctacttgggaggctgaggcaggagaatcacttgaacctgggaggtggaggttgcagtgagctgagattgtgctactgcactccagcctgggcaacagagtgagactccatctcaaaaaaaagaaagatactatgccagtgctatcagacagatgaaacacttcagcctggtgtgcccaagtaaggctttctggtag

SEQ ID NO: 33508 - DNA, 601 bp, Human
acaccactgaactccaatgtgggtgacagagtgagaccatgtctcaaaaaaaaaaaaaaaaaaaaggctgggtgtggtggctcacgcctgtaatctcaacactttgggaggctgaggcgggtggatcatgaggtcaggagttcgagaccagcctgacccacatggtgaaaccccatctctactaaaaatacaaaaattagctaggcgtggtgacgtgcctgtaatcccagctactcaggaggccgaggcaggagaatcgctttaacctgggaggcggatgttgcagtgagccgagattgcrccactgcacttcagcctgggtgacagagcgagactctgtctcaaaaaaaaaaaaaaagaaaaagaaaaacagaccaaatatgtaggcaggatgctgtgttatgaggtttggattttattttaaggctaattaataggaggagcaattgaagggttttaaggaagtgattgacatgatgagatctgtttttagtaagattaccggctacattgtagaggctggtagagccagtaaagaaatccagttgggcgtggtggctcatgcctgtaatcccagcactttgggaggccgaggcgggca

SEQ ID NO: 33509 - DNA, 601 bp, Human
aggcgtggtgacgtgcctgtaatcccagctactcaggaggccgaggcaggagaatcgctttaacctgggaggcggatgttgcagtgagccgagattgcgccactgcacttcagcctgggtgacagagcgagactctgtctcaaaaaaaaaaaaaaagaaaaagaaaaacagaccaaatatgtaggcaggatgctgtgttatgaggtttggattttattttaaggctaattaataggaggagcaattgaagggttttaaggaagtgattgacatgatgagatctgtttttagtaagattacyggctacattgtagaggctggtagagccagtaaagaaatccagttgggcgtggtggctcatgcctgtaatcccagcactttgggaggccgaggcgggcagatcacgaggtcaggagttcaagaccagcctggccaatatggtgaaaccacatctctactaaaaatacaaaaattgccgggcgtggtggcacgtgcctgtagtcctagctactcgggagtctgaggcagaagaattgcttgaacctgggaagcagaggttgcagtgagctgaaatcatgccactgcactccagcctgggtga

SEQ ID NO: 33510 - DNA, 601 bp, Human
taatgcttccaccacagggcttgaatgaatgaatgttaacttcctcttacctattcttgtttttttttttttgagatggagtctcgctctgtcacccaggctggagtgcaatggcgcgatctcggctcactgcaagctccacctcctgggttcacgccgttgtcctgcctcagcctcccgagtagctgggactacaggcgcctgccaccacgcctggctaattttttgtatttttagtagagatggggtttcactgtgttagccaggatggtctcaatctcctgacctcatgatccgcccrcctcagcctcccaaagtgctgggattacaggtgtgagccaccgcacccagcccctcttacctattcttttggaggagaaaaaatcaagaagccttcccaggttgtaatttcccaagctgttttttttgtccagctcctctgcatatctgacaaaatttcccatagcatctttcagtaacacttttatcttgctcatacttcccccatcatcacaattacacttatgttcacagggtctctggggcttgctgtcattccttcatctggccaaaaaatgcttcttcctgaaagccccgagtg

SEQ ID NO: 33511 - DNA, 601 bp, Human
tgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaasttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcat

SEQ ID NO: 33512 - DNA, 601 bp, Human
tctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctcygcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtg

SEQ ID NO: 33513 - DNA, 601 bp, Human
gctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaag

SEQ ID NO: 33514 - DNA, 601 bp, Human
acggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctrcgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccg

SEQ ID NO: 33515 - DNA, 601 bp, Human
agcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccsgctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcag

SEQ ID NO: 33516 - DNA, 601 bp, Human
tttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggaggrggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttcctt

SEQ ID NO: 33517 - DNA, 601 bp, Human
cattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagygggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgatt

SEQ ID NO: 33518 - DNA, 601 bp, Human
agtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccrtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcc

SEQ ID NO: 33519 - DNA, 601 bp, Human
tcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatcygatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaag

SEQ ID NO: 33520 - DNA, 601 bp, Human
ctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgygagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatcc

SEQ ID NO: 33521 - DNA, 601 bp, Human
ttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattstcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacaatgatacagttgtggacagccag

SEQ ID NO: 33522 - DNA, 601 bp, Human
tagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacaatgatacagttgtggacagccaggaagtcatccctcctgtggactctgagccaccagcaccctgcagaactaaagccagaaaaaatggggagtggytggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagta

SEQ ID NO: 33523 - DNA, 601 bp, Human
actttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttgsagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaa

SEQ ID NO: 33524 - DNA, 601 bp, Human
ttccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccrcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcac

SEQ ID NO: 33525 - DNA, 601 bp, Human
tggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatygtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaat

SEQ ID NO: 33526 - DNA, 601 bp, Human
ctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaaygaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaag

SEQ ID NO: 33527 - DNA, 601 bp, Human
ccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctgkcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgca

SEQ ID NO: 33528 - DNA, 601 bp, Human
cctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagcyctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggaga

SEQ ID NO: 33529 - DNA, 601 bp, Human
gatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaycctggtgatgctgaggagcccaggatattaaaactgagagtccgggaagggaggaggagatttgggtagttataaaggaacaaaattttctcgctgagaaatgacttttttagagtcctacatactggtttctttttctttttcttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaat

SEQ ID NO: 33530 - DNA, 601 bp, Human
tgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttcttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagat

SEQ ID NO: 33531 - DNA, 601 bp, Human
tttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagytcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaac

SEQ ID NO: 33532 - DNA, 601 bp, Human
ctcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtytgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtggagaagggaaatatttaaagatggactgcagtggaaaagagtaaggggatgtccatt

SEQ ID NO: 33533 - DNA, 601 bp, Human
cacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtggagaagggaaatatttaaagatrgactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctg

SEQ ID NO: 33534 - DNA, 601 bp, Human
gcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacytctcacctccagctggcaccagcgactccagcctcagcagatagcctttgctcagtggaggcctttgggagcctgcctgcaagctgcgtcatcaactagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagaca

SEQ ID NO: 33535 - DNA, 601 bp, Human
ttgggagcctgcctgcaagctgcgtcatcaactagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtktggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaa

SEQ ID NO: 33536 - DNA, 601 bp, Human
gaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggygttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgttt

SEQ ID NO: 33537 - DNA, 601 bp, Human
atgaggtcaacatgacatgatccttttggaatgactttctaatttgaattacaatgtgagtgaagtattttagaagacattctatcaaataatgatagacctgcataaggaggctgtcacagaagatctgtctctggtggacagacaaaccagattaacatgaaattgtaaaggaaaaagcttttttatacttattattatggctttttgcaacatggcaaaacattacagcttaaagcagacatcatctcctcttagaggaggaaaaagttttgcagtcaaatcaaattataattaagargtcatcgctatacaattctattcagtttaacaaaaacgatattacaccttcatgaaatccagagataataggttacttaaaaacataaacaaaaaactggtggatacactggctgaattaataaaggatatgataaggaatttaggtccacctatacctatgataataaacataaaagactgcaaaacaatttaagaacttaatcacagacctactaatcaaagttcatcatgtgcctgattaccagaaaaggaattattaaggtatacagtgaagggaatggagcagaataaaatataa

SEQ ID NO: 33538 - DNA, 601 bp, Human
actgaacctagttattgagaatatacctgcaattatagccatgcctgatattctgaatcaggcatacttgatattacttgaatgtgttcatgataaagacatctacaaagatctgttcaggtaccttagccacatggttttagaataattttcacctacttcaatgtctctgccaggaagaaactctgctgcacatcatcataactctcatgaagaaggtaaacatcccttaggcctgaatagcctccattcactctgcaatggttttccaaggcctaaattatagaggaggaaaaaaaawagtcacatttcagtaaactgattgtcactaatttttattattagattgtcaagttcagataaaacattttttttttttgagacagggcctcactctgttgcctgggcggagtacagtggcaccatcatgggtcactgcagcttctacctcttgggctcaggtgattctcctgcctcagcctcccaagtagctgggaccacaggcattcgccaccatgcctggctaattttttgtattttttgtagagatagggttttgccatgttgcccatggttgtctcaaactcctgggctcaagcga

SEQ ID NO: 33539 - DNA, 601 bp, Human
tagcctccattcactctgcaatggttttccaaggcctaaattatagaggaggaaaaaaaaaagtcacatttcagtaaactgattgtcactaatttttattattagattgtcaagttcagataaaacattttttttttttgagacagggcctcactctgttgcctgggcggagtacagtggcaccatcatgggtcactgcagcttctacctcttgggctcaggtgattctcctgcctcagcctcccaagtagctgggaccacaggcattcgccaccatgcctggctaattttttgtattttytgtagagatagggttttgccatgttgcccatggttgtctcaaactcctgggctcaagcgatctgcttgcctcggcctcccaaagagttgggattacagccatgagccactgtgcccagtcaaaatttattttttacaaattggattcaaattaaatgaaagtttgttatagagttttaggtaaaaaaaaattaaaaccataaactaaatgtaaattaaaaatgaagtcatagaacatatggaccacatatcttacctaatttgaaacacttctgcctttagttttggaaaaatttttcac

SEQ ID NO: 33540 - DNA, 601 bp, Human
tattagattgtcaagttcagataaaacattttttttttttgagacagggcctcactctgttgcctgggcggagtacagtggcaccatcatgggtcactgcagcttctacctcttgggctcaggtgattctcctgcctcagcctcccaagtagctgggaccacaggcattcgccaccatgcctggctaattttttgtattttttgtagagatagggttttgccatgttgcccatggttgtctcaaactcctgggctcaagcgatctgcttgcctcggcctcccaaagagttgggattacagscatgagccactgtgcccagtcaaaatttattttttacaaattggattcaaattaaatgaaagtttgttatagagttttaggtaaaaaaaaattaaaaccataaactaaatgtaaattaaaaatgaagtcatagaacatatggaccacatatcttacctaatttgaaacacttctgcctttagttttggaaaaatttttcactgatttttaccaattccccctatggtctggagcagggtttagcaaagtatgaactataggctaaatccagtccactgtttatttttgtaaataaacttt

SEQ ID NO: 33541 - DNA, 601 bp, Human
ttcagataaaacattttttttttttgagacagggcctcactctgttgcctgggcggagtacagtggcaccatcatgggtcactgcagcttctacctcttgggctcaggtgattctcctgcctcagcctcccaagtagctgggaccacaggcattcgccaccatgcctggctaattttttgtattttttgtagagatagggttttgccatgttgcccatggttgtctcaaactcctgggctcaagcgatctgcttgcctcggcctcccaaagagttgggattacagccatgagccactgtgyccagtcaaaatttattttttacaaattggattcaaattaaatgaaagtttgttatagagttttaggtaaaaaaaaattaaaaccataaactaaatgtaaattaaaaatgaagtcatagaacatatggaccacatatcttacctaatttgaaacacttctgcctttagttttggaaaaatttttcactgatttttaccaattccccctatggtctggagcagggtttagcaaagtatgaactataggctaaatccagtccactgtttatttttgtaaataaacttttattaaaccacagcc

SEQ ID NO: 33542 - DNA, 601 bp, Human
ctcaggtgattctcctgcctcagcctcccaagtagctgggaccacaggcattcgccaccatgcctggctaattttttgtattttttgtagagatagggttttgccatgttgcccatggttgtctcaaactcctgggctcaagcgatctgcttgcctcggcctcccaaagagttgggattacagccatgagccactgtgcccagtcaaaatttattttttacaaattggattcaaattaaatgaaagtttgttatagagttttaggtaaaaaaaaattaaaaccataaactaaatgtaaatwaaaaatgaagtcatagaacatatggaccacatatcttacctaatttgaaacacttctgcctttagttttggaaaaatttttcactgatttttaccaattccccctatggtctggagcagggtttagcaaagtatgaactataggctaaatccagtccactgtttatttttgtaaataaacttttattaaaccacagccatgttgtttaaatattgtctgtggctgtttttgtactacaatgacagagctaagtagatgcaaaagagactagctggctgtcccccaagcctgatattgtct

SEQ ID NO: 33543 - DNA, 601 bp, Human
gcagagatgttgcactgagagctcagctcccatctgcagatactgataatgaggttattgatttttcacatcagggctggaggacagaagggagagagcagagagactatgaggagaagcatttaattacctggttaaagaaattctggccagcaggccacatgaataaagaaaataaagaaaatgcctcatgatttcatacttttaaaaagccccgaagaaaataagaccgatcaacttaaaaacagatgcttcgattaaattctaagttccagacagtgcgtcaaatggaggatgagcrtgaagaaagaaactttcaagtcctattattttttctttcctcctttttttttgacaaagagtcaaataccagatatgtagaataagccaaaaattattggttaaaaaaaggaaaaaaatcagaatttagaaaaaatgggcaaggtttttatgggaaaccctatttccggatatttctttaaacagattttaatcccaaaaccttttcttagttgttcccttgaggttttttggtaatgagctaatgagagggccagccatgataaacagccactcctcctctccatggaaactgctctaa

SEQ ID NO: 33544 - DNA, 601 bp, Human
gacagaagggagagagcagagagactatgaggagaagcatttaattacctggttaaagaaattctggccagcaggccacatgaataaagaaaataaagaaaatgcctcatgatttcatacttttaaaaagccccgaagaaaataagaccgatcaacttaaaaacagatgcttcgattaaattctaagttccagacagtgcgtcaaatggaggatgagcatgaagaaagaaactttcaagtcctattattttttctttcctcctttttttttgacaaagagtcaaataccagatatgtagartaagccaaaaattattggttaaaaaaaggaaaaaaatcagaatttagaaaaaatgggcaaggtttttatgggaaaccctatttccggatatttctttaaacagattttaatcccaaaaccttttcttagttgttcccttgaggttttttggtaatgagctaatgagagggccagccatgataaacagccactcctcctctccatggaaactgctctaagctccttcttttgttagaggagttgcttttggggtggacaatgcctaatcacctttctttctagttcaccctctcattcttg

SEQ ID NO: 33545 - DNA, 601 bp, Human
tagcaaatggagaagctaacactgaccataatttcaatataagccagtttttctttatttttttggagttggagtcttgctctgtccctcaggttcgagtgcagtggcgtgatctcggctcattgcaagctccgcctcctgggttcatgccattctcctgcctcagcctcctgagtagctgggactacaggcgcccgccaccacgcctggttaatttttttttgtacttttagtagagacggggtttcaccgtgttagccaggatggtctcgatctcctgaccatgatcatgatccacccmctttggcctcccagtttttttttttttttttttttaaatataaatctactaaaagaacaagttggaccataagctgtgaaaaaatcacactgcgaagagagaagagaggttcacactattcagccctaaaagaccacagctggaaaccaggtcaggagaagaaaatcaagggaaatgatggatgaggaaaggaagagatggcagaacctgctgtcttcggataattgaggagctgaaatgcagaagggagattttttccctctggtacccccagagcacagaacactgtaaattgtggct

SEQ ID NO: 33546 - DNA, 601 bp, Human
ctaacactgaccataatttcaatataagccagtttttctttatttttttggagttggagtcttgctctgtccctcaggttcgagtgcagtggcgtgatctcggctcattgcaagctccgcctcctgggttcatgccattctcctgcctcagcctcctgagtagctgggactacaggcgcccgccaccacgcctggttaatttttttttgtacttttagtagagacggggtttcaccgtgttagccaggatggtctcgatctcctgaccatgatcatgatccacccactttggcctcccagtttttttttttttttttttttaaatataaatctactaaaagaacaagttggaccataagctgtgaaaaaatcacactgcgaagagagaagagaggttcacactattcagccctaaaagaccacagctggaaaccaggtcaggagaagaaaatcaagggaaatgatggatgaggaaaggaagagatggcagaacctgctgtcttcggataattgaggagctgaaatgcagaagggagattttttccctctggtacccccagagcacagaacactgtaaattgtggcttcaaaataaataact

SEQ ID NO: 33547 - DNA, 601 bp, Human
aatataagccagtttttctttatttttttggagttggagtcttgctctgtccctcaggttcgagtgcagtggcgtgatctcggctcattgcaagctccgcctcctgggttcatgccattctcctgcctcagcctcctgagtagctgggactacaggcgcccgccaccacgcctggttaatttttttttgtacttttagtagagacggggtttcaccgtgttagccaggatggtctcgatctcctgaccatgatcatgatccacccactttggcctcccagttttttttttttttttttttwaaatataaatctactaaaagaacaagttggaccataagctgtgaaaaaatcacactgcgaagagagaagagaggttcacactattcagccctaaaagaccacagctggaaaccaggtcaggagaagaaaatcaagggaaatgatggatgaggaaaggaagagatggcagaacctgctgtcttcggataattgaggagctgaaatgcagaagggagattttttccctctggtacccccagagcacagaacactgtaaattgtggcttcaaaataaataactttctaacaccttcaatatta

SEQ ID NO: 33548 - DNA, 601 bp, Human
catgtagcatgcattccagaatgattcttgaaggaaagaagactgggacagttatccaccaactccaaaacctccttggttgacagccattaactccccagcacttcccagaccacagccagctggctagggaaaagctcttccaccttcttttcctgacatggtttccagctgtggtctcaagtatgcatcagaacagccaagtgctggaggtgggagctgcaagcatatgcggggctgctgctgaaacacaggaggccacgggggtgggcataacaccaggggaaaaacgtgcggccawgccttcgaagtcccagtttttctggtttaaaaaatgcaagaccctacagcactcctggctcaccactatagctcaggttctagcagaggttactgggggcatccccaaaattgagacctcagtgttgtgacacagggaaacgatttcaggtcatatattatgttaaagagttgacaagaaataaaaatcataacacataaaccaaccttatgatctcataaacaagcaaccccctgaagaacacagcaaaccaaagcatcctgtctacctggcaatacgaatttgcttacttcccatttt

SEQ ID NO: 33549 - DNA, 601 bp, Human
gacagccattaactccccagcacttcccagaccacagccagctggctagggaaaagctcttccaccttcttttcctgacatggtttccagctgtggtctcaagtatgcatcagaacagccaagtgctggaggtgggagctgcaagcatatgcggggctgctgctgaaacacaggaggccacgggggtgggcataacaccaggggaaaaacgtgcggccatgccttcgaagtcccagtttttctggtttaaaaaatgcaagaccctacagcactcctggctcaccactatagctcaggttcyagcagaggttactgggggcatccccaaaattgagacctcagtgttgtgacacagggaaacgatttcaggtcatatattatgttaaagagttgacaagaaataaaaatcataacacataaaccaaccttatgatctcataaacaagcaaccccctgaagaacacagcaaaccaaagcatcctgtctacctggcaatacgaatttgcttacttcccatttttgataccttctcggccatacattttgtacattctaacatctataaaatggatgtcataacttaattggtagtgttattttt

SEQ ID NO: 33550 - DNA, 601 bp, Human
taactccccagcacttcccagaccacagccagctggctagggaaaagctcttccaccttcttttcctgacatggtttccagctgtggtctcaagtatgcatcagaacagccaagtgctggaggtgggagctgcaagcatatgcggggctgctgctgaaacacaggaggccacgggggtgggcataacaccaggggaaaaacgtgcggccatgccttcgaagtcccagtttttctggtttaaaaaatgcaagaccctacagcactcctggctcaccactatagctcaggttctagcagaggktactgggggcatccccaaaattgagacctcagtgttgtgacacagggaaacgatttcaggtcatatattatgttaaagagttgacaagaaataaaaatcataacacataaaccaaccttatgatctcataaacaagcaaccccctgaagaacacagcaaaccaaagcatcctgtctacctggcaatacgaatttgcttacttcccatttttgataccttctcggccatacattttgtacattctaacatctataaaatggatgtcataacttaattggtagtgttatttttcttagtggt

SEQ ID NO: 33551 - DNA, 601 bp, Human
gggctgctgctgaaacacaggaggccacgggggtgggcataacaccaggggaaaaacgtgcggccatgccttcgaagtcccagtttttctggtttaaaaaatgcaagaccctacagcactcctggctcaccactatagctcaggttctagcagaggttactgggggcatccccaaaattgagacctcagtgttgtgacacagggaaacgatttcaggtcatatattatgttaaagagttgacaagaaataaaaatcataacacataaaccaaccttatgatctcataaacaagcaaccccytgaagaacacagcaaaccaaagcatcctgtctacctggcaatacgaatttgcttacttcccatttttgataccttctcggccatacattttgtacattctaacatctataaaatggatgtcataacttaattggtagtgttatttttcttagtggtatataaaataatgatgcttcttactaattatggtgttttagatttgatggaacacaccattcctgatattttcaacttaaaatattcaattcatttgctggccaattgaagaccaaaacaattccctatcaccaaagtttagaa

SEQ ID NO: 33552 - DNA, 601 bp, Human
aaaaaaacagaaatgtaaagaaattacaatgactactgattaaatgtaataaaactgccccctcaaagaggcctagagaattgctgttatttaaaatgactgatgattaatgataagacacatattaaatgaagaggataataagcaagattcaccgatggcttcctaagatattagttaaattttaccaaaggcaatattcattttagatttcctgagagaagtcattcctcatggacagtttttaaagatagctaactttctaacaaagagtgctagagaatgagagtgtaattaaagmatttgcttgttcttatcccctgaattccctcctactccttgaggaataataactcttacaattagacagacattgttagatgcatatcctgcaggttgcctcctcaggcattcggcacacaaagcattcactagattggtttaggaaggaagtatactatcctcggcaggaagagacccaagaggtgacagacaaaacaacacactgggcagatggaaagcttatagatattccaagaaacctgagactggtaaaggaatatccttatacaaagtaattcttctataagtgctttctaaa

SEQ ID NO: 33553 - DNA, 601 bp, Human
tactgattaaatgtaataaaactgccccctcaaagaggcctagagaattgctgttatttaaaatgactgatgattaatgataagacacatattaaatgaagaggataataagcaagattcaccgatggcttcctaagatattagttaaattttaccaaaggcaatattcattttagatttcctgagagaagtcattcctcatggacagtttttaaagatagctaactttctaacaaagagtgctagagaatgagagtgtaattaaagcatttgcttgttcttatcccctgaattccctccyactccttgaggaataataactcttacaattagacagacattgttagatgcatatcctgcaggttgcctcctcaggcattcggcacacaaagcattcactagattggtttaggaaggaagtatactatcctcggcaggaagagacccaagaggtgacagacaaaacaacacactgggcagatggaaagcttatagatattccaagaaacctgagactggtaaaggaatatccttatacaaagtaattcttctataagtgctttctaaaagttagatctaagtagctatttactctaagtaa

SEQ ID NO: 33554 - DNA, 601 bp, Human
tcaccgatggcttcctaagatattagttaaattttaccaaaggcaatattcattttagatttcctgagagaagtcattcctcatggacagtttttaaagatagctaactttctaacaaagagtgctagagaatgagagtgtaattaaagcatttgcttgttcttatcccctgaattccctcctactccttgaggaataataactcttacaattagacagacattgttagatgcatatcctgcaggttgcctcctcaggcattcggcacacaaagcattcactagattggtttaggaaggargtatactatcctcggcaggaagagacccaagaggtgacagacaaaacaacacactgggcagatggaaagcttatagatattccaagaaacctgagactggtaaaggaatatccttatacaaagtaattcttctataagtgctttctaaaagttagatctaagtagctatttactctaagtaaaagcatatactagcattttaaagcccaaagacagaaaaaaacatgaagtggtttattgaaatagaggtgaataccccaagctgccaacaacccttaggtggaattaagagatcatcat

SEQ ID NO: 33555 - DNA, 601 bp, Human
ctaagatattagttaaattttaccaaaggcaatattcattttagatttcctgagagaagtcattcctcatggacagtttttaaagatagctaactttctaacaaagagtgctagagaatgagagtgtaattaaagcatttgcttgttcttatcccctgaattccctcctactccttgaggaataataactcttacaattagacagacattgttagatgcatatcctgcaggttgcctcctcaggcattcggcacacaaagcattcactagattggtttaggaaggaagtatactatcctcrgcaggaagagacccaagaggtgacagacaaaacaacacactgggcagatggaaagcttatagatattccaagaaacctgagactggtaaaggaatatccttatacaaagtaattcttctataagtgctttctaaaagttagatctaagtagctatttactctaagtaaaagcatatactagcattttaaagcccaaagacagaaaaaaacatgaagtggtttattgaaatagaggtgaataccccaagctgccaacaacccttaggtggaattaagagatcatcatttttgtattaatgg

SEQ ID NO: 33556 - DNA, 601 bp, Human
gttaaattttaccaaaggcaatattcattttagatttcctgagagaagtcattcctcatggacagtttttaaagatagctaactttctaacaaagagtgctagagaatgagagtgtaattaaagcatttgcttgttcttatcccctgaattccctcctactccttgaggaataataactcttacaattagacagacattgttagatgcatatcctgcaggttgcctcctcaggcattcggcacacaaagcattcactagattggtttaggaaggaagtatactatcctcggcaggaagagrcccaagaggtgacagacaaaacaacacactgggcagatggaaagcttatagatattccaagaaacctgagactggtaaaggaatatccttatacaaagtaattcttctataagtgctttctaaaagttagatctaagtagctatttactctaagtaaaagcatatactagcattttaaagcccaaagacagaaaaaaacatgaagtggtttattgaaatagaggtgaataccccaagctgccaacaacccttaggtggaattaagagatcatcatttttgtattaatgggaacttaattt

SEQ ID NO: 33557 - DNA, 601 bp, Human
gaaagcttatagatattccaagaaacctgagactggtaaaggaatatccttatacaaagtaattcttctataagtgctttctaaaagttagatctaagtagctatttactctaagtaaaagcatatactagcattttaaagcccaaagacagaaaaaaacatgaagtggtttattgaaatagaggtgaataccccaagctgccaacaacccttaggtggaattaagagatcatcatttttgtattaatgggaacttaattttagactatgcctttctagttatctccttcaatatctaagyctatcagtagatatatctatatcaatgttatacaaagcaaagctgaagccagggatataaaatgacttcaatgaaaatacacagtcctgggtggaaaaaatcctggtcgaagcattaaaaattatagaaaagttgataagcctgatttatgggtatcactgaacattttttactatgaaatttatctataagaaacatgcaaattaaaacatcacctctacggcttcccaggcccatttcctgtactttggatcatgagtcagtctccacatatacatgtaagtctccataacttctggc

SEQ ID NO: 33558 - DNA, 601 bp, Human
ctctacggcttcccaggcccatttcctgtactttggatcatgagtcagtctccacatatacatgtaagtctccataacttctggccgtaagatgtagtatttttcattttgtcttgtagcgatggcttcaacaccaccatcaaatctgaaagcttctggtcccagtttcataactaaaggacatggaatgaatgaataagggttattttcctggacagtgcttacagtcaataacttaaatgaaactagaaagtacagtcatccctcagtatctatgagggactggttccaggaccctccraggataacaaaatccatggatccttgagtcccttatataaaatggcaaagtattcgcatacaacctaggtacatcctcccatatactttaaatcacctcgtttacttatactacttaatacagtgtaaatgttatgtaactaggtgttatactgtattgtttagggaataaagataagaacaaaaactctataaatgttcactacagacagaaccatccattttttgggaacatttctgatctgcagttgtggaacccagggatacgaaggtctgactgtactttaacaacactgaagag

SEQ ID NO: 33559 - DNA, 601 bp, Human
gtctccataacttctggccgtaagatgtagtatttttcattttgtcttgtagcgatggcttcaacaccaccatcaaatctgaaagcttctggtcccagtttcataactaaaggacatggaatgaatgaataagggttattttcctggacagtgcttacagtcaataacttaaatgaaactagaaagtacagtcatccctcagtatctatgagggactggttccaggaccctccaaggataacaaaatccatggatccttgagtcccttatataaaatggcaaagtattcgcatacaacctrggtacatcctcccatatactttaaatcacctcgtttacttatactacttaatacagtgtaaatgttatgtaactaggtgttatactgtattgtttagggaataaagataagaacaaaaactctataaatgttcactacagacagaaccatccattttttgggaacatttctgatctgcagttgtggaacccagggatacgaaggtctgactgtactttaacaacactgaagagaaatgtcaaagtagtcattttaaaaacgagttataaacatcatgtaatatataatattcatatactt

SEQ ID NO: 33560 - DNA, 601 bp, Human
tttttcattttgtcttgtagcgatggcttcaacaccaccatcaaatctgaaagcttctggtcccagtttcataactaaaggacatggaatgaatgaataagggttattttcctggacagtgcttacagtcaataacttaaatgaaactagaaagtacagtcatccctcagtatctatgagggactggttccaggaccctccaaggataacaaaatccatggatccttgagtcccttatataaaatggcaaagtattcgcatacaacctaggtacatcctcccatatactttaaatcacctygtttacttatactacttaatacagtgtaaatgttatgtaactaggtgttatactgtattgtttagggaataaagataagaacaaaaactctataaatgttcactacagacagaaccatccattttttgggaacatttctgatctgcagttgtggaacccagggatacgaaggtctgactgtactttaacaacactgaagagaaatgtcaaagtagtcattttaaaaacgagttataaacatcatgtaatatataatattcatatacttaaacaatttagtcattgaaaagagtccatttt

SEQ ID NO: 33561 - DNA, 601 bp, Human
ttcctattttataagaagggagtgggattcatgatctgtttcatgggggatgtggagaagattaataatggttaataaaatgctaagtttctctttgcagggagatagagacccttgcccaatgttattggcaaaagcagaagtcagtaaattaggctggctttaactctttatggcctggatttttgtttcttggtaaactaaaggtagatatttttaggaagaaaagcattgccttttaaaataaaatatacattcctttgagacattaatcacgatcatcaagcttcataggcagagyggatagtcttttgagggcagcaatgacaaaactgcattaaatcaaagcatgtgggaatagaccataaatgaagaataacatgtactcacatgttcgattatatgattcatgacaagtacgggcaatttcagccccgagttcaaggtagtgttgggccatgccttcgggagctgcatcagccccgagtgcgaacatgcccccagcgaagcaggtcaggtggcccatcttgtgctccaggaggccccctttccactctgcgatataagttagtccgctgctagacttgcggatcaaatgagt

SEQ ID NO: 33562 - DNA, 601 bp, Human
tttcatgggggatgtggagaagattaataatggttaataaaatgctaagtttctctttgcagggagatagagacccttgcccaatgttattggcaaaagcagaagtcagtaaattaggctggctttaactctttatggcctggatttttgtttcttggtaaactaaaggtagatatttttaggaagaaaagcattgccttttaaaataaaatatacattcctttgagacattaatcacgatcatcaagcttcataggcagagtggatagtcttttgagggcagcaatgacaaaactgcatkaaatcaaagcatgtgggaatagaccataaatgaagaataacatgtactcacatgttcgattatatgattcatgacaagtacgggcaatttcagccccgagttcaaggtagtgttgggccatgccttcgggagctgcatcagccccgagtgcgaacatgcccccagcgaagcaggtcaggtggcccatcttgtgctccaggaggccccctttccactctgcgatataagttagtccgctgctagacttgcggatcaaatgagtctcgatagcctgtgaaaaacacttattttttaacattt

SEQ ID NO: 33563 - DNA, 601 bp, Human
aaaggtagatatttttaggaagaaaagcattgccttttaaaataaaatatacattcctttgagacattaatcacgatcatcaagcttcataggcagagtggatagtcttttgagggcagcaatgacaaaactgcattaaatcaaagcatgtgggaatagaccataaatgaagaataacatgtactcacatgttcgattatatgattcatgacaagtacgggcaatttcagccccgagttcaaggtagtgttgggccatgccttcgggagctgcatcagccccgagtgcgaacatgcccccmgcgaagcaggtcaggtggcccatcttgtgctccaggaggccccctttccactctgcgatataagttagtccgctgctagacttgcggatcaaatgagtctcgatagcctgtgaaaaacacttattttttaacattttgtaatctcttctcaaatttatactaaaaatatgcccaacattaaaaaaaaaagaatagaatacacctgacaatcagagtttggtgttaaaaatccattcaacctgaaattacatgctattgctttctgtattcctcctctagtttatgccttatttgtttgat

SEQ ID NO: 33564 - DNA, 601 bp, Human
gggccatgccttcgggagctgcatcagccccgagtgcgaacatgcccccagcgaagcaggtcaggtggcccatcttgtgctccaggaggccccctttccactctgcgatataagttagtccgctgctagacttgcggatcaaatgagtctcgatagcctgtgaaaaacacttattttttaacattttgtaatctcttctcaaatttatactaaaaatatgcccaacattaaaaaaaaaagaatagaatacacctgacaatcagagtttggtgttaaaaatccattcaacctgaaattacawgctattgctttctgtattcctcctctagtttatgccttatttgtttgattagtcagaattaacactgctgcgccagcacatttggttttgcttggttctgtgaccaaacattgtattcctcatattcaaaaaactttccccttcccaaagacaggccactgtgcagcagtaatagttggtttggtacattttcatttccataagtggtgaaatgacacagcccaggccctaaggtggatgaagaacacagcatatttgtgcatgagatccaggatggtggcagaactcttcctttcactt

SEQ ID NO: 33565 - DNA, 601 bp, Human
caaatgagtctcgatagcctgtgaaaaacacttattttttaacattttgtaatctcttctcaaatttatactaaaaatatgcccaacattaaaaaaaaaagaatagaatacacctgacaatcagagtttggtgttaaaaatccattcaacctgaaattacatgctattgctttctgtattcctcctctagtttatgccttatttgtttgattagtcagaattaacactgctgcgccagcacatttggttttgcttggttctgtgaccaaacattgtattcctcatattcaaaaaactttcyccttcccaaagacaggccactgtgcagcagtaatagttggtttggtacattttcatttccataagtggtgaaatgacacagcccaggccctaaggtggatgaagaacacagcatatttgtgcatgagatccaggatggtggcagaactcttcctttcacttccgtaggcttggagggataacaaaatagagtggcaaagaggaggtgttctggggccggaagacttggcttcaaattccagctctgacactatctctaatttgtgggagtgaacaatttgcttactatatctctaaatct

SEQ ID NO: 33566 - DNA, 601 bp, Human
cttcagcttttgaaatgtgtggtgaggaatactccaaaaatgcttgtgcttttagagaatcacatcctgtcaccttatacttagaaaaatatacaagggccaggagcgtggctcacgcctgtaattccagcactttgggaggccaaggtgggcggatcacctgaggtcaggagttcgagaccagcctggacaacatggtgaaacccccatctctactaaaaatacaaaaattagctgggtgtggtggtacatgcctgtagtcccagctactcgggaggctgaggcaggagaattgcttgarcatgggacagggaggttgcagtgagctgaggctgtgccactgcactccagcctgggtgacagagcgagactcccatctcaaacaacaaaacagaaatatacacaagttgttttatccctagtcctctggtggccctcaaactgttgagtctcagcacccttttgtaatcttcaaaagaaatggacaccccaaataatttatgtaaataatacctatatttactacattggaaaattaaaataatttaaaaatattttcgttacctcatttaaaataataattacatgcccattatgttaa

SEQ ID NO: 33567 - DNA, 601 bp, Human
tactcgggaggctgaggcaggagaattgcttgagcatgggacagggaggttgcagtgagctgaggctgtgccactgcactccagcctgggtgacagagcgagactcccatctcaaacaacaaaacagaaatatacacaagttgttttatccctagtcctctggtggccctcaaactgttgagtctcagcacccttttgtaatcttcaaaagaaatggacaccccaaataatttatgtaaataatacctatatttactacattggaaaattaaaataatttaaaaatattttcgttacctcrtttaaaataataattacatgcccattatgttaacatatacaatttttcaaaaaagttatattttacaaaacaaaacaaaaaattagtgagaagactgacacaatttcacatttttgcatatctctttcttgtttgccttgacaggagacagctggatactcatgtctgccctactttcaatcctttgctatatgttgttttggctgtaatacatcaagacaagtcagcctcacacagtaatacagtcagaaaaagaaaggatattttaacaggcttttcacacaattgtggatatttttc

SEQ ID NO: 33568 - DNA, 601 bp, Human
ttcataattcagcaggagtgatttatgagtattttccatttcacctcacagaacatgacaaaggtgtgtactcacaggttggtatttattagaatcactaattttttttttttactgtttcagtaagcacattcataagtgaaaccagtatccttttttaaaatgctattaagaatacaatgggggctggtgtggtggctcatgcctgtaatcccagcactttgggaggccaaggcaaagggatcgctcaagcctaaaagtttgaggccagcctgggaaatatgagaccttctctctaccaaaaaaaaaaaaaattaaaaattggctgagcatggcatcgtgcacctgtagtcccagctactcggggcggggggccgaggtgggaagatagcttgagcccagcttgagcccaggaggcagaggttgcaatgagctgagattatgacactgtactccagcctgggtgacacagtgggaccctgtcccacaaaaaagaaaaaaaaaagaaaaaatatgaatattagtactatttggtgtttgttcgcctttgttctcagtgaggcttcagcagtatcacctaacactgtaggtgtaaatatca

SEQ ID NO: 33569 - DNA, 601 bp, Human
gagaaaaacaggctgtttgctcttccaatttcccaactcttaaaaattcaggctcctctctcattatatagccatgcagaaacagaatgttaggaagcagaatggtctacctactctctataaaaccctcatagtcattagtacaaaggaatgaatttcctttctatccacatgaccagcttgttacagattaacatccccacactactctggccagatcttccctttctgattaatagctgtaaatgtgcttatatgtcatcacacttggagttatatatgaaaaatacacaatccagtktcctaataacacaatctgatgacagaagcctgtttattaaaggagccatgcccctttctccttttctaaacatttctcaacaaaatctgtgctgcttttgtgcttcctctctctccacgagtacagtaccaaaaagagctataataatgcaaatcttctgacttacgttgaccccactgtccactactgggattcagatagttaggataaaggccttgtggtttttccagtttgttcagtactgttcgaatattcattacctataatagaaaataaaatgttaccgtgaaaatctaaaaa

SEQ ID NO: 33570 - DNA, 601 bp, Human
cctctctcattatatagccatgcagaaacagaatgttaggaagcagaatggtctacctactctctataaaaccctcatagtcattagtacaaaggaatgaatttcctttctatccacatgaccagcttgttacagattaacatccccacactactctggccagatcttccctttctgattaatagctgtaaatgtgcttatatgtcatcacacttggagttatatatgaaaaatacacaatccagtttcctaataacacaatctgatgacagaagcctgtttattaaaggagccatgcccytttctccttttctaaacatttctcaacaaaatctgtgctgcttttgtgcttcctctctctccacgagtacagtaccaaaaagagctataataatgcaaatcttctgacttacgttgaccccactgtccactactgggattcagatagttaggataaaggccttgtggtttttccagtttgttcagtactgttcgaatattcattacctataatagaaaataaaatgttaccgtgaaaatctaaaaaacaattttcatgccattcttcttcttcttgaacatacaagttgacttaaatgat

SEQ ID NO: 33571 - DNA, 601 bp, Human
atggtctacctactctctataaaaccctcatagtcattagtacaaaggaatgaatttcctttctatccacatgaccagcttgttacagattaacatccccacactactctggccagatcttccctttctgattaatagctgtaaatgtgcttatatgtcatcacacttggagttatatatgaaaaatacacaatccagtttcctaataacacaatctgatgacagaagcctgtttattaaaggagccatgcccctttctccttttctaaacatttctcaacaaaatctgtgctgcttttgygcttcctctctctccacgagtacagtaccaaaaagagctataataatgcaaatcttctgacttacgttgaccccactgtccactactgggattcagatagttaggataaaggccttgtggtttttccagtttgttcagtactgttcgaatattcattacctataatagaaaataaaatgttaccgtgaaaatctaaaaaacaattttcatgccattcttcttcttcttgaacatacaagttgacttaaatgatgcagagttagaacaaagataactgctgttagcttattattacaaaca

SEQ ID NO: 33572 - DNA, 601 bp, Human
tcctaataacacaatctgatgacagaagcctgtttattaaaggagccatgcccctttctccttttctaaacatttctcaacaaaatctgtgctgcttttgtgcttcctctctctccacgagtacagtaccaaaaagagctataataatgcaaatcttctgacttacgttgaccccactgtccactactgggattcagatagttaggataaaggccttgtggtttttccagtttgttcagtactgttcgaatattcattacctataatagaaaataaaatgttaccgtgaaaatctaaaaarcaattttcatgccattcttcttcttcttgaacatacaagttgacttaaatgatgcagagttagaacaaagataactgctgttagcttattattacaaacataatggcagtaagtgaatatagtcacactgattagttatctaccattagccagatgccatactaggaacaaggggccagtggataaacaaagtcaccgcactcttagaattgtgcatcctagtgggacgggacagacaataaatcaataagtctagtcatgtgtcccttaatgacagggatacatgctgggaaacacagg

SEQ ID NO: 33573 - DNA, 601 bp, Human
tagttaggataaaggccttgtggtttttccagtttgttcagtactgttcgaatattcattacctataatagaaaataaaatgttaccgtgaaaatctaaaaaacaattttcatgccattcttcttcttcttgaacatacaagttgacttaaatgatgcagagttagaacaaagataactgctgttagcttattattacaaacataatggcagtaagtgaatatagtcacactgattagttatctaccattagccagatgccatactaggaacaaggggccagtggataaacaaagtcaccrcactcttagaattgtgcatcctagtgggacgggacagacaataaatcaataagtctagtcatgtgtcccttaatgacagggatacatgctgggaaacacaggcaatttaattcttgtacaaacatcatagagcacactgtcacaaatgtagttggcacagcctactgtttctaggttacaaacctgtgtagcatatgttactgtactgaagtatttgtgtatctaaacacagaaaaatacactataaaagatgaaaaatgatacctttctatagggttatacattttataaccctataca

SEQ ID NO: 33574 - DNA, 601 bp, Human
ctgattagttatctaccattagccagatgccatactaggaacaaggggccagtggataaacaaagtcaccgcactcttagaattgtgcatcctagtgggacgggacagacaataaatcaataagtctagtcatgtgtcccttaatgacagggatacatgctgggaaacacaggcaatttaattcttgtacaaacatcatagagcacactgtcacaaatgtagttggcacagcctactgtttctaggttacaaacctgtgtagcatatgttactgtactgaagtatttgtgtatctaaacayagaaaaatacactataaaagatgaaaaatgatacctttctatagggttatacattttataaccctatacataaatacagggcactttgtatagggcatttatcatgaatgaaactcgcaggactggaagttgcagtggatgagttagtaagtgagtaataagtgaatgtgaaggcctgggacgttactgtatagtactgtaaactttataaacatggtacacttagccattattaatacatttataaaagtatttttctttcaataataaattaacgttagtttactgtaattttacttg

SEQ ID NO: 33575 - DNA, 601 bp, Human
cagaaaaatacactataaaagatgaaaaatgatacctttctatagggttatacattttataaccctatacataaatacagggcactttgtatagggcatttatcatgaatgaaactcgcaggactggaagttgcagtggatgagttagtaagtgagtaataagtgaatgtgaaggcctgggacgttactgtatagtactgtaaactttataaacatggtacacttagccattattaatacatttataaaagtatttttctttcaataataaattaacgttagtttactgtaattttacttkataaactttttaattaaaaaaattttgactcttttgtaataaccattagcttaaaacacactttgtatagttgtaccaaaatattttctttctttatattcttataagttttttctatttaaaatttctttttaaagttgtttaactttttaaactttttgttaaaaactaagacacatatacacattagcttaggactccacaggaccatcaatatcactgtcttccacttctacatcttatcgcactggaaggtctttcaggggcagtagcacgcatggagctgtcaactcctgtgat

SEQ ID NO: 33576 - DNA, 601 bp, Human
ttctacatcttatcgcactggaaggtctttcaggggcagtagcacgcatggagctgtcaactcctgtgatgataatgccttgaagaggaatacctcttgaaggaccttgcttctagagctaacttaaaaaaaaagtggtacattctaaaataacaataaaaaccatagtagtacataaatcagtaatgcagtcatttaattatcaaatattatgtactgtacataattatatgtgctatacttttatgtgactgggagtagagtatgtttatgccatcaccaccacaaacatgtaagtaaygcattgcactacgacattatgacaactatgatgtcacaaggccgtaggaattttgtcaactccattataaacttacaggaccactgtcacatatgtggtccactgttgaataaacactgttaagtaacacctaactgtatagtatgtcaggagatgataaatactgtggaaaaaaataaaagggtgctatggattgaactgcatacccctaaattcatatgctgaaaccctacttcccagtgtgattgtatttggagatttatttggagatggtaattaggttatgacggtagagcctta

SEQ ID NO: 33577 - DNA, 601 bp, Human
gtactgtacataattatatgtgctatacttttatgtgactgggagtagagtatgtttatgccatcaccaccacaaacatgtaagtaacgcattgcactacgacattatgacaactatgatgtcacaaggccgtaggaattttgtcaactccattataaacttacaggaccactgtcacatatgtggtccactgttgaataaacactgttaagtaacacctaactgtatagtatgtcaggagatgataaatactgtggaaaaaaataaaagggtgctatggattgaactgcatacccctaawttcatatgctgaaaccctacttcccagtgtgattgtatttggagatttatttggagatggtaattaggttatgacggtagagccttaaatgggattagtgccctcatgagagacacaagagctctctctctctctctgtgactccttctctccctcagagcacaaagaagacatcatgtgaacacacactgggacagttctcgtcatctacaagcccagggaagaggctcagaataaaacctacctcatgggcagtttgatcttggatttcccagcctccagaactgtaagaaataaatt

SEQ ID NO: 33578 - DNA, 601 bp, Human
gggacagttctcgtcatctacaagcccagggaagaggctcagaataaaacctacctcatgggcagtttgatcttggatttcccagcctccagaactgtaagaaataaatttcggttgtttctggctgcatttttgttatggtaacccgagctgattgagagttaacgggacagggtgatgtggagaggctatcccatgttagtcagagtggcctggcaaggcggaggtgtttgagcagaatattaaagaagtgagggagtaggccacgtggaaatgtggaggaagagcactcggaacagasagaggagcaagtacaaaggccctgaggagacagcaggtttgcaatgctactgaggccagaggtgaggagacaaaggggagaatgtcagcaggtagaggagaggagagccagggcccaggtcacccaggccccacaggccacaataagggcatattttactctgagtgtcatgagaaggctgagggggtgaggaaggggtggtcaggtggctactgtatggtgtacatacagtacaccaggtgacctgatggatcccagatcaggacagcagtagaggcagtgagacacccaaaggatttc

SEQ ID NO: 33579 - DNA, 601 bp, Human
gacagggtgatgtggagaggctatcccatgttagtcagagtggcctggcaaggcggaggtgtttgagcagaatattaaagaagtgagggagtaggccacgtggaaatgtggaggaagagcactcggaacagagagaggagcaagtacaaaggccctgaggagacagcaggtttgcaatgctactgaggccagaggtgaggagacaaaggggagaatgtcagcaggtagaggagaggagagccagggcccaggtcacccaggccccacaggccacaataagggcatattttactctgagtgycatgagaaggctgagggggtgaggaaggggtggtcaggtggctactgtatggtgtacatacagtacaccaggtgacctgatggatcccagatcaggacagcagtagaggcagtgagacacccaaaggatttcttagtggactgggcctggggtttaccaagaagaagaaccaggaggagaccactgggtacagtgagatgtcatttaccaagatagcaaagactggagaagcacgtctaggcgttaagtccgaggcattttaagtgggacttgtctatcgggcctcttagtggagatgtt

SEQ ID NO: 33580 - DNA, 601 bp, Human
agggtacattataatacaataatagggcccactacagaatttatccatgttaactgaaatttaaggactgaattagaaattcttatttaacttaccacattaaaatctaaattttcttcaacccatgattttgcttcttcaaattcatgtttcatttccataataaaaagtgtatccagggcatctactatagttgctcctttgatgttacctgaaaagatcagaaaaatatttgataaaatactttgcctagataaaatatatgtaaattgaccataactaagaaagggagagggtaatrctggatttattaataagcaataatattaaacatagtctaaaattctttcaatgaaagtataaaacagcaccaaactaaaaattatcacgggctatcgactgatatactaatctttaaagtttcttctgagttataaaaataaatgtctcagaaacttctcttagaaatttcattagtgattgcattctctctctttttttttttttgagatggagtctcattctgttgcccaggctggagtgcagtggcgcgatctcagcaaattgcaacctccacctcccgggttcaagtgattctcct

SEQ ID NO: 33581 - DNA, 601 bp, Human
aatttaaggactgaattagaaattcttatttaacttaccacattaaaatctaaattttcttcaacccatgattttgcttcttcaaattcatgtttcatttccataataaaaagtgtatccagggcatctactatagttgctcctttgatgttacctgaaaagatcagaaaaatatttgataaaatactttgcctagataaaatatatgtaaattgaccataactaagaaagggagagggtaatgctggatttattaataagcaataatattaaacatagtctaaaattctttcaatgaaartataaaacagcaccaaactaaaaattatcacgggctatcgactgatatactaatctttaaagtttcttctgagttataaaaataaatgtctcagaaacttctcttagaaatttcattagtgattgcattctctctctttttttttttttgagatggagtctcattctgttgcccaggctggagtgcagtggcgcgatctcagcaaattgcaacctccacctcccgggttcaagtgattctcctaccttagcctcctgagtagctgggactataggcgcatgccaccacgcctggctaatt

SEQ ID NO: 33582 - DNA, 601 bp, Human
gctcctttgatgttacctgaaaagatcagaaaaatatttgataaaatactttgcctagataaaatatatgtaaattgaccataactaagaaagggagagggtaatgctggatttattaataagcaataatattaaacatagtctaaaattctttcaatgaaagtataaaacagcaccaaactaaaaattatcacgggctatcgactgatatactaatctttaaagtttcttctgagttataaaaataaatgtctcagaaacttctcttagaaatttcattagtgattgcattctctctctytttttttttttgagatggagtctcattctgttgcccaggctggagtgcagtggcgcgatctcagcaaattgcaacctccacctcccgggttcaagtgattctcctaccttagcctcctgagtagctgggactataggcgcatgccaccacgcctggctaatttttgtgtttttagtagagacggggtttcaccatgttggccagaatggtctcaatctctcgacctcataatccacccacctaggcctcccaaagtgctgagattacaggtgtgagccaccatacccggcctgtgattgc

SEQ ID NO: 33583 - DNA, 601 bp, Human
ctagataaaatatatgtaaattgaccataactaagaaagggagagggtaatgctggatttattaataagcaataatattaaacatagtctaaaattctttcaatgaaagtataaaacagcaccaaactaaaaattatcacgggctatcgactgatatactaatctttaaagtttcttctgagttataaaaataaatgtctcagaaacttctcttagaaatttcattagtgattgcattctctctctttttttttttttgagatggagtctcattctgttgcccaggctggagtgcagtggygcgatctcagcaaattgcaacctccacctcccgggttcaagtgattctcctaccttagcctcctgagtagctgggactataggcgcatgccaccacgcctggctaatttttgtgtttttagtagagacggggtttcaccatgttggccagaatggtctcaatctctcgacctcataatccacccacctaggcctcccaaagtgctgagattacaggtgtgagccaccatacccggcctgtgattgcattctctagcaagaaaagaataggcctaaaaccaaggagcaacagactttttaa

SEQ ID NO: 33584 - DNA, 601 bp, Human
aatttcattagtgattgcattctctctctttttttttttttgagatggagtctcattctgttgcccaggctggagtgcagtggcgcgatctcagcaaattgcaacctccacctcccgggttcaagtgattctcctaccttagcctcctgagtagctgggactataggcgcatgccaccacgcctggctaatttttgtgtttttagtagagacggggtttcaccatgttggccagaatggtctcaatctctcgacctcataatccacccacctaggcctcccaaagtgctgagattacaggygtgagccaccatacccggcctgtgattgcattctctagcaagaaaagaataggcctaaaaccaaggagcaacagactttttaagactgatgtaattacatcaaagtgcacctgtgcaaaactttaaatataattagatctaaaattgtttagtgatagttctaagaagacattactctaaaatgaaatttcacccccgtatgaattctgactgatgctaactaccctccatcccctacaagtcctgacctctgtggtttatttcctctgaattccaatgacatggagacttcctgttgcc

SEQ ID NO: 33585 - DNA, 601 bp, Human
cactcctagctttggaaataaaagtcattttcctttcactgaacttcatccttgttattggctgtgcaagtggcaggcagccgatcctgcactcaggagcacaatgaattgctgctgaaagactgggcactacacttcctatatgtaattagcactctggacgatccaagaccaaatctataaatataagtgaaaattatttcactggcacatgcctttcaaatgccaagttaagaagttatcattaggaaactataaataatagaatattaaaacacttgattttcaaaaaagataaaarttgtaaatcttatctaataataatgagaaagaaacctgaagacccttgcattttgtgaaatgttttactgtaatccaatttcctttaaattttttgaagctagaactatggattcagagagacactggagggaatattttaaagtgggcattttgaaatatatcagcttcatattttcattgacatttcatttctaagttattaagagccttaagttaatatttgtatttcttgtattttagctttaaatgagtataattggtcaagcacaaaatacctctctttgaggtacagtttaac

SEQ ID NO: 33586 - DNA, 601 bp, Human
ccaagttaagaagttatcattaggaaactataaataatagaatattaaaacacttgattttcaaaaaagataaaagttgtaaatcttatctaataataatgagaaagaaacctgaagacccttgcattttgtgaaatgttttactgtaatccaatttcctttaaattttttgaagctagaactatggattcagagagacactggagggaatattttaaagtgggcattttgaaatatatcagcttcatattttcattgacatttcatttctaagttattaagagccttaagttaatatttktatttcttgtattttagctttaaatgagtataattggtcaagcacaaaatacctctctttgaggtacagtttaacttgaaatcttttgtaccactgaaatcttgaaataaatagttctagtttcctgcttaagatggaattgggagatcatgaatacttaagattttttttatattcattaaagttgtttaggaaggaaccagtcttactctgtctaggaaaaagatggatgcttcaacatagctggtgagaaacaaccatgagaaggaagcagacctgaagagctccccaacggctaat

SEQ ID NO: 33587 - DNA, 601 bp, Human
gaaactataaataatagaatattaaaacacttgattttcaaaaaagataaaagttgtaaatcttatctaataataatgagaaagaaacctgaagacccttgcattttgtgaaatgttttactgtaatccaatttcctttaaattttttgaagctagaactatggattcagagagacactggagggaatattttaaagtgggcattttgaaatatatcagcttcatattttcattgacatttcatttctaagttattaagagccttaagttaatatttgtatttcttgtattttagctttamatgagtataattggtcaagcacaaaatacctctctttgaggtacagtttaacttgaaatcttttgtaccactgaaatcttgaaataaatagttctagtttcctgcttaagatggaattgggagatcatgaatacttaagattttttttatattcattaaagttgtttaggaaggaaccagtcttactctgtctaggaaaaagatggatgcttcaacatagctggtgagaaacaaccatgagaaggaagcagacctgaagagctccccaacggctaataactgggaaaagattcataatgc

SEQ ID NO: 33588 - DNA, 601 bp, Human
aagataaaagttgtaaatcttatctaataataatgagaaagaaacctgaagacccttgcattttgtgaaatgttttactgtaatccaatttcctttaaattttttgaagctagaactatggattcagagagacactggagggaatattttaaagtgggcattttgaaatatatcagcttcatattttcattgacatttcatttctaagttattaagagccttaagttaatatttgtatttcttgtattttagctttaaatgagtataattggtcaagcacaaaatacctctctttgaggtrcagtttaacttgaaatcttttgtaccactgaaatcttgaaataaatagttctagtttcctgcttaagatggaattgggagatcatgaatacttaagattttttttatattcattaaagttgtttaggaaggaaccagtcttactctgtctaggaaaaagatggatgcttcaacatagctggtgagaaacaaccatgagaaggaagcagacctgaagagctccccaacggctaataactgggaaaagattcataatgcctaatactttctccaaaaaggttgtttttagggtcaagactca

SEQ ID NO: 33589 - DNA, 601 bp, Human
taaatgagtataattggtcaagcacaaaatacctctctttgaggtacagtttaacttgaaatcttttgtaccactgaaatcttgaaataaatagttctagtttcctgcttaagatggaattgggagatcatgaatacttaagattttttttatattcattaaagttgtttaggaaggaaccagtcttactctgtctaggaaaaagatggatgcttcaacatagctggtgagaaacaaccatgagaaggaagcagacctgaagagctccccaacggctaataactgggaaaagattcataaygcctaatactttctccaaaaaggttgtttttagggtcaagactcaaaataacttagctcaaactaaaaactatttcctaagaagccaggtggtaaagaacttacattttcctatcctctccctggtttgctgagcgaatatacgggactacatattacacagataagaaatttggctgagaagtgggctaaagaaatcatttctcatccataaaaatgaaaactttgtatgtctttgtaacaagttccattgtattggtatttctataataagaaaatcattatgtatcttattttaatt

SEQ ID NO: 33590 - DNA, 601 bp, Human
ttttttttatattcattaaagttgtttaggaaggaaccagtcttactctgtctaggaaaaagatggatgcttcaacatagctggtgagaaacaaccatgagaaggaagcagacctgaagagctccccaacggctaataactgggaaaagattcataatgcctaatactttctccaaaaaggttgtttttagggtcaagactcaaaataacttagctcaaactaaaaactatttcctaagaagccaggtggtaaagaacttacattttcctatcctctccctggtttgctgagcgaatataygggactacatattacacagataagaaatttggctgagaagtgggctaaagaaatcatttctcatccataaaaatgaaaactttgtatgtctttgtaacaagttccattgtattggtatttctataataagaaaatcattatgtatcttattttaatttgaagatggaatgagattaaataccatttgaattattaatatttcatttccttatgctaatacctgaagctctttttctaagagcaagttcttgattatgaaaagtgttttttaccgaaaaagccaatgaaaaccaaaaagca

SEQ ID NO: 33591 - DNA, 601 bp, Human
aaaagatggatgcttcaacatagctggtgagaaacaaccatgagaaggaagcagacctgaagagctccccaacggctaataactgggaaaagattcataatgcctaatactttctccaaaaaggttgtttttagggtcaagactcaaaataacttagctcaaactaaaaactatttcctaagaagccaggtggtaaagaacttacattttcctatcctctccctggtttgctgagcgaatatacgggactacatattacacagataagaaatttggctgagaagtgggctaaagaaatcatttctcatccataaaaatgaaaactttgtatgtctttgtaacaagttccattgtattggtatttctataataagaaaatcattatgtatcttattttaatttgaagatggaatgagattaaataccatttgaattattaatatttcatttccttatgctaatacctgaagctctttttctaagagcaagttcttgattatgaaaagtgttttttaccgaaaaagccaatgaaaaccaaaaagcaaacgtcaggcctaagagacctagtatatttttaatgttcaataacaaattttaaaat

SEQ ID NO: 33592 - DNA, 601 bp, Human
tacttttcccagctctttctacctgttcttgcaaaccctgcaatgcctttctcccaacctgaggtcctactggttcctcagaatttcatggaagtatatattgaaccacctggcgcattgataaatcactatttacatattatatgctgtgtactaggcaaagacttgtgtaaagacctgtgcaaagactcgtattattttcattatcaccagtgctacaagtaaagccaaacacatggaaggttctaaataaatggaaaagcaaaatgtcagaattaagagcatggactctaatgttagmcacaccagggttcaagtcccagctctgccagttagtaggtggctatctctgggaaaactattctctgggcctcatttttctcacctataaaatgtatattttaatgaggctaaataagataatgcatgaatggcacttggcacacagtaagtgctcaataaatgtgtgctgaaactgttattatgtgaattgctattatttaacattttcagttaaagtatagaaagtgttctattgttgaattcagaagttccagagtaacactgtattcccttcatcctgttacttacagacaaattt

SEQ ID NO: 33593 - DNA, 601 bp, Human
tgaatggcacttggcacacagtaagtgctcaataaatgtgtgctgaaactgttattatgtgaattgctattatttaacattttcagttaaagtatagaaagtgttctattgttgaattcagaagttccagagtaacactgtattcccttcatcctgttacttacagacaaattttgaggattagaaagaaatcaagtgcagtaggaggatactgggcagctctgtgacccaaagaatccatgacacccttgtgttacttagcttccttacttccacaatggaatgttattaatacccacastaccagtcacagagggctgctgtgggaaccaaatgcaataaagcttgcaaaagtggataaatggaagttcaattaacctaatccatcctcactttctcttccatggtacaaacaggagaaacctatagccaaaattgagatacagtgaagatcaccatggctggctgccttgcccagattatctataaaggcacagcttttacctaacaggaagcagttagtgcagcccaccaagtgcttctatgctaggaatcaccccagaggctaaaatttatgatactgcaccctataaccattaag

SEQ ID NO: 33594 - DNA, 601 bp, Human
tccacaatggaatgttattaatacccacactaccagtcacagagggctgctgtgggaaccaaatgcaataaagcttgcaaaagtggataaatggaagttcaattaacctaatccatcctcactttctcttccatggtacaaacaggagaaacctatagccaaaattgagatacagtgaagatcaccatggctggctgccttgcccagattatctataaaggcacagcttttacctaacaggaagcagttagtgcagcccaccaagtgcttctatgctaggaatcaccccagaggctaaaakttatgatactgcaccctataaccattaagtgagaatctttagaagtatgccccaggcgtcagtactctttaaagttacgcaggttattccagcaggttattcgaacacatagccactactctagctgaaggacacactatgcacaatccttatctaattccatcaggtgtgcaagtttcctaaccaaatggcctggagggccatgttacacagacttctccaccatccataagctcaagcaattggggagaagttatcgtcactaagaaaccaaagcacatctactcaccaaacaaactg

SEQ ID NO: 33595 - DNA, 601 bp, Human
aaaagtggataaatggaagttcaattaacctaatccatcctcactttctcttccatggtacaaacaggagaaacctatagccaaaattgagatacagtgaagatcaccatggctggctgccttgcccagattatctataaaggcacagcttttacctaacaggaagcagttagtgcagcccaccaagtgcttctatgctaggaatcaccccagaggctaaaatttatgatactgcaccctataaccattaagtgagaatctttagaagtatgccccaggcgtcagtactctttaaagttaygcaggttattccagcaggttattcgaacacatagccactactctagctgaaggacacactatgcacaatccttatctaattccatcaggtgtgcaagtttcctaaccaaatggcctggagggccatgttacacagacttctccaccatccataagctcaagcaattggggagaagttatcgtcactaagaaaccaaagcacatctactcaccaaacaaactgcttgaatggcctccttttgatataggtttgagttcatttaatccccaggcataacctttataattattccaagcatgt

SEQ ID NO: 33596 - DNA, 601 bp, Human
agattatctataaaggcacagcttttacctaacaggaagcagttagtgcagcccaccaagtgcttctatgctaggaatcaccccagaggctaaaatttatgatactgcaccctataaccattaagtgagaatctttagaagtatgccccaggcgtcagtactctttaaagttacgcaggttattccagcaggttattcgaacacatagccactactctagctgaaggacacactatgcacaatccttatctaattccatcaggtgtgcaagtttcctaaccaaatggcctggagggccatrttacacagacttctccaccatccataagctcaagcaattggggagaagttatcgtcactaagaaaccaaagcacatctactcaccaaacaaactgcttgaatggcctccttttgatataggtttgagttcatttaatccccaggcataacctttataattattccaagcatgtttcatcatctgaaaaaaaaaataaaaacaggattataatttgaatggagatgtttttgctacaaaataggtaatatattgaagagcaaaggctaaaacattaaaattcattagttaaaaggatgact

SEQ ID NO: 33597 - DNA, 601 bp, Human
caccaagtgcttctatgctaggaatcaccccagaggctaaaatttatgatactgcaccctataaccattaagtgagaatctttagaagtatgccccaggcgtcagtactctttaaagttacgcaggttattccagcaggttattcgaacacatagccactactctagctgaaggacacactatgcacaatccttatctaattccatcaggtgtgcaagtttcctaaccaaatggcctggagggccatgttacacagacttctccaccatccataagctcaagcaattggggagaagttatygtcactaagaaaccaaagcacatctactcaccaaacaaactgcttgaatggcctccttttgatataggtttgagttcatttaatccccaggcataacctttataattattccaagcatgtttcatcatctgaaaaaaaaaataaaaacaggattataatttgaatggagatgtttttgctacaaaataggtaatatattgaagagcaaaggctaaaacattaaaattcattagttaaaaggatgactaagtaaaagaattatgattatataaaccagaacacacatgctcatacaaacat

SEQ ID NO: 33598 - DNA, 601 bp, Human
tgggaacatgggctcatctagctgtggcagcagaagagtcctggagtccagggacgcagagctccaagagctgcgaagaggttggggttcctcttctcccaatctcccttccccttctgtaatagcttatagtttcccctcttccacaaagccctcttggaatgcctgaagggagtagaggcagaggcctgctccctgccctcacccacttcgtacggctctaggacttccctacctgtcggttccgctcgtcggtgattcgctggatctgaatctttttcctccccatcttctccggggktcctcagtgctacggaggggaggggctcgctgggtggtgggtctcggcacaccttacactgtgctcatgaacggtctgggaacagtgctcagttcatggtctgcaggataccttctgcacagcctcctggaaagggagggtcatgagaggactctgagcccccaaaacccccagccctgctccctgggcacacaggccagactcacagcgcccctgtgagaggctggcagcatctgagctccaccctcaacatgaggcaatgctgtctgcctgaggcaatggtatgccacagccaggcac

SEQ ID NO: 33599 - DNA, 601 bp, Human
agtccctggtttggggaaggaccaggctagtgcctgtaggccaacacacagcttagatacagcccagagcccactcactgaaggggcaggattcaggtggacagaactccacacctctgtgctggaggctatgaagaggtcagtggagaagaagagggagaggattcctgttgggaaaggaggagtgcctgggggtatgacctaaggcttgcatatggctctgggatgggaacatgggctcatctagctgtggcagcagaagagtcctggagtccagggacgcagagctccaagagctgcraagaggttggggttcctcttctcccaatctcccttccccttctgtaatagcttatagtttcccctcttccacaaagccctcttggaatgcctgaagggagtagaggcagaggcctgctccctgccctcacccacttcgtacggctctaggacttccctacctgtcggttccgctcgtcggtgattcgctggatctgaatctttttcctccccatcttctccgggggtcctcagtgctacggaggggaggggctcgctgggtggtgggtctcggcacaccttacactgtgctcatgaacgg

SEQ ID NO: 33600 - DNA, 601 bp, Human
gcagggaaggggcttccaggggatggggcctccaggggatgggctaaggagctggtgccatggatcagtccctgcccgaccaccctgtggtaagccctgaccagaaggcactgagttctccagggggaggtaggcaggggggctctgctcccagtccctgggctctgcttaggagaataggaggaagagagaaatagagatggagacagagagagcggggaatgggatgtggaaaaggaaagggggatgaacactgactgagtccctactgtgaccaccctacattctagtggaggcacakctgggggatctgcagtagaccccaaagctgccctcttcatgctcaaaatagctttacagatacttgctttgtctttaaaatgaatgcaaattttaccttctagtctagagtaaatctgtcttctctaacataaaaataagggactttcctccaaatctctgagtaggcctgtggcttcccgggcaccctcttcgtcagcacaagttctgtatccccaaggtgcacgcacctcagtgtgagaagcagggacattcaattcacacagcacccttcaaagcaggcactgaccccattttgtgg

SEQ ID NO: 33601 - DNA, 601 bp, Human
gtctataactctgcatcattttatcaaactcctcgtctatctttttatatttctcttccgtctggggggtcagggcaaacacctcgtccacctcagggctctcacattccctgtgcttcttgtgcagcgcctggggggaaggggccggaagggggggccaacagagacagagtgagtggggctcaccccatagcgccggaagagcccgtcgagctcctcgctggcgcgtcggtacttgtcctccagcagggggctctgttccagcgagtcctccccgtcgggctcggggctgtcgcagccrttgaagcccttcttcctcagggtctgtaaccgcaccactgccatcagctgggtgagagtccttcccgcccgcctcgctggagttccttccagcccctccctaagggccccctactcttccccgacctccttcttcagggttcccagcatctccctggcccctccccactgacagtgcctcctggggcatcgtgtgaagatctgaagatgggcttggtgggagctgtcggaacacagagaacaaggctggaaggtgagcctaacctgggggtgcacttggcagggagacatgtacttccaa

SEQ ID NO: 33602 - DNA, 601 bp, Human
ccatgcgactactcacggccagtctataactctgcatcattttatcaaactcctcgtctatctttttatatttctcttccgtctggggggtcagggcaaacacctcgtccacctcagggctctcacattccctgtgcttcttgtgcagcgcctggggggaaggggccggaagggggggccaacagagacagagtgagtggggctcaccccatagcgccggaagagcccgtcgagctcctcgctggcgcgtcggtacttgtcctccagcagggggctctgttccagcgagtcctccccgtcrggctcggggctgtcgcagccgttgaagcccttcttcctcagggtctgtaaccgcaccactgccatcagctgggtgagagtccttcccgcccgcctcgctggagttccttccagcccctccctaagggccccctactcttccccgacctccttcttcagggttcccagcatctccctggcccctccccactgacagtgcctcctggggcatcgtgtgaagatctgaagatgggcttggtgggagctgtcggaacacagagaacaaggctggaaggtgagcctaacctgggggtgcacttgg

SEQ ID NO: 33603 - DNA, 601 bp, Human
tcccctaagagcatgctgttgccctggaagtgtgtgcctgcctccatcccaattcccggaccactctgggaatggcaggaatggcagggtgacgtcaatcgtgacattcgaagtcacagtcacccagccagacaacggcacagggtaggaggggctgtccgctgccaggggttggggggcagcctttcttctgtggcttatttttttattttttgagacggagtttcgctcctgttgcccgggctggagtgcaatggcatgatctcagttcaccacaacctctgcctcctgagtttaagcsattctcctgcctcagcctcctgagtagctgggactacaggcatgagccaccacacccggctaattttgtatttttagtagagatggggtttctccatgtttgtcaggctggtctcaaactcccgacctcaggtgatccgcccacctcagcctcccaaagtgctgggtttacaggcgtgagccaccatgcccggcctcttctgtggcttatgtatgtgtgctcacaaatgcacatctaacatctggatacttctgtaagagggagaatgcacttatgtgtgttgagtgcctgcgtgagtgt

SEQ ID NO: 33604 - DNA, 601 bp, Human
aagggcctctatggatcactgctcacttgaggtctacaagcatttctctggccttctccttgaagagggtgacatattcacccacccctttaatttcctgaccctgtgacataattatcaccagggaggtattatacagtgccccaaaactgagctgggggatgctgaggtccaaggatgtgagagtgaccacagtcagaaatgcttccttgctctgtcccctaagagcatgctgttgccctggaagtgtgtgcctgcctccatcccaattcccggaccactctgggaatggcaggaatgkcagggtgacgtcaatcgtgacattcgaagtcacagtcacccagccagacaacggcacagggtaggaggggctgtccgctgccaggggttggggggcagcctttcttctgtggcttatttttttattttttgagacggagtttcgctcctgttgcccgggctggagtgcaatggcatgatctcagttcaccacaacctctgcctcctgagtttaagccattctcctgcctcagcctcctgagtagctgggactacaggcatgagccaccacacccggctaattttgtatttttagtagaga

SEQ ID NO: 33605 - DNA, 601 bp, Human
taggctggtacttcttgtgctgcaacctcttaaaaggccctctgggaagaaaaatctcataaaaagccatggttccaagatttatcttgggaagtcctaactgctggctagccttcatctctcctgctagaggtctgctctttcccctgtccctactcttccattccccagcccccacccttggcccagacacccacttaccaagtgatgcattaacccctttcctgcctgggaagtgatgactcgcaggtcgggcttgcggctgggggctccaagctgggtgctgtgggtaggtgggggyggagacttggcagggatgaccttgtttaggctgttgccattggccacagggaggaggccaggggaagcccgagcactgacgtagccattccctggagaagtgacaacaagagggtaaaaggaaaaacatgggcctatccttcagccctattaacttccccacaccaatactcctgttacccggaacctctcaaagccatgcttaggctttgagtgggggctgagctatctgatattccctgaacacttcatgtcttgagaataatgggaggcaagtaccccttactcctgaatctttagg

SEQ ID NO: 33606 - DNA, 601 bp, Human
gggcctagtccaggcatcagggtgggacctctgagccctgggctggcccactccccctcgcacacgtacatacagagaaaggtgtgtctgaatgaacataataccacatgcagacattcatgtacacacaggcacacacacacacgtctgacctctcacccccaccccattcacctttgaatcccacttggcacctaagcacagctcctggcaactaagcaaagaaacagcaacagttcacgcacaggcgagaggccaaggacgcacacgtacttcatgctgggggaccgcagagcaatamccagaattcaaagccacagcaaagagctcacagcctcacttaccagatctaaatggtcctcagtctgagagcagaaataaaaccaaggggatgttcagtctctggccgctgccctcccccacacctctgtccccacagctgttccagtcacctctctgcataagagtagggtggctctacccagcctacaaaggcagagctctccaccgtcctgactcatttccagagatgctccatcccaatctccaccagtgaggaaatgctcaccatctaatccccatccctcctgctatagtggca

SEQ ID NO: 33607 - DNA, 601 bp, Human
tacatcccgcttaattttctgtatttttagtagagacagggtttcactgtgttagccaggatggtctcgatctcctgacctcgtgatccgcctgcctcggcctcccaaagtgctgagattacaggcgtgagccattgcgcccagcctttttatgtttgaacttttttttttttgagagggagtctcgctctgtcaccaggctgaagtgcagtggtgcaatctcggctcatggcaacctctgcctcccggattcaagtgattctcctgcctctgcctccagagcagctgggactacaggtaygtgccactacacccagttgatttttgtatttttagtagagatggggtttcaccatgtggctaggatggtctcgatctcttgacctcgtgatcctcctgcctcagcctcccaaagtgctgggattacagatgtgagccaccacgcctggcctgggttctggatttttacatgtggggaggaggtgggattttgtggttatttgcactggtggctggttcaactctgggaggcttggggaagggggagaagtttatgagtcttttggtccagactaaactcatcaaaggaactggcctgaca

SEQ ID NO: 33608 - DNA, 601 bp, Human
cataaggagactccatctctacaaatagcttaaaaattagctagggtggtggggtgcactgtagtcccagttattcagggggctgaggcaggagacttgcttgaacctgggaggttgaggctgcagtgagctatgatcatgccactgcactccagcctgtgggatcttgtctcaaaaagaaaaaaaaaatcatgtgtaggtatcactttcataacaatttaaaaaaataaaaagatggaaacagataagtagagaaggtctatgtcttggcctcatgcccaaggggcagaggggctgcaagggtaccatgccgggagcacagctggccaaggttccagcagatctccccatgagggggtgttcattacgtcataaaatgtctaccttaaagaagaaactgatggttgcactgtcacagaataaatagaatcactgaatgtttcatgatttacacagcactattgtttcatgctgtatcctgtttgggacagtttagaaaatgtcctccctagttcaagattagcctggccaacatggtgaaaccccatctctattaaaaatacaaaaaattagccaggcggtggcgcgcacctgtaatccc

SEQ ID NO: 33609 - DNA, 601 bp, Human
tggagtgcagtggtgtgatcttggctcactacaacctctgcctcccacgttcaagcaaatctcctgcctcggcctcctaaatggctgggattacaggcacatgccaccacgcccagctaatttttgtatttttagtagagatggggttttgctatgctggcaaggctggtctcaaactcctgacctcaagtgattcgcccacctcggcctcccaaagtgctgggattacaggcatgagccaccgcatccgaccaagaggtggtttttaaaaatagtgttgaacttaaaaaaaaaaaaaaamaaacagctgggcgagtggctcatgtctataatcccagcactttgagaggtcaaggcagaaggaccacttgagcccagagtttgagaccagactgggcaacataaggagactccatctctacaaatagcttaaaaattagctagggtggtggggtgcactgtagtcccagttattcagggggctgaggcaggagacttgcttgaacctgggaggttgaggctgcagtgagctatgatcatgccactgcactccagcctgtgggatcttgtctcaaaaagaaaaaaaaaatcatgtgtaggt

SEQ ID NO: 33610 - DNA, 601 bp, Human
ctgtgaccttgggggctttactctgcgttaggacatccactgtactcgaaaaactgagacacttaagcatgtaggtcaaaggaagtaacttggtgagcatttggaacatcaaatctaaatcaaagctgtgaattgttatctcatttcctgggtccctggcctcagaagtaaccaagacaataaacataataatacatgatgtaggaacatgtgacagccttaaggaaaccacttaaaaagatttataaggattgaaaatatgaaaatgataggcgagatgtggtagttgtagaagagacayaagagagctcacatgtacacaatttgagtttctgcagaagaacaaagagcaaagaagcagggaagctcttaagttttcatcctacagataattattgggtatccactgtgtgccaggcaggcaccatgcggggaccaaggaactagtgccgagcgtaaactccctcttagagtttaagaataggggggtccatggtgattgtagaaccatgtgaacaagactacagctgagaaaaatgccctcaggaaaggcacaggtcttttgtggactggttaattcgattcaactttttgtggaggt

SEQ ID NO: 33611 - DNA, 601 bp, Human
aaccacttaaaaagatttataaggattgaaaatatgaaaatgataggcgagatgtggtagttgtagaagagacacaagagagctcacatgtacacaatttgagtttctgcagaagaacaaagagcaaagaagcagggaagctcttaagttttcatcctacagataattattgggtatccactgtgtgccaggcaggcaccatgcggggaccaaggaactagtgccgagcgtaaactccctcttagagtttaagaataggggggtccatggtgattgtagaaccatgtgaacaagactacarctgagaaaaatgccctcaggaaaggcacaggtcttttgtggactggttaattcgattcaactttttgtggaggtcaggcttctctgaggggggagcattgcaacttatcggaaatttatatacattataatccagtttaggtaacagatgaaaaacgtagaccaaacaatactatatattgtagtttctgtaataagagattgttttaaaaagcgtatagactagaaggaaatgtgctcagttcatgatcattgttgcctctggggagggaggaaagagatagaagtgaagagagaacaa

SEQ ID NO: 33612 - DNA, 601 bp, Human
tctcctggaaggaggagagggggctttattatcaggtgtttgaactggtgatttgggggttggagcagttctggcaatgacaagatccaaggtggaaccccatcaaaagtggagaaagggccactggagatggaggcagtcaggaagctggactgaagaagtgttcggtgggttttccgcatgatgctaagccacggcagggtggccgagcccgagatggaggaaagactgttagatgaaggccgattagaagtccataggtgacagtctgaagagggggccagtggtgtggctgatgacrtaaatcttaaaggggtagggtcttttgttttgctttctaaagaagaatatatacaaattatggtttaaaaggagcagttggagccgggtgcggtggctctcgactgtaatcccaacactttgggaggccgaggctggtggatcacctgatgtcaggagttcgagaccagcctggccaacatggcaaaaccccgtctctactaaaaatacaaaaatcagctgggcatggtggtgtacacatgtagtcccagctacttaggaggctgaggcaggagaatcacttgaacctgggaggcagtgg

SEQ ID NO: 33613 - DNA, 601 bp, Human
gatgaaagtcagtgtgtggtaatgtgtgtaaggtaatatcatccaaggaacttgagctcctgaattgcctgcccactcacctctcttcccaatacatattttcttatgtctaaactacatattctgagattcttcctgaagctgtagaactttataattggaaaggatagagaattgaactttatgtgacttattcataatggctacatgactggttagtggcaaagttgaaaatttaataatttaggtctcttcattcccagtgtaaatttcattctcctttcacaatccccagtatttrctagaggtactccatatcagcagtgtgtaatagaagatttatttattgttttgtttaataaataattcaaccaaattaaatataatagaaaaaagttgcagagaagtacaaaggcctttcaaagtttatgacaagccccagcctggctgtctttttccattatttcctgtttttgacactttctattttgtatcccatgtatcagtcttgatctcatccacacttttccaggccatcagttatgtcttctcactcacattaaggcttaacttcttgaagaagaaacattctctgaagtta

SEQ ID NO: 33614 - DNA, 601 bp, Human
attcttcctgaagctgtagaactttataattggaaaggatagagaattgaactttatgtgacttattcataatggctacatgactggttagtggcaaagttgaaaatttaataatttaggtctcttcattcccagtgtaaatttcattctcctttcacaatccccagtatttactagaggtactccatatcagcagtgtgtaatagaagatttatttattgttttgtttaataaataattcaaccaaattaaatataatagaaaaaagttgcagagaagtacaaaggcctttcaaagtttrtgacaagccccagcctggctgtctttttccattatttcctgtttttgacactttctattttgtatcccatgtatcagtcttgatctcatccacacttttccaggccatcagttatgtcttctcactcacattaaggcttaacttcttgaagaagaaacattctctgaagttacaagtcatttcgtaaacacttgtttttcttctgttggtctgatttgtctgatttatctataaacatttattaactaaatatttaggttatctctctctatggattgctggaagaatattttgtaacca

SEQ ID NO: 33615 - DNA, 601 bp, Human
ctggaagaatattttgtaaccatagtaaggggattgcctgatggagaccttgtgtgcactcgtgtgtaagggtgggtagagagagagaccgatttggagctattgtgatgttgctgacagaggtgacaaaagctcgagccagggcagggcttctcagcctcttggatgtggatgtttgggcccgtaactcttggtcgtggagggccgtcctgcgcattgtaggatgtttagagctagggcagggcttctcagcctcttggatgtggacgtttgggcccgtaactcttggtcgtggagggcygtccggcgcattgtaggatgtttagagccagggcagggcttctcagcctcttggatgtggacgtttgggcccgtaactcttggtcatggagggccgtcctgcgcattgtaggatgtttagcagcatccctggcctctactcaccatatcccagtacttccactttttcctccaaattttgaccatcaaaaacttctctggacaacgtctccagacgctgaggggagggggagaaatctgccccagaagagaacccctggactagggagtagcagggaaatgaggacagcacgatcggagg

SEQ ID NO: 33616 - DNA, 601 bp, Human
ggaagaatattttgtaaccatagtaaggggattgcctgatggagaccttgtgtgcactcgtgtgtaagggtgggtagagagagagaccgatttggagctattgtgatgttgctgacagaggtgacaaaagctcgagccagggcagggcttctcagcctcttggatgtggatgtttgggcccgtaactcttggtcgtggagggccgtcctgcgcattgtaggatgtttagagctagggcagggcttctcagcctcttggatgtggacgtttgggcccgtaactcttggtcgtggagggctgyccggcgcattgtaggatgtttagagccagggcagggcttctcagcctcttggatgtggacgtttgggcccgtaactcttggtcatggagggccgtcctgcgcattgtaggatgtttagcagcatccctggcctctactcaccatatcccagtacttccactttttcctccaaattttgaccatcaaaaacttctctggacaacgtctccagacgctgaggggagggggagaaatctgccccagaagagaacccctggactagggagtagcagggaaatgaggacagcacgatcggaggag

SEQ ID NO: 33617 - DNA, 601 bp, Human
agaatattttgtaaccatagtaaggggattgcctgatggagaccttgtgtgcactcgtgtgtaagggtgggtagagagagagaccgatttggagctattgtgatgttgctgacagaggtgacaaaagctcgagccagggcagggcttctcagcctcttggatgtggatgtttgggcccgtaactcttggtcgtggagggccgtcctgcgcattgtaggatgtttagagctagggcagggcttctcagcctcttggatgtggacgtttgggcccgtaactcttggtcgtggagggctgtcckgcgcattgtaggatgtttagagccagggcagggcttctcagcctcttggatgtggacgtttgggcccgtaactcttggtcatggagggccgtcctgcgcattgtaggatgtttagcagcatccctggcctctactcaccatatcccagtacttccactttttcctccaaattttgaccatcaaaaacttctctggacaacgtctccagacgctgaggggagggggagaaatctgccccagaagagaacccctggactagggagtagcagggaaatgaggacagcacgatcggaggaggtc

SEQ ID NO: 33618 - DNA, 601 bp, Human
gaccgatttggagctattgtgatgttgctgacagaggtgacaaaagctcgagccagggcagggcttctcagcctcttggatgtggatgtttgggcccgtaactcttggtcgtggagggccgtcctgcgcattgtaggatgtttagagctagggcagggcttctcagcctcttggatgtggacgtttgggcccgtaactcttggtcgtggagggctgtccggcgcattgtaggatgtttagagccagggcagggcttctcagcctcttggatgtggacgtttgggcccgtaactcttggtcrtggagggccgtcctgcgcattgtaggatgtttagcagcatccctggcctctactcaccatatcccagtacttccactttttcctccaaattttgaccatcaaaaacttctctggacaacgtctccagacgctgaggggagggggagaaatctgccccagaagagaacccctggactagggagtagcagggaaatgaggacagcacgatcggaggaggtcatctagaagtacatggactttttcactctgtggaattgcacccgtacttatggttgagcaaccgtccaggaggagaaaaca

SEQ ID NO: 33619 - DNA, 601 bp, Human
tggagggctgtccggcgcattgtaggatgtttagagccagggcagggcttctcagcctcttggatgtggacgtttgggcccgtaactcttggtcatggagggccgtcctgcgcattgtaggatgtttagcagcatccctggcctctactcaccatatcccagtacttccactttttcctccaaattttgaccatcaaaaacttctctggacaacgtctccagacgctgaggggagggggagaaatctgccccagaagagaacccctggactagggagtagcagggaaatgaggacagcacratcggaggaggtcatctagaagtacatggactttttcactctgtggaattgcacccgtacttatggttgagcaaccgtccaggaggagaaaacaacaggtggttgatgtataaaaatattgaagataaaagcatctattccaagagcagattataactagactgtatcattttaaatgcatttttttctcttctatttaagaatgccaaataaaatgacataatttcttctatatttggtaattcctttaccaagtggctgaattgtttgtagtggttaatgtctgtgtgatgatgaacg

SEQ ID NO: 33620 - DNA, 601 bp, Human
ttgtctgccaagcaacaggaactgcccctgctgcaggtggctgcagatcacttccctgtcccccgttcctcacctttgaggagagcagtgtccatttctccacagctttcccaagtacccatcttcccaccagctgtagtaaattctgatttggttttactgtttaaaaaatcaagttaagttatgctgctatatatattacttcaattacaatttttggttacagtttatgtacaattttacagtaacaatgaatgattaacacttttatagtatatgttgaaatgttgaaaacaaaatrtatgtcaaaaaaagctgtgtcttatgccgttcttgagatagtttgtaaataaaacaaaactgtatttgtaagtaataaacacccaagaaagaaacttagaaattttatgcaatttaaattacacaaaatataattcataaatggtaaatttattgaacactaactgtatttcatatagggtacttgctggctgcagaaaattcagtagaatgggttttaattgttggttttttaatcttcagtttatacctctttttctcccaaggttgtcgtgaaaatgaaagttaacatttgtaagac

SEQ ID NO: 33621 - DNA, 601 bp, Human
gaacatccattttgcttattagctatttgaattttctttccaatgaagtggaaagttttgcagtgttacatatacctactattaaaataattgttttgtttcatgcaaaacatgtgcacatggttttttaaacagaatgtctttatttgtaggaaaatttttactaatttttgactagttcccagtatctttgctcaattaaagactcaccaaatcttttgtttttttttaacctttgttactattgaatttcttccatttgttactattgaatttcttccatttgccattgtaatagctrggataatgaatcagagacacaaattgcctgagggttttttgttaacaatcccttaagttttgttttgtaagttctgtaagggaacttcagatctctccatttttactacttctgtctctcttgtttccccttattaataggaaacaaaatcatgaagaaacaggatttccatttaggataaaacctatttgggataaaacatatataaactaaaattattaacatgaagagaaactatgacattaaaaaaatactaaggagggttaaaacagagtggtaaaagtgaagaagagaaaagca

SEQ ID NO: 33622 - DNA, 601 bp, Human
catgttcacatgagactgctcccgaactggacaatagggagtgacctccctctttttaaaggttgatgcactgtgttttaaggcatttgtaagttggtagtgtggtacattatgtgtattttagtataagagttaaatactacagttacccttttcatggagtttagtctttgcagaagcagtttttcagcatttcatcttaaacgcttatcagtagcatttcataagtattcatcttaagtttgtacatacttagacaatcgttgatgtttagaaattttaatagtatcatagcatggtrtcttgaaggacattttttactcaggattcccgtttactttatgaccgtctgtgtgtgtgagatggtaggtagagaagagcacagccacgtgaagaggtgtggggtggttaccagactccctcctgcattcaagccctgcgtaagcctcagtgccttcacagtgagcctggttcatgggcccgtgagtcactggtggattcggcccactgctcccgaggcagacttcacatacccaagggcttgtgtctcaacacagctgtgggtttgtgaatgtgccacggggaggcagaatgacaccag

SEQ ID NO: 33623 - DNA, 601 bp, Human
ccgtcttacagatacatcaaagttcaacttcacttgaccctagaggtttcaataagtatttttaattgattttacttgacctaggaaatatctgttctgggcttaagttatcttatcatcgtttgtaaaaacactttgcagtggtgctcttgctgaggcttgctcctgctggctctcaagagctgatggcgaatgtttgagaaattttgcaagttgttataccacagaaattggcaaactctacaacccacctccccatccccgacatcccccaccagagctagtcgttcaacattccccratatgccacttcatgagtatatgttcttgctttttacccgtgcaaaaatctcttaaggacatggaattggctagtctcacttgtgggaaatcggaaaaattagaggtgtttagtgacttcttggtctcaccagtggtctttgttgctgcttaggagtggagtaggcttcctcacttcaacaccagtggttttcccgtcagatagtgccgaattttttatgaactatatggcagtagaaatgtccccatcacttcagacttaacaagtgctatactagatttgagggcttagggaaatacc

SEQ ID NO: 33624 - DNA, 601 bp, Human
gatggcgaatgtttgagaaattttgcaagttgttataccacagaaattggcaaactctacaacccacctccccatccccgacatcccccaccagagctagtcgttcaacattccccaatatgccacttcatgagtatatgttcttgctttttacccgtgcaaaaatctcttaaggacatggaattggctagtctcacttgtgggaaatcggaaaaattagaggtgtttagtgacttcttggtctcaccagtggtctttgttgctgcttaggagtggagtaggcttcctcacttcaacaccrgtggttttcccgtcagatagtgccgaattttttatgaactatatggcagtagaaatgtccccatcacttcagacttaacaagtgctatactagatttgagggcttagggaaataccagaaaaaaatgcatattttataatttgtaaatgtctgtgcaatagatcatgttgccttcaacctatcaatgtataataagagcataaatgctaccatacttcattataccattcacttaaaaatatatactaaatgactttaataaactaatgccatatttatttgaggttctttgattattcg

SEQ ID NO: 33625 - DNA, 601 bp, Human
taaatgctaccatacttcattataccattcacttaaaaatatatactaaatgactttaataaactaatgccatatttatttgaggttctttgattattcgaattacaattttaacacattccctatttagttttaatttttactctttatgggttcattctggttgctgaacatttcactttattctggaaaagcacctcattaactttgttctttaatatattaagcttcctgctcttttgcacttttgcttggctactgcttgagaaacctttaggtattcccttccattttcttactragagatttggaatcttttggaccatgaaatcattttagtactttaaatgtaattaagtacataaatataatttgatggtaactttaaagatcagcaagatttggttaataacagttttattcaccctgggcttaagttatggagcttttcacatgtcagtaacatttcaatagtgttgtgtttttatttctgttgttaatataagacaaggttttatgcaggcaggtgctctcaggctcgggtgttggctatggagagatgaaaatggagccctccttccagactctagagctctaacag

SEQ ID NO: 33626 - DNA, 601 bp, Human
cttaaaaatatatactaaatgactttaataaactaatgccatatttatttgaggttctttgattattcgaattacaattttaacacattccctatttagttttaatttttactctttatgggttcattctggttgctgaacatttcactttattctggaaaagcacctcattaactttgttctttaatatattaagcttcctgctcttttgcacttttgcttggctactgcttgagaaacctttaggtattcccttccattttcttactaagagatttggaatcttttggaccatgaaatsattttagtactttaaatgtaattaagtacataaatataatttgatggtaactttaaagatcagcaagatttggttaataacagttttattcaccctgggcttaagttatggagcttttcacatgtcagtaacatttcaatagtgttgtgtttttatttctgttgttaatataagacaaggttttatgcaggcaggtgctctcaggctcgggtgttggctatggagagatgaaaatggagccctccttccagactctagagctctaacagactccagaggacggtctccacagcagcgctg

SEQ ID NO: 33627 - DNA, 601 bp, Human
aagtgtgcacccagaggcctcgtgactacaggggagagccactgggcgcagatgccaatgcaggagaaactggagagtgaggggagatcagatcatggacagccatcagtgactgcctaagtaatgaaggctttgcccagaggtggtgggcagccccagaggctcttgagcagctggtgtgtttgggatgtgggaggctggggatgagtaagacgctgagatagtatagtctgctagccagaattgaggagaaagtgggcagattggttaaaatgccattgcagaaattcagtataaatartacgatactggactaatgtgggatttaaaagaggtaatggcagcaagaaacaactttggtgcaaccactgacaagcctggtgacagagtaggtgtgtgttgagggttcaagtgggggagttttcctaggcttgagccgggtgacaggaagacagtttcttcagtggctcacatgtaatcagcagttcccacggataccaggtctttgccatatttttcaaatcaagtactttgtggtcaagtaaacttgggaaccacttggaattatgtttctcttgtgagagttacagttcacattgac

SEQ ID NO: 33628 - DNA, 601 bp, Human
cccaggcattttgattctagagccctttttctgtactcttcccagagaagggaaaatccttctcatcagagatggcttcctagaagaggcgtggcatttcagctgcactgtgtgagtaagattcactcaacagatactcaggtatgaataagatactttaggcagagggaaaggtgtaaaagtaatggaagtgaaaagtaaagtagtttggtgtgttctgtaagagtctttcagtttggctagtgtgaaaacatagaaaagacaaactgggtccaaattctgcaggggtttggatatttgrttagtaggtagtggagaaccatgaactaagttttttggttttttgttttttttttttttgagacctggtcttactctgtcacccatgctggagtgcagtggtgcaatcttgactcactgcaacctctacctcccgggcacaagggatcctcccacctcagcctcccaagtagctgggactacaggcacacaccaccacacctggctaacttttgtatttttttgtagagatggggttttgccattttgcccagtctggtcttgaactcctaggctcaagtgatctgcccacctcacctcc

SEQ ID NO: 33629 - DNA, 601 bp, Human
ccgtggggcctttgggcctggcggctctgggtgatagaaattccgtatagacgctggtcgtgattcagttctctgtgcgtagagctgtcttcagcaccagcactgcgacagtcaggaccaaccaggcagatgcactgagataacacacacagacagtgaaggggcttacgattccagagaggataataagtcacagacagttctaacagcacaggtgtgagaagggcctatgagggtggcagagctgagtctgatgaaggcttagaggagaggattaacagtagtgtcttatggggacacrttgggggagaagataacatttatgataagcttcagaaacaagtggcattgaaaccgctggaggtaggatggggaaagggccagggaacctgaagtagaaacaggactcactgctgtctgtggagacatccggtttgacgtggaaggaggagaggagtggagaggggaggctccagcgtcttgcacttgccgtggagccgcgtcctcctccacatggcgctcctcactccctctcggagcagggcctcttcctcctctgtgcccgggacctacccgcacttctatgacttcactctagctt

SEQ ID NO: 33630 - DNA, 601 bp, Human
aggtaggatggggaaagggccagggaacctgaagtagaaacaggactcactgctgtctgtggagacatccggtttgacgtggaaggaggagaggagtggagaggggaggctccagcgtcttgcacttgccgtggagccgcgtcctcctccacatggcgctcctcactccctctcggagcagggcctcttcctcctctgtgcccgggacctacccgcacttctatgacttcactctagcttggctaaaaacttcctttttacttaattttttgttgtttttaattgacaaatcatgattacmtatatttatggggtgcaaaatgatgtttcagtgtatgtgtataatgtagagtgattaaatcaagccagttaacatttttgtcacctcactttacagattcgatttcaacctaatgaccataagactatcaaggaaactgcagacgaattgaaaatattcgaaggcatcaaacaccccaatctggttcggtattttggtgtggagctccatagagtaagccgaccctaatgccactctttgtgtgaggaatcagtgagggcacagaatggagtcctgttctacatcacaggtcttctcatt

SEQ ID NO: 33631 - DNA, 601 bp, Human
tgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcrtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctcagttatattgtcttttaatggttaacacttatgagccaacgcagtatgatacagaagtctgtcattttcactcatctgttcctcaaaaggaggagcacaatcacgtgtgctaaagatggtcactgggttcggcg

SEQ ID NO: 33632 - DNA, 601 bp, Human
caggtaaaccttcaggcctgacaagccctactgtttctacaagaagggatggatgaagttaagctagtaatctctcttcaaaatatattacaagataaaaaataaaataaaagaaagtcagtgggagacaaaggaaaatcaggaccaaaaacaaatgtcatctttatactgatttaatttgattcaagcacagactacttccacttcccagtacaacctgcccatattgctctcgggaattctaactatcggattaccagtgaccataatgctaaaaaactgaataaggctttttttttttcaaggcaaaaatcaattctaaaatttgaaaatctgctatcagtgccgaatatcatgatacaaaaagggaaaaataaaagctaaaattagttatatctcatccacccaaaatcaggcttcccctcacgtctttctgctcagcgcctacaagtaggtctcttcacaccaactatgttaataccaacactacatacccttaaggaaggtggtgtagcaaatttcacacaaaataatttttaaatagacaaaactgataatggagataaaacaagaatcacacactttagctcagtgcaacaat

SEQ ID NO: 33633 - DNA, 601 bp, Human
acttctctattacaatttatctgtttgaaagtcttctctcctgaaaaggtgagcttccagacccaagagccctgcccttcatttctttaaccagctatccaatagaatgtctaacacatgggggaactcaatgaaagaaacaagtgaccggagcagatgctaggctttgttaattcactttgtaggtgcttaacgcatagattttcagaaatacgaacaggtaaaccttcaggcctgacaagccctactgtttctacaagaagggatggatgaagttaagctagtaatctctcttcaaaayatattacaagataaaaaataaaataaaagaaagtcagtgggagacaaaggaaaatcaggaccaaaaacaaatgtcatctttatactgatttaatttgattcaagcacagactacttccacttcccagtacaacctgcccatattgctctcgggaattctaactatcggattaccagtgaccataatgctaaaaaactgaataaggctttttttttttcaaggcaaaaatcaattctaaaatttgaaaatctgctatcagtgccgaatatcatgatacaaaaagggaaaaataaaagctaa

SEQ ID NO: 33634 - DNA, 601 bp, Human
gatttcctagttgctgaagagatctaggtatacacttctatttcaaatttaaaatgttaaaaaaaaaaagtctttacaatcattttgatgtcaaaacttggtttttaattaaaaaaaaaaaagcattcctgaaaaggtttattaaaactggttttcacacctcttatgaaaaagaagtggctcacacttataatcccagcactttgggaggccgaggcaggaggttcacttggggctaggagttcaagatcagcccgggcaacacagggagaccctgtctctattaaaaaaaaaaaaaaaagaaaaaggggaattttgttgtaaatgtacacataaagtgttcttagaattttgggagacactttcataaatgaagaatctctgtcaaatgaatatatatgtaaatatatattacccaaatatagcaaatatttgctatattagtattcattcattatatattacatgtatattttattaaacatacgtattaaagtacaagttctaaatatcaccttttcctataatattttcccattcctaatgacatatttcatcataaaaaattatacccaatggatctcagtttcagacattttta

SEQ ID NO: 33635 - DNA, 601 bp, Human
acagcacaccccatacatcaaatcatatctagattacttgtaatacctaatgaatgtaaacaatatgtaaatagctgatacactgtattgttttatggaacagtgacaagaaaagaaagtctgtacatgttcagtatgaatgcaaattttttttccaaatatttttgatccaaggttggttgactccacagatcccccaatctggagggttgacgatacagtgaaattcactgacacagattttccttttctgatttctgtgacacaattaggtgaacagggtatgaaacctccttttggyagtgcgtttccacagcttccccatcattcaaagacacatttcctatgcacatactggaggcacagaacaaaaacccagtacaacagaactactcagagcctgcaacttcactccagggaaaaaccctttacagtaagatactttatcagttttcttaagagcgggaggcttgtggtgaacatataatcatctgaaaggtgttaatgctcaaatcagttgtatgggtggaaggaaattttccaaaaaaggaaaaaaaataaagatggggatgagttatgctgggtgaaagaagtcagtcaa

SEQ ID NO: 33636 - DNA, 601 bp, Human
agaaaggttcttttatacccagagaactacatatacaaatcacatcttttttttttaagttttcaaaatgagatattattatacatgataaatactaaaaatgtcaaaataagatatagcgcagagaagttaaaatcttttagtgaagatcaaaagcaaaaatgtagaaaaaaatcctagaatactgattaagatgaagactaagacaacaaatacacagtgaattctgggatttgtgacagccacgccaagtcacccctcagtatcaatggacaatggtttgatcctcccacagataccygaatccacagatgctcaagtctctgatataaaatggtgtagtacttgcatataaccgacacacagcacaccccatacatcaaatcatatctagattacttgtaatacctaatgaatgtaaacaatatgtaaatagctgatacactgtattgttttatggaacagtgacaagaaaagaaagtctgtacatgttcagtatgaatgcaaattttttttccaaatatttttgatccaaggttggttgactccacagatcccccaatctggagggttgacgatacagtgaaattcactgacacag

SEQ ID NO: 33637 - DNA, 601 bp, Human
acactgtaagggagagctcaggacacaggcttcagagccacccaactgggatgcaagactggccttgttactgctgtgggaccttggacacgttatttagactttaggctgccgtgaggattaaatgagatcatgtgtgcagcacacatttcctatgtgaatgaaccatggccactgttgagcagttgtgccatccagagagcaaagggcccaatgctgggcagtggtcccaacccaccccatagtaccactagcaggaacccagtcctcttccctaaatgcaaatgccatggccccctcwaaactaaatagtgagctgggtctagatacaatctgcaccctgctgggtaggtcttcaaggagggataaggttgtaagaaccactcaccagtcgctactcagagactcaaggatactcctgttcctcagttggttcacaaaaaaacacttaagatttatatgaatcgaagggtttctgctaccattctcatgggccttcccaaatactagtgaaacgtagatagtcattacccatcaaaaaaacactcaccaagaagggccagactcccacacacggatcccagaagtcagggagagagtg

SEQ ID NO: 33638 - DNA, 601 bp, Human
ccttctttctttctttcccttattttggagacagggtctcactctgtcacccagcacccaggctggaatgcagtggcacaatcacagctcactgcagcctcaatcttctgggctcaagtgatccttccacctcagcctcccaagcagttgggactacaggcatacaccaccacgcccagctaatttttaaatttaaaaacactgtaagggagagctcaggacacaggcttcagagccacccaactgggatgcaagactggccttgttactgctgtgggaccttggacacgttatttagacyttaggctgccgtgaggattaaatgagatcatgtgtgcagcacacatttcctatgtgaatgaaccatggccactgttgagcagttgtgccatccagagagcaaagggcccaatgctgggcagtggtcccaacccaccccatagtaccactagcaggaacccagtcctcttccctaaatgcaaatgccatggccccctcaaaactaaatagtgagctgggtctagatacaatctgcaccctgctgggtaggtcttcaaggagggataaggttgtaagaaccactcaccagtcgctactcaga

SEQ ID NO: 33639 - DNA, 601 bp, Human
aacatgatgagttactcaatttaaatcattccctctgtacattaacttacaagactttattaaatctttaattctttgttttagccactgtcttatattttgccatatgcatggttctaaaatatagttctttctgggtgctagccaacactcaatgatatctaagtgccacgatactgcaataattattacttcaaattcttcttctctcctacttccaagttgcttttcttttctagactgttgatattctacccagtttattttccccaatatatttatcattttattatttaaaaakccctattggcatttttaataatatctagaaatgtggtatgtatcctatcactacaagtcctttctatctaaaatggtctgctagcccactacaattctttatacacaaacaggggcatgtcgatcttcagtaaatagagattatgaataaccttctatttttaacattgtttgttgttatgtaaagtcagtaccagttccgtataaatctggcacaattaataggcattcgacttttccttgctttgctaatgaaagcaatataacgataaagcttaaactactgtgatgacacagctag

SEQ ID NO: 33640 - DNA, 601 bp, Human
tcttgtatttcctttcaatctacttttaatgttatattatatatttagaataattaaggcccaactgtatatacttttgtatcttgctctttcttgtaaaattatatcacaaacattgaacagttctccatgtctttaaacgttcttcaaaaagttggcttttgatgcttgttttgtgttgttatatagactgcaaatgtttttactctcccactcccatgaaccacaatataataaaaatccttgttacagtttttaatccttgtttgtttccttaggataaattccaagaaattaatcwcaaagtatgcacattgatatatattaccaaatgctcctccatgaagtcttatcaatttacccgtaactagagaggatccatcatcccaaaccagaactactattcttattctgtttcaactttgtcagctgctggctgacaaaaagttttgcttcattctatctttccttaatggtggtgggtctcatgccaggtacagagcagagcactttacacaaattatttcccttacatctcatatgattcttatgaagtactttttatttccgttttacaaaggagaaaactagggtttagtga

SEQ ID NO: 33641 - DNA, 601 bp, Human
ggacactgtgtatgaggggctgacagccggagcacagccacgagtgtgagctctttgttacatgttaacttcactagacaatgggaagtccacaggaggattctgggcaggaaagtaacaaatcaatactttatgaaaactaatccagtgttcacagacggggaagactgaccagcaggatggtgacatgctggccatggaggctctggagtctgtctggcttacaaaataacgtcccacaacctctacagccttggtctaaaaaaagccaggaataatagtagcaccaagctcaaaattkttgtgaggatttgatgagaaatatatgatttaaagtagcaaatactcagttgatgttaaatcactgttaggaagacagaggcctttagaacagcccgggtgtttggtgataagaatcaaggtgatttgcttttgggatgcagacagatgcaggactgtaggaacaatgcaaggacttggttagaagatatgacaatattaggaagggaaagaatacaactaactcccaaattttattttacagagaagtattaatgaagaattgatgtggaaagcggcaaacgtggtcaccttaggcaat

SEQ ID NO: 33642 - DNA, 601 bp, Human
attcaatattgaggggttccctgggagctgctcccggggaaagaggagctacactgtaatcatatgttagataaaagcggcaatgtctatgctggtgaaactgaacatatactatttgtcagcaaaatttcaaaagcacccttcatgaggatacattaaaactattcacatggattctctactagcaaccttccttctgaagatatcaaacttgatgatagctagcattatcatgatttgtcatacattcactcaatacttttactgagtccaaaactaatatgcattaaaaaacatgatycacgttcttgatcctttgtaagcctagaagttagataagcaacacaacaataacagcatcatcatcaacaaaaggtaaagaagaatgccacatgactgaaataagtaaaatacgttcggatgaatacaaaattccacctgggggactgataaaagcttcgcaatgtggcgtgaggatgaagccttcatggggacttcagccagggaaacctggtgagcaggcctaggaggaggacagcaaacacatgggggaggacactgtgtatgaggggctgacagccggagcacagccacgagtgtg

SEQ ID NO: 33643 - DNA, 601 bp, Human
gcctgggaaacaagagtgaaactctgtctcaaaaaataataataataataaataaataagaaaccaactggaaagaacataggctttgatgatttatagattttgttggtgggtttatttcatggtctctcttttgaaaaatggaacatgtctactttatatcctgtcctagtggagcacctctgagaacaaacatggaagttacaagggaaaaactgagcaggtttactttagttgcatattcaatattgaggggttccctgggagctgctcccggggaaagaggagctacactgtaatmatatgttagataaaagcggcaatgtctatgctggtgaaactgaacatatactatttgtcagcaaaatttcaaaagcacccttcatgaggatacattaaaactattcacatggattctctactagcaaccttccttctgaagatatcaaacttgatgatagctagcattatcatgatttgtcatacattcactcaatacttttactgagtccaaaactaatatgcattaaaaaacatgatccacgttcttgatcctttgtaagcctagaagttagataagcaacacaacaataacagcatc

SEQ ID NO: 33644 - DNA, 601 bp, Human
attgcccaattgcactccagcctgggaaacaagagtgaaactctgtctcaaaaaataataataataataaataaataagaaaccaactggaaagaacataggctttgatgatttatagattttgttggtgggtttatttcatggtctctcttttgaaaaatggaacatgtctactttatatcctgtcctagtggagcacctctgagaacaaacatggaagttacaagggaaaaactgagcaggtttactttagttgcatattcaatattgaggggttccctgggagctgctcccggggaargaggagctacactgtaatcatatgttagataaaagcggcaatgtctatgctggtgaaactgaacatatactatttgtcagcaaaatttcaaaagcacccttcatgaggatacattaaaactattcacatggattctctactagcaaccttccttctgaagatatcaaacttgatgatagctagcattatcatgatttgtcatacattcactcaatacttttactgagtccaaaactaatatgcattaaaaaacatgatccacgttcttgatcctttgtaagcctagaagttagataagca

SEQ ID NO: 33645 - DNA, 601 bp, Human
catatcacttcatcattctgtggtaacaatgaaatgtacaataatctgaactcttgaaaaattctatgaaatttctgtgttattaaataatgttaaaaataaacatttctattacatttaaacttataagttatatttgtatgagaccttaaaaattaaggccgggtgcagtggctcacgcctataatcccagaactttgggaggctgaggcaggtggatcacctgaggtcgggagttcgagaccagcctgaccaacatggagaaaccccgtctctaccaaaaatacaaaattagctgggygtggtggcacatgcctgtaatcccagctactcaggaggctgaggcagaagaatcgcttgaacccgggaggcggaggttgcggtgagccaagattgcccaattgcactccagcctgggaaacaagagtgaaactctgtctcaaaaaataataataataataaataaataagaaaccaactggaaagaacataggctttgatgatttatagattttgttggtgggtttatttcatggtctctcttttgaaaaatggaacatgtctactttatatcctgtcctagtggagcacctctgagaac

SEQ ID NO: 33646 - DNA, 601 bp, Human
cttgagctgctacagaatgatacagtgaagtctaagaagcagactggaaccccagggcatggtcctttcttctactctgtgtccctgccatgtggcacatggtccttgctcctgccaggccttcaaatggtcagtgatgaggacgtggatggtgcggacacatctgcttaggtttaatcttgcagtcatatctttgtaatacacaataacctgagaaaacgtgtattagcaaaggggttgccataaatgctctaagattaaatataaactagaaaccacataattaggctgactggaggaraagggctgaattttcagttattggctactcaaaaactagacaggctctgcagatgaattttcagttattggttactcaaaaactagacaggctctgcatatgaattttcagttactggttaccaaaaaactagacaggctccgcactgggctcatgttgggcttcaggtgaaagtgtacacaaatctttctgggagaggagatagcaattaacaagttctaaactgttctatgctcctaaaaaatgattaagccacaatactaatatactttttaaagataaacatagatgatgtagagg

SEQ ID NO: 33647 - DNA, 601 bp, Human
attaatatttcacaatttaataaacaaaatataaatatgtcaaatcaacatatatattgttgaattatcacttaataaaatattagtttagtaaaatgaatatattgttactatattataaataatatattaattttacttttaacagatatttaatattctaacaaaaagatcatacttatggttttctgatgtttctatgttttaagatttacataacttctagttctattttatgtctaggttatataactaattgttgaaattaacaacattgaaaaacacatgccaggtgcagtgrctcacgcctgtaatcccagcactttgggaggccaaggagggcagatcacttgaggtcaggggttggagaccagtctggccaacatggtgaaatcccatctctactaaaaatacaaaaattagctgggcgtggtggcacgtgcctataatctcagctactcaagaggctgaggcacgagaatcgctcgaacccaggaggcggaggttgcaatgagccgagatcgcaccactgtactccagcctgtgagacagagggagactctgtctcaaaaaaaaacaaaaaacaaaaaaacagttattt

SEQ ID NO: 33648 - DNA, 601 bp, Human
actgctttcaaaataaagcaatggtctacacgaggccataaagcttccagagtcataaaatagcatgggatgcaacagcatacttgactgcagctctagggtactgttctgaggtacggtggggcaaacctctacccagtgcgtggatctctatgctataaagcgtcttaaccaggagaagtaaggctgcatgaatttaaaagtctctgtagtctagaatgtcagttaatggtgttattaatcatactttaaaaataaggagtcttgtatgaaatataagtaattaaatcattttcattcyttaaagtgtttatggcattaataattccacaagttaaatttttagggcttagtaatgctaaaaagtttttaaggatactattatattatcactgaattttgggttaaaacagtagcaacacacaaatgggacctaaacaacaaagagaatgaaacatacataccaagtcatctggtgattctgcgtggagaccatcaattatgatatgatccccagcagatgtaaagttacgacgaatgtgttctggtaagagatgcttctcaatcttgttgggaaaattggttcccataagaaatgtac

SEQ ID NO: 33649 - DNA, 601 bp, Human
aactttggagaagagaggaacatgctagggtgagaagggataagcacagaaggaataaagacaagcgaggattcaggttgtgatctgcccccagtgtcccctctgtcggtgagtggaatgtctaaccagatgtacaaccagaaacccagggggcccaccacaatgcctcctcctccctctcaccctcactaagtcttgcaacttcactgccaagaccttgagtctcacgcagctccatcatcacggccaccctactcctgactcaccacctaaattacaactgtaagttaataaatgcttytgaaaaaacgtattatgtacatttatattattattgtgtaacattttctcttagacattatgaatcataaggaactcaacatagcacaaggcaagtttatgacaaacccaacgacacacttccgtaacacctcacctagcacaaaccttcctaagcagtactcttctctctgaaaaggaggcttatctgactgtgtgttttttatatgacctaacctacatttaaccttgacctcagtaaacatactgatctttcattctcttacactaattctaaccaatttgtcaaattcagcacaga

SEQ ID NO: 33650 - DNA, 601 bp, Human
gtcaagggaaacagttgtttacgaaagagtaagaagtaagattgagtgcatttagagaactttggagaagagaggaacatgctagggtgagaagggataagcacagaaggaataaagacaagcgaggattcaggttgtgatctgcccccagtgtcccctctgtcggtgagtggaatgtctaaccagatgtacaaccagaaacccagggggcccaccacaatgcctcctcctccctctcaccctcactaagtcttgcaacttcactgccaagaccttgagtctcacgcagctccatcatcayggccaccctactcctgactcaccacctaaattacaactgtaagttaataaatgcttctgaaaaaacgtattatgtacatttatattattattgtgtaacattttctcttagacattatgaatcataaggaactcaacatagcacaaggcaagtttatgacaaacccaacgacacacttccgtaacacctcacctagcacaaaccttcctaagcagtactcttctctctgaaaaggaggcttatctgactgtgtgttttttatatgacctaacctacatttaaccttgacctcagtaaaca

SEQ ID NO: 33651 - DNA, 601 bp, Human
aaacatacactaaaaacacacatttaatacataacatacatattatatctgtttaggagcttcgattatatgaaaaaaattgtaagtgttttaagggttcggggacaaaggagtccaaggaaagtgaaaaagtttaaccagcttcatgaaagaggtgggttttgagctgagcactaaaaaaacggggtaagattttaacaggcagaccaggaagaaaagctgctctccataggagagtgacacgagcaagggaacccaggccgcaatgagcgtgacacgcctgtagcttaaccgagagccytgacaggtcaagggaaacagttgtttacgaaagagtaagaagtaagattgagtgcatttagagaactttggagaagagaggaacatgctagggtgagaagggataagcacagaaggaataaagacaagcgaggattcaggttgtgatctgcccccagtgtcccctctgtcggtgagtggaatgtctaaccagatgtacaaccagaaacccagggggcccaccacaatgcctcctcctccctctcaccctcactaagtcttgcaacttcactgccaagaccttgagtctcacgcagctcca

SEQ ID NO: 33652 - DNA, 601 bp, Human
gatacttacaaaaaaagaaaaaacatacactaaaaacacacatttaatacataacatacatattatatctgtttaggagcttcgattatatgaaaaaaattgtaagtgttttaagggttcggggacaaaggagtccaaggaaagtgaaaaagtttaaccagcttcatgaaagaggtgggttttgagctgagcactaaaaaaacggggtaagattttaacaggcagaccaggaagaaaagctgctctccataggagagtgacacgagcaagggaacccaggccgcaatgagcgtgacacgcstgtagcttaaccgagagccctgacaggtcaagggaaacagttgtttacgaaagagtaagaagtaagattgagtgcatttagagaactttggagaagagaggaacatgctagggtgagaagggataagcacagaaggaataaagacaagcgaggattcaggttgtgatctgcccccagtgtcccctctgtcggtgagtggaatgtctaaccagatgtacaaccagaaacccagggggcccaccacaatgcctcctcctccctctcaccctcactaagtcttgcaacttcactgccaagacc

SEQ ID NO: 33653 - DNA, 601 bp, Human
attattattttatataaatataaaataaaaatatggtactattataatcaaactgttgacaacagcgactacagaaaaacatacttttcaccaaactgatacttacaaaaaaagaaaaaacatacactaaaaacacacatttaatacataacatacatattatatctgtttaggagcttcgattatatgaaaaaaattgtaagtgttttaagggttcggggacaaaggagtccaaggaaagtgaaaaagtttaaccagcttcatgaaagaggtgggttttgagctgagcactaaaaaaacrgggtaagattttaacaggcagaccaggaagaaaagctgctctccataggagagtgacacgagcaagggaacccaggccgcaatgagcgtgacacgcctgtagcttaaccgagagccctgacaggtcaagggaaacagttgtttacgaaagagtaagaagtaagattgagtgcatttagagaactttggagaagagaggaacatgctagggtgagaagggataagcacagaaggaataaagacaagcgaggattcaggttgtgatctgcccccagtgtcccctctgtcggtgagtggaatg

SEQ ID NO: 33654 - DNA, 601 bp, Human
tatctgacatacagtgggcaatcagtaaatatttgctgaattaataaacaaaagggggatgtagatgatataaaacatagggcattaggtctcaagcagcctgtggaaaaccataaatgtagcatatgtgtttaggcttcagttctgccacattttagcaatataacctaaccttagattccttatctgtgacatgaatacaaatacctacctcacaaagctgcagaggaaggaaatgagataacaacaggataagcactgaatgatattctaatattattattttatataaatataaaawaaaaatatggtactattataatcaaactgttgacaacagcgactacagaaaaacatacttttcaccaaactgatacttacaaaaaaagaaaaaacatacactaaaaacacacatttaatacataacatacatattatatctgtttaggagcttcgattatatgaaaaaaattgtaagtgttttaagggttcggggacaaaggagtccaaggaaagtgaaaaagtttaaccagcttcatgaaagaggtgggttttgagctgagcactaaaaaaacggggtaagattttaacaggcagacca

SEQ ID NO: 33655 - DNA, 601 bp, Human
gcagtcttctctcaggaacagcagcactgactcaccattagcactggagtcagatcatctcactcctctgccccaacccccacagtgacctgctgcacttgcatcaagtctctacttaatgccgccccttgtcagtctgttcccacctctcgccactctccttgcacacgctgcgcttcagccactctgccctcctcaaacgtggcaggcatttttctgcctcaagaccttagcacttgatagtgactctgcgtgaaacctttctcccctcaagagccacagcctcatgcttgtgtctgtsaagagcacgctcacattccacattctaagtgagccttccgacaatgctctctaaaactccaacaccagcctacatgcccacataccttatccccttccctgttcagttttctccatggcttgtattaactaataacataccacatactttatctacttatttcgttctttactgttcttcccttgctcccaagaatgtaaactgcataaggataggaattttcttctgctttgtacactgacttatttccctgaccgagaataatatctgacatacagtgggcaatcagtaaatatttgc

SEQ ID NO: 33656 - DNA, 601 bp, Human
tatattccaggtaccataccaaactgttttcaaatgaatccctatgtatgcttgtacacgttttatttcttaataaccgtgttttaacattcacccatcttattcttccagtcattttacatgtgaagaatctgcctcaattaatcttttttttttttttgagacggagtcttgctctgtcgcccaggctggagtgcagaagtcccatctcggctcactgcaacctctgcctcccagggttcaatcgattctcctgtctcagcttcctgagtagctgggattacaggcacccgccactgcrcccaattaatttttgtatttttagtagagatggggtttcaccatgttggccaggctggtcttgaactcctgacctcaagtgatctgcctgcctcagcctcccaaagtgctgagattacaggcatgagacaccacatctggcctgcctcaattagtgcccccagagaattgtcatattaagattcagtttgaaaccccccactaagtgcctcaccgcagttacctcctcattcactagccacatgaatgcccgccttagcctcagtcagcctctctgtcttccttctgctctgctgaggac

SEQ ID NO: 33657 - DNA, 601 bp, Human
tttcttgccactgtcaatacttaacaagtcctgtgtatacgaattctgaaaacactggctcatgtgccatatgaaacaacaataggaatttttggggaacaaatacattatttagtcaacaatgaaatctcattttaggattatattccaggtaccataccaaactgttttcaaatgaatccctatgtatgcttgtacacgttttatttcttaataaccgtgttttaacattcacccatcttattcttccagtcattttacatgtgaagaatctgcctcaattaatcttttttttttttttgagacggagtcttgctctgtcgcccaggctggagtgcagaagtcccatctcggctcactgcaacctctgcctcccagggttcaatcgattctcctgtctcagcttcctgagtagctgggattacaggcacccgccactgcacccaattaatttttgtatttttagtagagatggggtttcaccatgttggccaggctggtcttgaactcctgacctcaagtgatctgcctgcctcagcctcccaaagtgctgagattacaggcatgagacaccacatctggcctgcctcaattagtgccc

SEQ ID NO: 33658 - DNA, 601 bp, Human
ttaagtttcctgccctctcttcaatttaagttatctccttttgagtgaaataaaagactaaggaaataaataatggtggttaacctaaacccaaaccatgaggtttcttgccactgtcaatacttaacaagtcctgtgtatacgaattctgaaaacactggctcatgtgccatatgaaacaacaataggaatttttggggaacaaatacattatttagtcaacaatgaaatctcattttaggattatattccaggtaccataccaaactgttttcaaatgaatccctatgtatgcttgtayacgttttatttcttaataaccgtgttttaacattcacccatcttattcttccagtcattttacatgtgaagaatctgcctcaattaatcttttttttttttttgagacggagtcttgctctgtcgcccaggctggagtgcagaagtcccatctcggctcactgcaacctctgcctcccagggttcaatcgattctcctgtctcagcttcctgagtagctgggattacaggcacccgccactgcacccaattaatttttgtatttttagtagagatggggtttcaccatgttggccaggct

SEQ ID NO: 33659 - DNA, 601 bp, Human
gaaataaaatgaacatatctgttaaaattattatgtgatgatcataatctatatcccacaattcccttaaagtgatgattttcaaagggaagtagagctaccaacatataccaaacatatagtaaatgcttctaggtgatgacgatcttttaatcagaaaaaaattaaattggcatactaataatccacagcgtcagattctatcccaaaattaaaagagttaatgggaccaggtggctcatgcctgtaatcctagtactttgggaggctgagggcggggggtggatcacctgaggtcagkagttcaagaccagcaaggccaacaggctgaaaccccgtctctaccaaaaatacaaaaattagccgggcgtggtggtgcatgcctatagtcccagctacttgggaggctaaggcaggagaatagcttgaacccaggaggtagagactatagtgagcccagactgtgccactgtactccagcctgggcaagaaagtgagactccatctcaaaaaaaaaaaaaaaaagagttaatgggaggctaaagaaaaaagtacaaaatttcaaggtgtttctatctattcatatgtgtaagaaaaaaaa

SEQ ID NO: 33660 - DNA, 601 bp, Human
cattttcatccctcgtatcatctcaaaatctttcagagttctataaaacaggtttatcattacttgttaggacaaaattttaacaattacattatgaaaggactagtttgcttatgttacattccaatattcataagattagatacaattagtagtgcacacataaatcactattaatccaaattttacctaagtgtcatgagaaataacaatatataaagcagcatattactgcaatttctaccttaaaaagcatcatggtggataaatgtctcaagagtactaaagcttggaaaaactwgcaatgtcattacaaatatgcaaagcattaatcaccaactttaaatcactactttttgctatacctttaaaagagacttaacaaattaactcctagaaaggaattttatcattggctacatttaagatttctagtcatttttcccctatggaaaaactctagctggtcaataattaaataggtatttaatatttgtagaatatgacatgtatattggaattaattcctatatatacctgtaaaatgatgaagctatgcttgctctaaaatctatagctatgtagagaaagactactaaca

SEQ ID NO: 33661 - DNA, 601 bp, Human
ttcattttcatccctcgtatcatctcaaaatctttcagagttctataaaacaggtttatcattacttgttaggacaaaattttaacaattacattatgaaaggactagtttgcttatgttacattccaatattcataagattagatacaattagtagtgcacacataaatcactattaatccaaattttacctaagtgtcatgagaaataacaatatataaagcagcatattactgcaatttctaccttaaaaagcatcatggtggataaatgtctcaagagtactaaagcttggaaaaaytagcaatgtcattacaaatatgcaaagcattaatcaccaactttaaatcactactttttgctatacctttaaaagagacttaacaaattaactcctagaaaggaattttatcattggctacatttaagatttctagtcatttttcccctatggaaaaactctagctggtcaataattaaataggtatttaatatttgtagaatatgacatgtatattggaattaattcctatatatacctgtaaaatgatgaagctatgcttgctctaaaatctatagctatgtagagaaagactactaa

SEQ ID NO: 33662 - DNA, 601 bp, Human
actgcttctggtccaggaaccacactttgagaaccactggtctggattaagtataggtcctgaccagagcagcagggtgaatggtggcaccattcaccaaagcagggacttcatgaggagattgggcatttcacaaatatctgcagaataattgtatccataagctatatacaaatatctacagataacagtttaaagtcatattcacttttactgaattagcttttggcaacacattttgttttttatttttctgtttctatagtcaccaaactaaattcttacctattatctggtttcycaaataagcctacctaccaggtcaaggtgtgcagatgactgtgcagatgactaccagtagttactttgctagacacagctccttccataaattaacagactgacatgctactctacacatcgctgagtttaatgggattaatctgtttcctagtggctgtatctgggaagctagtaaacagtttgtaaatctgcaaggcccatttccctaaatcttccttatgactatggctctggcagcagcaactaagtcaagaattaataacagcatttggaaaagaatggtgtagacaaccccggc

SEQ ID NO: 33663 - DNA, 601 bp, Human
gtggagctcaccccagtttttgattcagtgggtctgaggtggggctcaagaatttgcatttctaacaggttcccatgtgatgctactgcttctggtccaggaaccacactttgagaaccactggtctggattaagtataggtcctgaccagagcagcagggtgaatggtggcaccattcaccaaagcagggacttcatgaggagattgggcatttcacaaatatctgcagaataattgtatccataagctatatacaaatatctacagataacagtttaaagtcatattcacttttactgmattagcttttggcaacacattttgttttttatttttctgtttctatagtcaccaaactaaattcttacctattatctggtttcccaaataagcctacctaccaggtcaaggtgtgcagatgactgtgcagatgactaccagtagttactttgctagacacagctccttccataaattaacagactgacatgctactctacacatcgctgagtttaatgggattaatctgtttcctagtggctgtatctgggaagctagtaaacagtttgtaaatctgcaaggcccatttccctaaatctt

SEQ ID NO: 33664 - DNA, 601 bp, Human
gctaaatacatggctaaactgtctgaatccaagacggcttcgagtggagcaaaaacaaaaggctagaaaccagttaggcaatcccagttaccatctgggtgagaataatgatcccaacccaggctatggcaatgggcacaggagaagacacaagagttcacagggagggagaatctgcaggacctaacaaatgattatgggggaggggagtgtgcagtgcctggggtgcttgttgaaacacagattgtggagctcaccccagtttttgattcagtgggtctgaggtggggctcaagaattkgcatttctaacaggttcccatgtgatgctactgcttctggtccaggaaccacactttgagaaccactggtctggattaagtataggtcctgaccagagcagcagggtgaatggtggcaccattcaccaaagcagggacttcatgaggagattgggcatttcacaaatatctgcagaataattgtatccataagctatatacaaatatctacagataacagtttaaagtcatattcacttttactgaattagcttttggcaacacattttgttttttatttttctgtttctatagtcacca

SEQ ID NO: 33665 - DNA, 601 bp, Human
gcatccttccctattacattcctgtcccctgaacagtacctggcccagggtagtcactcagtaaatatttgttgaaagaatcaacagtacctcccaaagaagactgctgaatgtacttaaactattaagtagaatatctggcattgagtaagggctcaacaaatgttggctactctccttattaccattatcctttaacatttcagtttaggcataatctcctccaataacaaggtgttatttcccatattccatggtaatacttatatcatgggatgcatgacaacctaagatacttgtmggcttattttctttctcctcatgagtgcctgaagggcagggactgcgtccatggaaccctagccccacagtgttctggtcctggcacacattttctctaacagatgattatttgctatctgctagatgcagacagagtgcaggctgtaatcagacaaaaacaagaggatgatagcctaggcagtagaagggcaagtgactcaacaatcagaggacagtatgtcatgtctacattgtgccatgtaaaacacagcccacaagaagagtatttaaatcacagcggaaggttaggaaatgttct

SEQ ID NO: 33666 - DNA, 601 bp, Human
atattactatctatcccctctccaagagacatagcttataggagagactcaatcactactctccatcttgccttctttgttctttcagaatttaatgattccatcaaagagaaccccgattttgtgctttaaaattacctgcaagtatatatttattgttcatcaaacatctgttaagcacctacttggtgccaggaactcttcaagacactgaggatacagaagtgaatgcaactgacaacagtgctggaccccggtggagtgcacattctgcagttctggggaaacccttcatcacccrcattttgtcctctcagtctcctcttataaatttttctttttattatatctcagcattttatcaatctctatcttttttggaagtttgtaatacagatagtgaagtaaatcaatgcagtgatgaacgtcctcccaccctgactctcctttcaatcccaccaccacacctactctccactcacaagacgtggccgagagacaatgagactgtttacatttcttaaaatatagtgaagaaagcagtgtggtaagcatgctagcaaaaatcaaacaacaaaacaatacaaagccttagtgacac

SEQ ID NO: 33667 - DNA, 601 bp, Human
atgtggtttgtctgctcgctgaaaaaaatcacagtaaatgtaccccaacaatccttcagattcatgaacaacagcctagaaaaaaaaatttaaatttggtggtaaatgaggccatctgattctctaaaatccctaacacaagaatctgtatattaaacatccatagccacacatatagacattttaattacattctacaccccacattatctcgagatagattctcttttccccgcatcctcttctgctccatctcttgaatgattttggttttggaattctgtgtccaggacaggaaatmctcctcatgagggccttttgtcctgactgcctatcctctacaatacctttactaaccacccacaagagctgggaagaagtgctggctggacaattttaggagcaaattatttttccttcaaatcctggaatgtcgtgatatacgcccaagcaaattataacccttgaatttgaaaacaccacaatgcagctcccagcttgagttaaaaatcagcaatattactatctatcccctctccaagagacatagcttataggagagactcaatcactactctccatcttgccttctttgttcttt

SEQ ID NO: 33668 - DNA, 601 bp, Human
ccacaggacacggtaaaatgatcacattttccaaataaaaagcccctttcccaattcaaagaaaatgtatgtttgtaaaggactgtagtaaataaaagccctcctcatggctcaccagtgacgtgttggtaacgagtacgtcctagcattgaatgcatggcatgtcccatttcatggaaaagattttccatcatgccaggagttagcaaagttggagaactccttgaggaacggggaagattcagcataagaactacaactgggagttgatagtctccatcttcctttagtctgcctccayggatagtgaaatggcaatcctttaagaatcagaaaacataaaaggaaaagaaagtatttggtaatgtgaagagtaaaacagtcttaatgaatataaaatttcaccaaaaatgtgtgagtgcaaactttaacttaattatattcttattctatctatttacatatatacaccttttcttgacattttttattctgctaaaattttaattttttaaaacatcaagaacacattcagtttctatggattaactcattactttggtcccaaaacatgcattgaaatgatgctgtgccagaagct

SEQ ID NO: 33669 - DNA, 601 bp, Human
tcttcagctatgctggctatacatgaaacagattaaaacatttctaatattaatatagcgtttgtatttaattcactaaattccattacctaatacttttatccttcctttgttttacaagtactttattttatccatttattgctttttgtaacaaagtcaattctcagtgaggaaaagaaatattttaaactcaaaattacttaaagtaacaaatcctgtaagaaatttagatgacatttaacgattgtgttcagcccacctacagtcttttcaataccttctccttgtccaaaatacygtgtgtaaagttagttaacaaatgctggatgccaacaattcactagtggtctaatgctgaccatatgtgatagggagcttaagacttaaggataagacaatgaagaaggaagtctgtaatatcacaaaatatagccacatagcagcataaaaactacaaagcagaactatgattttatacaggggaaagtatatgaaaaattaaaaggacttcatcatactttttaagcatgctttattttcttctctgattttgaatataaagagagaccattcattcacttacttattaactctgtgg

SEQ ID NO: 33670 - DNA, 601 bp, Human
gtgatttagaagttgtgtaaattttctaagctttcattttttcccaactgaaaacgggaaatagtctttttttttttttgagacagagtctcactctgttgcccaggctggagtcagtggcaagatctcggctcacttcaacctccacctcccaggttcaagagattctcctgcctcagcctcctgagtagctgggattataagcatgcaccaccatgcctggctaatttttgtatttttagtagagatggggtttcaccgtgttggttaagctggtctcaaactcctgacctcgtgattygcccacctcggcctcccaaagtgctgggattacaggtgtgagccactgtgcctggccaggaaataattttattcaacgcctacttcataagggcagtgtgaggactaaatgagtcaattttggtcaagttctttgaactcagatgaaagatgttttagaagcataattattataataaataggtatcattggcaagaatgtaaagttatatatttatttgggataatgactccggaaaacttcagaacaaaggtacatacatacctgaagttgcatatcagctgcagcacaaaccttttt

SEQ ID NO: 33671 - DNA, 601 bp, Human
tggtcttcatctcaaaacctgggaagttggttttgaatattatctaaaactaacagcaattactatctaaacttcaaacctaaaaacacaaaaattttaaaaagatacaaaatgaataaacatatgtatatataaaattaagtttgagccttaatttagctggcaaaatgtgtgatttagaagttgtgtaaattttctaagctttcattttttcccaactgaaaacgggaaatagtctttttttttttttgagacagagtctcactctgttgcccaggctggagtcagtggcaagatctcrgctcacttcaacctccacctcccaggttcaagagattctcctgcctcagcctcctgagtagctgggattataagcatgcaccaccatgcctggctaatttttgtatttttagtagagatggggtttcaccgtgttggttaagctggtctcaaactcctgacctcgtgattcgcccacctcggcctcccaaagtgctgggattacaggtgtgagccactgtgcctggccaggaaataattttattcaacgcctacttcataagggcagtgtgaggactaaatgagtcaattttggtcaagt

SEQ ID NO: 33672 - DNA, 601 bp, Human
tgtttaaggtgtttacataactctcaagatctgaagaggagtgagaattccataacaatctcagtcattacaaacatctacgcatctgatgtcatgcagacctggcatccagatggttcatgaaagttttctggtcttcatctcaaaacctgggaagttggttttgaatattatctaaaactaacagcaattactatctaaacttcaaacctaaaaacacaaaaattttaaaaagatacaaaatgaataaacatatgtatatataaaattaagtttgagccttaatttagctggcaaaatrtgtgatttagaagttgtgtaaattttctaagctttcattttttcccaactgaaaacgggaaatagtctttttttttttttgagacagagtctcactctgttgcccaggctggagtcagtggcaagatctcggctcacttcaacctccacctcccaggttcaagagattctcctgcctcagcctcctgagtagctgggattataagcatgcaccaccatgcctggctaatttttgtatttttagtagagatggggtttcaccgtgttggttaagctggtctcaaactcctgacctcgtgat

SEQ ID NO: 33673 - DNA, 601 bp, Human
ttgcctctctctgtctctagggggctattgtttttggagggcggaggagggaaaggttggttttccattttaaaagaaaattatcagaacactttttcaagaagaaagccacaaaacagacttttaaaagccaggccttctactaaagatatcagcaaatcaagacttttgccaagtaatgttaatttttaaaaataactcagaaatcctttaaaaattatattgatatgaatagatactgagtaaggtaaagcaaatatagattcacggttttgtctatataatagatttccttcactgmaacatgtatttcatgtttgaaggtacagaaaaacagagcacatttattaccttctagggactgaattttacaaaactataaagcaattaaatagtgattactttgttaaacaggtaactgaatcatcataaagtgaatactgcctaagatgaaagatgggtgtttaaggtgtttacataactctcaagatctgaagaggagtgagaattccataacaatctcagtcattacaaacatctacgcatctgatgtcatgcagacctggcatccagatggttcatgaaagttttctggtcttca

SEQ ID NO: 33674 - DNA, 601 bp, Human
acagagtaaattatcaggaactgaaactcttacattctaacctcaactgaggtgttattttgccccaatgtataaataaatcagaattcaagagtttcatttcttcaattatgccttttacaaaatgatataaacatggggtaacttttttgaattataaaaacagagcaaaataaattaaatatgaaaacagagcaaaataaattaaatgtgcattctttttatgcttatttgctgataaactaaacaattccaaagacatgagcctatctgcctacccagggagtcatgcattcctggsgccaagaaacttattaagtcacagaaaaatgaagagcctatttttaaaacaataattttaaaaaatgtacagttttaaaaacagtgttttttttttgttttttttttgagacagagtctcgccctgtcgcccaggctggagtgcagtggcgcgatctcggctcactgcaagctccgcctcccgggttcacgccattctcctgcctcagcctcccgagtagctgggactataggcgcctgccaccacgcctggctaatttttttgtatttttagtagagttggggtttcactgtgttagcc

SEQ ID NO: 33675 - DNA, 601 bp, Human
agcagctgctgtatagggagggctcaactagatgaccaggggaaaaggagcactctcctctgagtagaggatataggccactgaaacacagtgggagaagaaagcattaaagaaagtttggacatgaaatctgctgtttacaaagtactgaaaactaaattttgcaaagaaatctaaaataaacataaagcattttttcactgcaacatctgactcaaatattgtttttcaacactgacttgaacatttgacttcatgcaggcaagtagaaaatgctttattttaaaggacaaattttgayatgcaattatgcttctgatatgtatctttgtgattcagaaatgggatttgtagagaatgtgcagctgttgacttgaaagaagtgaggattagtttggttaaaagagaaaatttaaatgacctctggcttctggctgcatctagatatagaattatggttctaaattataaagttaagtttaaaccttccctagaaaaatacagacatttcctaaatataaatattgctttcttctaactggtaatctaaacatatagctaaatatagctctttcaattctacattttataatgagtaacg

SEQ ID NO: 33676 - DNA, 601 bp, Human
aaagaaatagcaatgcagcatctcgtgagtatagatgtatcgaagaattctgatgcagctgttggagaggttggaactagactcccacacctggtgtcaggaagtacaaaggaagcagctgctgtatagggagggctcaactagatgaccaggggaaaaggagcactctcctctgagtagaggatataggccactgaaacacagtgggagaagaaagcattaaagaaagtttggacatgaaatctgctgtttacaaagtactgaaaactaaattttgcaaagaaatctaaaataaacatamagcattttttcactgcaacatctgactcaaatattgtttttcaacactgacttgaacatttgacttcatgcaggcaagtagaaaatgctttattttaaaggacaaattttgacatgcaattatgcttctgatatgtatctttgtgattcagaaatgggatttgtagagaatgtgcagctgttgacttgaaagaagtgaggattagtttggttaaaagagaaaatttaaatgacctctggcttctggctgcatctagatatagaattatggttctaaattataaagttaagtttaaacctt

SEQ ID NO: 33677 - DNA, 601 bp, Human
ggatctcctgtacctctccacccaatggaagtttaaccactacctggcctttagaaagagattgggaaagcaggactactgatcctaggcacccctacttcctcccgacaatgctcccagcctctccagtgccttgttttgcctccattctgtggaaaggggtgggcatcccgtatcacgtggtgaggtcagaaaagccaagaaaacccacaggagcagcaggggctgcttcaggtagcacaggagccctcatacaagggttccctcagacaccacacagccacctctacacagtggctgyagggtagggggatgtccagggccaccggtcagctgcgggaagcaggagcaagcttgggtgggaatggccaagtggggcgaggctgtgtggggagcctgccactttctgccaggtttggctgtgttatgtgggctgcagttctcgagcccgacttccagatgtaatagagtggggaattactgtggtccaagatggggacattttagaacttacccccttacctgttgaaaggatcctgtagaaaacactccttccaaaccatggaggcgaccgctctggacatgaggtaagagtaatatc

SEQ ID NO: 33678 - DNA, 601 bp, Human
gacagcacaggattccccacacccccaagacagcacgggacgggatcccccacacccccctagacagcacaggatcccctgcatcccccagccacagcatagaatccctcacaccctccaggaagcaagggatctcctgtacctctccacccaatggaagtttaaccactacctggcctttagaaagagattgggaaagcaggactactgatcctaggcacccctacttcctcccgacaatgctcccagcctctccagtgccttgttttgcctccattctgtggaaaggggtgggcatccygtatcacgtggtgaggtcagaaaagccaagaaaacccacaggagcagcaggggctgcttcaggtagcacaggagccctcatacaagggttccctcagacaccacacagccacctctacacagtggctgcagggtagggggatgtccagggccaccggtcagctgcgggaagcaggagcaagcttgggtgggaatggccaagtggggcgaggctgtgtggggagcctgccactttctgccaggtttggctgtgttatgtgggctgcagttctcgagcccgacttccagatgtaatagagtg

SEQ ID NO: 33679 - DNA, 601 bp, Human
aatagcactcatcagccaaagttccctgaaaagaatttggagatgtagttatttgtgtggtgagaagataaatgctataaacaactctgacaccagattataattactggttttctttcaaagaaagagccttctaaggaatcataggacccaaacttgacaacgtcttggttcctattgttatagggattcctgttaggaggatcaggaggccaaatcagggagcaaagggaagatctcctacatctctccagccagcatgggatcctctgcacctccccagacagcacgggaaccctcrcacccttcacccagcacaggacccccacgcacctctccagacagcacgggataccccacccccaccagacagcacaggatcccccgcaacccctcagccagcacaagatccccatacctccccagacagcacaggattccccacacccccaagacagcacgggacgggatcccccacacccccctagacagcacaggatcccctgcatcccccagccacagcatagaatccctcacaccctccaggaagcaagggatctcctgtacctctccacccaatggaagtttaaccactacctgg

SEQ ID NO: 33680 - DNA, 601 bp, Human
ataaaaatagttttgtgattattttaaatgaggcttgaaattataccattaagaaataatttgtgatggcacctaataaagaagagaaaaagaacactctaaaacaagagtgaaggaagagaagctggcaggaaaaggttaattacaccagaaaaccttggttcaggataacagttaacggatcagcaaactccactggagtgtgcgggtgataaaggcacagtggaggctgccttgttcccgtcttctggtactctgtgtcacctggatatgcctacctgacggagttccacaaggaacrctgttaatgacaatatgtgaaggcaggtttggaataatttttgtagacataaatcctccaaactaatgggacctggaaacaagttatttagtactactcttttgtattttatgaaaaatgcaattcctttaacatacatgactacatactatgatgagacaggttaaataaattttgatattgtttccatttgagaagctctggagcctctttacatgtgggtcattttgtgaacatggtctttaatcagactttttgatagcattacagtatcaaaaacatgctgacatcaaacactag

SEQ ID NO: 33681 - DNA, 601 bp, Human
cctcaggaccctcaactctgacatagaggaacagggaggaggaaaatgccctcaggagcttggccaacaggaaagcactggaccaataaaggagtcccctttacctctgatagcaaaatacgacctcctcaaacccagggacactctctatggtgtctgggaatttggcatcccaaggcacagaacccgggcgtcccttaccagcggcacaggagcagttggggtccattgcaacccgaggcgagactagagttcccaagcgagaagggaagaggcagtgggtgcacgtggaaggcggagwggagcccaacagccagcggctgcttttatagtcaggagacggggccgggcgcagacgccccgccccgcccttgcacccagcccgctgagtccgcaccgcccgcggtcccggcctgggctgtgcgcaggagatgggccaagtgcaaggtcccttgagcgcagctgggcgcacaccgcaggacggcccctttcgcaccggctcgcgagggaggcgctgtgccccccgtgtgcggcttctctcaccctgccaggccttcccagcttccctgaggttgcctgctacacccgccccttggcgttc

SEQ ID NO: 33682 - DNA, 601 bp, Human
caactggtggacattggaatgggtcttcctttgagaaagctgccccacctcacataagccctggaaagtgcagaagactagacaggcagtgacaacctacagggacaaaggaaggccggttccccagaagcacgcactcagggacagccttgggttccctcccaaccttagccacagccccagattcctggagatggccccgcactcactcttcttgcaggaggtgcatttgcactctttgcacttgcaggagctggcgcaggtgcaggagacacctgctagaagagaaaaagccagtgarcggtgagtgagatgcagaaggtacagcagtgggtcaatgagtgtccacttcccccttctctgtgcagagccagccctcagagctcctttcccactcagagcagaggaagagaagccccatgtcctctccattcatgctgggaaaaccaagcaccctcctatttctactccaaaggaaagtcccaggctgcagacatggcccaggaagacttcgactttctgtcctgaacctggaagaggcaatgtcccctcctatccaatgtctcctatccaatccggtagctcagagtcaggttagaga

SEQ ID NO: 33683 - DNA, 601 bp, Human
ggcatggtttttgtcaggagacaactggtggacattggaatgggtcttcctttgagaaagctgccccacctcacataagccctggaaagtgcagaagactagacaggcagtgacaacctacagggacaaaggaaggccggttccccagaagcacgcactcagggacagccttgggttccctcccaaccttagccacagccccagattcctggagatggccccgcactcactcttcttgcaggaggtgcatttgcactctttgcacttgcaggagctggcgcaggtgcaggagacacctgcwagaagagaaaaagccagtgaacggtgagtgagatgcagaaggtacagcagtgggtcaatgagtgtccacttcccccttctctgtgcagagccagccctcagagctcctttcccactcagagcagaggaagagaagccccatgtcctctccattcatgctgggaaaaccaagcaccctcctatttctactccaaaggaaagtcccaggctgcagacatggcccaggaagacttcgactttctgtcctgaacctggaagaggcaatgtcccctcctatccaatgtctcctatccaatccggt

SEQ ID NO: 33684 - DNA, 601 bp, Human
cattttatcatcgggggtcagctcatcttcctctgcctcaaagtagatgatgttgttgtctggactgtgttcccccatggttcagttgtgctcagcccagttgtgagaaatgaaaacgtaatgacttgtctgcaacagaacaaagccagagttagagtcataccacaagaccgacggacctcctcagcaaccacaaggctcattttccctctcacttaaagagcaagccaaagcaaatgaaaaaccatccttgggaataatttttttattttaactttaaaaccatcaagtcatttttaawgaaaagcaatgccgactgggcgtggtggctcacacctgtaatcccaacactttgggaggctaagatgggaggatcgcttgaggccaggagtttgagatcagcctggtcaacatagtgagacccccatctctaataaaaaaaaaaaaaaaaagaaaaagaaagaaaagcaatgcttttcaaaaactgaataagttcataagaccttctgaatacgcctgtcaaacaatttgaaacttggtcaaaatatttaaaggggacaaaagagcaaacagaacagcagctgctgaaaggctgagttgc

SEQ ID NO: 33685 - DNA, 601 bp, Human
gattatgggagcccacaaccacgcctggctaatttttgtatttttagtacaacggggtttcaccaggttggccaggctggtctcgaactcctgacctcaggtgatccgcctgcctcggcctcccaaagtgctgggataacaggcatgagccactgcgcctggcctccctttgtcataaagttctacagagcctccccatgccagcttaatgtgcttcaggatcaagtgcgtaagaattctatacccataacatattagtatccaacatattttgccccaaaagaaacgcagagaatagcayagtggtatgagtgtgactctggagacagacttcctgggattcaaatcctgaccccacatcctgcttggatggggaaacttaagctagttatagaacccctctgtgcttccatttacttatcagctattgtggggactagcacttggaatcatgcctagcacacagtgagtatttttaagtgttagctactgttatttctattactttatactcaatactgaagactattaagtctcctgatacaaacgtgaaaaagagaattggctactgaataggccactccccatttctcaggataga

SEQ ID NO: 33686 - DNA, 601 bp, Human
acctttccctaatagaggtaagtaagtatttttaagagagtttgggtaacagttgttaaaagttcaataaattacacattaatcatctcagtcctcaaactcaatgctgagcaaagcattgggaatgcctactgctgggaagtttaaagagtagatttgtttctcacaggttgtttttttttagagtgtctctgtattggtttcatctcttaaggttgaatacctgaggtccgcctctgaaagaaacccaaacattctaggtaaggctgagctaattatgctcacctgaatatatacaggrtctatatctctgtatatccacctagctctacaggtctcaatggaaaattgatagttacaggcttgatgaaacaaaaattggcctaaactcaccagtatgtgtacgaacgtgagttttaaggtggtggcttgctgcaaatgcttttccacagccatcgtgatcgcacctaaatttgttaaggaaagagaaacaggagtcattagctaatagatctttatcctgaacgtcttttttttttttgagatcgagtctcgctctgtccccaaggctggagtgcagtggcgcaatcttggctcactg

SEQ ID NO: 33687 - DNA, 601 bp, Human
ataaagtcatttcactggattaagaaatctacctttccctaatagaggtaagtaagtatttttaagagagtttgggtaacagttgttaaaagttcaataaattacacattaatcatctcagtcctcaaactcaatgctgagcaaagcattgggaatgcctactgctgggaagtttaaagagtagatttgtttctcacaggttgtttttttttagagtgtctctgtattggtttcatctcttaaggttgaatacctgaggtccgcctctgaaagaaacccaaacattctaggtaaggctgarctaattatgctcacctgaatatatacaggatctatatctctgtatatccacctagctctacaggtctcaatggaaaattgatagttacaggcttgatgaaacaaaaattggcctaaactcaccagtatgtgtacgaacgtgagttttaaggtggtggcttgctgcaaatgcttttccacagccatcgtgatcgcacctaaatttgttaaggaaagagaaacaggagtcattagctaatagatctttatcctgaacgtcttttttttttttgagatcgagtctcgctctgtccccaaggct

SEQ ID NO: 33688 - DNA, 601 bp, Human
gctgaggcaggagaatcacttgaacctgggcggcagaggttgcagggagccaagatcacgccactgcactccagcctgggcgacaagagtgagactctgtctcaaaaaaaaaaaaataataataataataaagagttttaacattatcttatgactaaggctccaaagtaacaaacctataataatgtgaaattaatactatctgtatacctggtctcatcatttacagtgatttcacaggacctcatttgccattcatataaatcttggaagtattactctatatccccattttttattytttttgtaacaaattgccacaaacttatattcccattttaaatatcagaaaactgatgctcagacagtaggaatcaagtgcccccaaacacacagctaattagcagaagacaaatccagtgcttctgactgaaaagtcaatggtccttccaccactgtgtttcccacatgggcactgaaaggctccttactcagagtggtactggggatttagaattcaaattccactgcccagactaagtgaactctggagtcccagaatgccagtcacaattcacactttaggtggtagccctgctta

SEQ ID NO: 33689 - DNA, 601 bp, Human
cggtggtgtgtgcctgtaatcccagctactcgggaggctgaggcaggagaatcacttgaacctgggcggcagaggttgcagggagccaagatcacgccactgcactccagcctgggcgacaagagtgagactctgtctcaaaaaaaaaaaaataataataataataaagagttttaacattatcttatgactaaggctccaaagtaacaaacctataataatgtgaaattaatactatctgtatacctggtctcatcatttacagtgatttcacaggacctcatttgccattcatataaaycttggaagtattactctatatccccattttttattctttttgtaacaaattgccacaaacttatattcccattttaaatatcagaaaactgatgctcagacagtaggaatcaagtgcccccaaacacacagctaattagcagaagacaaatccagtgcttctgactgaaaagtcaatggtccttccaccactgtgtttcccacatgggcactgaaaggctccttactcagagtggtactggggatttagaattcaaattccactgcccagactaagtgaactctggagtcccagaatgcc

SEQ ID NO: 33690 - DNA, 601 bp, Human
ttagacaaagtgagtgatttgtatcctgtgaaagagaaaaaattctaattgagtaacaaaaatcaggatttacagtggcatatcatgtaacaaaacatttgattacaaagtccctaatgttccacatgtctacatgtattatctgaagaagtataagccaaccaaagcaagggctaaatgaattaattttttttaaattatactttatgttctagggtacatgtgcacaatgtgcaggtttgttacattatgtatacatgtactatgctggcgcgctgcacccattaactcatcatttacrttaagtatatctcctaatgctatccctcccctgccccaccccgtgaattagttaatttttaaaaatcctgatattcttacaagaatatcttacatttcttaaaaatgattaataaagagttttagaggctgagagtggtggctcacgcctgtaatcccagcaatttgggagtctgaggcaggtgggtcacaaggtcaggaattcgagaccagcctggccaacatagtgaaaccccatctctactaaaaatacaaaaaattagctaggcgcggtggtgtgtgcctgtaatcccagctactc

SEQ ID NO: 33691 - DNA, 601 bp, Human
gtacacttaccgtactggaattttctcgcaattcagaatctgtggacagaaggctcaagtcacttagacaaagtgagtgatttgtatcctgtgaaagagaaaaaattctaattgagtaacaaaaatcaggatttacagtggcatatcatgtaacaaaacatttgattacaaagtccctaatgttccacatgtctacatgtattatctgaagaagtataagccaaccaaagcaagggctaaatgaattaattttttttaaattatactttatgttctagggtacatgtgcacaatgtgcagrtttgttacattatgtatacatgtactatgctggcgcgctgcacccattaactcatcatttacattaagtatatctcctaatgctatccctcccctgccccaccccgtgaattagttaatttttaaaaatcctgatattcttacaagaatatcttacatttcttaaaaatgattaataaagagttttagaggctgagagtggtggctcacgcctgtaatcccagcaatttgggagtctgaggcaggtgggtcacaaggtcaggaattcgagaccagcctggccaacatagtgaaaccccat

SEQ ID NO: 33692 - DNA, 601 bp, Human
tgcttgctattggttgctcaccagtgcctttccacagttgttttttatattttgtctagaatttttagctgttttctgcgggagagttggtctcataagagcaactctgccactaccagaaggagaattaggccttgtcgtgcttacataaaaatgcaggttcagatgccacggtcagacaagctgactcagcaggcttggggggaggcccaagaacctacaacttcagaagtgctgtaattgactccactaaccactctttcacagcattcctgaatcattcagtctctgttcaaatacwtcccatcatatttattcattatgcacataatcacagaaaatctagcctatgctatatttatttaccaggaaaaacgacaacaaaaaacccaaactcaaaattagtgttagcaatactataaaactctcatgttcaacatggaggaggctgcataagctcagactcaatgcattggtttgtaagttgcatcatggagccatgggaatggcagtcaaatttcctaacagcttgaatcaaagcaatcagattaagataaagtgggcttgtcctttagcagatagaggcctgtatatgtgtaag

SEQ ID NO: 33693 - DNA, 601 bp, Human
aggaggtggagcttgtagtgaggcgagatcgcgctactgcactccagcctgggcgacagagcgagactctgtctcaaaaaaaaaaaaagaaaaaagaaaaattaatcctattgcttcaaggaattgtggccttagtttgaaaggctaaaatcaatttccacatctgagataaacactgggtaccaggagcatgatctataattaaaccccaagggatagtgcttctctctcttgattatataaattgtgataggaaaggcttccctttttcataagtacttggtgtccccttatgccaggrtattttcctggtgaccctagggctccagaaagctcgttagtcatatgtcatagtcttggccagagaatagactcctaagctatttaacacagttacacgttaaagggatattattcctagaaatcttaggctgggtagctttgagggcatctagaccacccagtgcagaaatttcttttagaacattagttgtaaaataggaatatgcataaaagtcatgtgatgtacccatttaatctttttctctttgctctttagtttgattcatttctattattgatcttcaactcaactgattct

SEQ ID NO: 33694 - DNA, 601 bp, Human
gtgatgattcatcaagctgtacatttataatacatgtgcttttctgtatgtatattgtacctcaataaaaagcttgttaaaatttaaaaaaaggaaaatgctgaagcccctgccaagcttcagggcaaaaacgctgggagcaaagtgggtaggaacaactttcacaagtagagaagacaagaacaggctgagctttccaggcctggagcaaggagcaaagagcaaagggcaaagaagaggagaatacaggtagctgtctgggaccaggatggatcctggagctgagcagccaaaaggcttygagaaggccattccctagcaccttcaactctcctctaacaaaagatctgagcaaaccaaagttcatttctaggatatgcatacatatggctgctgagaaacccataaaatcattatctcatataaatttactatttgattttaacaagtcctgattctctcttttttttctttttttttttgagacagggtcttgctctgttgcccaggctggaatgcagtggtgtgatcatggctcactccagggctcaaacaatccttttgcctcagcctcccagatagctgggacaacaccagctaa

SEQ ID NO: 33695 - DNA, 601 bp, Human
gccaccatgcccagcccctcaaacacttaaaacaggaattggcacactatgacttgccagttgatttcctgtttttgtaaataaagttttattggaacacgggcacatgcatccatttatatattatctgtgctacttttgctacaatggcagagttgactagttgtgacagagaccatggaatcaacaaagcctaaaatatttactgtctggctcattaccaaaaaaaaccttgctgacttctgatctaaaagaccaaatcttacattaaaaaatgagattacaggccaggtgtggtggyttatgcctgtaatcccagcactttgggaggctggggcgggcagatcacctgaggtaaggagtttgagaccagcctggaaaacatggtaaaaccccgtttctactaaaaatacaaaaattagctgggcatggtggcaggcgcctgtaatcccagctacttgggaggctgaggcagtagaattgcttgaacctgggaggcggaggttgcagtgagccaagatcgcaccactgcactccagcgtgggcgacagagcaagactccgtaaacaacaacaaaaaaattatataatattcattaccc

SEQ ID NO: 33696 - DNA, 601 bp, Human
cccatctgggtgacaaaatgagacgctgtctcaaaaaaaaaaaatgtagaagaaaaatctcacagctcctccccattttggtggttttacagccaacagaagattctgggaaaggagattctcttcttcaggactgagggaagtaggggaaaagatggaattaaactgaaagacccaaactttctgaccctttatagaaagctcacttcatttacgctaactagaatgattcattgtgcctgtgactcagtgtgtcagcaagtgcttagatgtgagtagaaagagtccgtgtgacaaaccygtctgttgaggatcttcctgaattgccgtatcatctgaattctggaacattgattcaaagatgattgctggtgaaattgtgctgaggtcctggccctgggtctgatggagagagacaaagatgtgagattggccatcttgagacaattcttcaccatgagaaaacacattcaaagcagcagaactagaatgaaaatcttttgatatgcattttgtttctaccttctgctatttaaagtaacatgtattttcttaagccttagacactaaagatttgggtcctcaaatactttatttttat

SEQ ID NO: 33697 - DNA, 601 bp, Human
gagaaactaggggtggggaaagggtttatggaaactctctgtaccatctgttcaataaagtccaaaaaaaagtaatctaaaaataatgtacgtaggtaataactgacacattgcagatcctcaattttaaaaaatatgtagcacaataagtccttacacatagtaaggactcaatgaataatagctgttgatgttttttaaattaccattattagtatttaatatttaacctactggtaatattaactttctttttggcatttttagcctctttaactagaatatatgtttttataaaaaataaatcatgttttttctcttttctgtatcctccagatactcagtatagtgtctggcaaatattaggctttcaaagttgtgagattggccaccctgagacaattcttcacgatgaagcattaactgaatgaccaagtcatttccctagtcatcaagaccaagtacttcctcagaaaatgattctatgatgggctgtgggagcacaagttagctctctgacttggccactgctgtccggtgccatctgactgggtcacatcagtccctcacatcagtctgactctgccttgaaaacaacctt

SEQ ID NO: 33698 - DNA, 601 bp, Human
aaaggccaggtgtggtggctcacgcctgtaatcccagcactatgggaggccgaggcgggcagatcacgaggtcaggagatcgagaccatcctggctaatacggtgaaaccccatctctactaaaaatacaaaaattagacgggtgtggtggcgggtgcctgtaatcccagctactcgggaggctgaggcaagagaatggtgtgaacctgggaggcggaggttgcagtgagccgagatcgcaccactgcactccagcctggacaacagagtgagactccgtgtcaaaacaaaaaaaaaaaaatgaagaggaagagaggcccgagctaggatgttcaacccctcgccatgtgatgccctgtgctgcctcaggactctgcagagggtccacaccaggagggcggccctccagatgtggcctctcaacttcggacttctcagcctccataaatgtaagaaataaatgtattttctttatcaattacccagtttggggtattctgttataagcaacagaaaatggactaagacaataaccaaaaacctcttcaaaggcctctgtgaggatgaaatgagatgatgcacgtaggacacttggcacatg

SEQ ID NO: 33699 - DNA, 601 bp, Human
cagtgagccgagatcgcgccactgcactccagcctaggtgacagagcgagactccatctcaaaaaaaaaggccaggtgtggtggctcacgcctgtaatcccagcactatgggaggccgaggcgggcagatcacgaggtcaggagatcgagaccatcctggctaatacggtgaaaccccatctctactaaaaatacaaaaattagacgggtgtggtggcgggtgcctgtaatcccagctactcgggaggctgaggcaagagaatggtgtgaacctgggaggcggaggttgcagtgagccgasatcgcaccactgcactccagcctggacaacagagtgagactccgtgtcaaaacaaaaaaaaaaaaatgaagaggaagagaggcccgagctaggatgttcaacccctcgccatgtgatgccctgtgctgcctcaggactctgcagagggtccacaccaggagggcggccctccagatgtggcctctcaacttcggacttctcagcctccataaatgtaagaaataaatgtattttctttatcaattacccagtttggggtattctgttataagcaacagaaaatggactaagacaataacc

SEQ ID NO: 33700 - DNA, 601 bp, Human
ctttttttccccctcagagattaagctgcatgccaaggacaggttaaggcttcctctcacaggtagacagccctgtaaaggccttgtgctgtaaggtgcacagcatagttcaagggtgggccctggattcagccacacttggattcaagtccaagctctgccacttattagttgttggtgttgggcatgtgatttaacttcttaagagtcttgtttccccacctgtaaaaacaggaataataactactatggatggagtatctgtcccctccaaaactcatgttgaaagttaatccccagtgtggcagtattgagaggctgggtttttaagaggtgactgggtcatgaatgaattaattcactcatggattaatgagttatcatgggagtgggactggtggctttataagaagagtaagagaaggagggtgtggtggtacatgcctatagtcccagctatttggaagactgaaggaggatcacctgagcccaggagttcaaggccagcccagcctggaacatagtgaaattctctctcttaaaaaaggccaggcgcagtggctcacgcctgtaatcccagcactttgggaagccgaggcgg

SEQ ID NO: 33701 - DNA, 601 bp, Human
taggccgggcgtggtggctcatgcctataatcccagcactttgggaggccaaggtgggcagatcacttgatgtcaggagtttgagaccagcctggccaacatggtgaaaccttgtctctactaaaaatacaaaaattagctgggcatagtgttgaatgcctgtaatcccagctacttgggagactgagacatgagaatcacttgaacctaggaggcaggggttgcagtgagccgggattgcgccactgcagtccagcctgggcaacagaacgtgactccatctcaaaaaaaaaaaaaaaaagaaagaaaaaaaagaaaattagccaggcatggtggtggagcatgcctatggtcccagctacttggggggctgaggcaagaggattgcctgaactcaggaggcccaggctgcagtgagctgtgatcgtgccaccatactgcagcctgggtgacagtgagaccttgtctcaaaaacaaaacaaaacaaaggccagtgggcaggagaacagggtgggaacggggaggcctgacaactagtgctttggttccaccacagattcacttacaaccttgggggagtcaattaatttttctgggtccc

SEQ ID NO: 33702 - DNA, 601 bp, Human
aaatcacatgactaagctgagcaagtcacatccttgtttgcactgtatgaggctgtatgcaaaatccagaggggggcagagatggagggggcaacccaaagcctggctggaacctggaaccaggacacctggcctgccaattacatgccacctcatatgaattcccttaaatctgcaccttcttctgataagcaaaatgcagcccttctgctctgaggaagaaaataccattaaaaagaaggcagaccaccaaacagcactggccataagccacaagttcactctaggacaaaacagcgaygttccccaaggaaaattcactgcgatctgcaagccctggcaaccaaccgagagaaagaaccaggaaggcaaggacagtgatcatgttgctagagcctgctttgcacacacgtcatcaacagacagcagtcaacaagctgcctagggcctctgcagagccagatcaaccccacagcctgtgagccaggccttaagctgcctatttgtgctgaagcgggctgcagaacgacccgtgttatccaccctgagcaccaccaacactaagcacaaatgacaacaccatctcacctgaaccctgtcc

SEQ ID NO: 33703 - DNA, 601 bp, Human
tcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacrctgccctgcgtctgcggaacctgcgggaaggccttctctaggccctggctgctacaaggccatgtccggacccacactggtacgtgcccctccaggcgcccccaccgttgctctctctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcct

SEQ ID NO: 33704 - DNA, 601 bp, Human
acttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggtacgtgcccctccaggcgcccccaccgttgctctytctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcctgtttctcagccaaatgggtcggagctggatatgggaaaggtgcaaccaacaccttgctgtgggggccaggtgtgaaggggcccacccggccacaccctctcccgggtccgccccc

SEQ ID NO: 33705 - DNA, 601 bp, Human
tctatctttcagatgggcatgagaacagcttttggggtttctatacaggctaaatgcaggaatgcatatgggaagcacctggcaaagtgccggtacctgctaaactctcacaaaaatggttccttggcatttgctctgcttccttgctgtgtgactttgggcaagcaacttaacctctctgagccttaggggaaaactatgatagcatatgttttagagagtggctgtaaaggtggctaatcactttatagtaatttattatacccgaacggttctcaggtcggcttccccacccccactsaatcctagcacacagaccaggaaacggcatctttggggcagaaaacacaatcacgtcttttgaaaatttactaaatgtgtaaaaaactttctggacatggagaaaaggtagaactttttagaacttgaatggtggcagccactgtgcctggagctgctctttggagagtgacagttgagggagaagattccacagggttcaagctggccaggttctgccatttcctggcctggcgcctgacctctgagcggtgagggttagtgaggtgtctgggaggactggcaattcgcgggctttatt

SEQ ID NO: 33706 - DNA, 601 bp, Human
agaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccrtggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacccccccccacaaggaaccctcaggccaccctccacgaggtgtgactaactatgcaataatccacccccaggtgcagccccagggcctgcggaggcggtggcagactagagtctga

SEQ ID NO: 33707 - DNA, 601 bp, Human
catctttctttaattgaatcactgtgtcagctttctgtctctagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccarcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttggggaaggatca

SEQ ID NO: 33708 - DNA, 601 bp, Human
gtacatgcaaaatgtcctgattaatgattattaaaggaaagaccatttctcttttccccaaacccaacctctttgtcacttcagacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaaggtgagatcttgccttcagcctccactggggacagtgagaaggtttcagktgttcattttattattcatcttccgtgtgtgtgtgtgtgtaattgcactcatgagtaggcagtacttaataacagtttgggtttgtttgtttgtttgtttgtttgaaagataagtgttcaaatgagaccaaaatcatgcaaaataggattttcaacattcttgtatcatattaacgaattatttattagtttgggagaagtaagcagagtagcatttaggggagagaaagagggttttaaaaatgtatttggctgggtgcggtgtctcacgcctctaatccgcacttcgggaggccgagg

SEQ ID NO: 33709 - DNA, 601 bp, Human
gaccatttctcttttccccaaacccaacctctttgtcacttcagacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaaggtgagatcttgccttcagcctccactggggacagtgagaaggtttcagttgttcattttattattcatcttccgtgtgtgtgtgtgtgtaattgcactcatgagtaggcagtacttaataacagtttgggtttgtttgtttgtttgtttgtttgaaagataagtgttcaaatgagaccaaaatcatgcaaaataggattttcaacattcttgtatcatattaacgaattatttattagtttgggagaagtaagcagagtagcatttaggggagagaaagagggttttaaaaatgtatttggctgggtgcggtgtctcacgcctctaatccgcacttcgggaggccgaggcaggtgttttgcttgagctcaggagttcaagaccaacctg

SEQ ID NO: 33710 - DNA, 601 bp, Human
gtttgggtttgtttgtttgtttgtttgtttgaaagataagtgttcaaatgagaccaaaatcatgcaaaataggattttcaacattcttgtatcatattaacgaattatttattagtttgggagaagtaagcagagtagcatttaggggagagaaagagggttttaaaaatgtatttggctgggtgcggtgtctcacgcctctaatccgcacttcgggaggccgaggcaggtgttttgcttgagctcaggagttcaagaccaacctgggtaacatggcaaaaccttgtctctacaaaaaaawatacaaaaattagccaggcatggtaacttgcacctgtagtcccagatacttgggaggctgaggcaggaggatggcttgagccagggaggtcaaagctgcaatgagtcatgttcatatcactgcactccaacctgagtgacacagcgagaccctctctcaaaaaaaaaaaagcatttgagcaaatgtaattaactcagacatggtattcagattttgtttaataaaagcaaacaaacgtaaattaaaaaaaaaaaaaaacaagctcataaggtcaccaatccaaaagccagctatgtaggc

SEQ ID NO: 33711 - DNA, 601 bp, Human
aggttgcccaggtcagaggcccagatctgtcactattggctgagttgcctagcatttctggacctcaattttttttctctgtaaaatggggataataatgtcaactatttcataaagttgttatgagttcacatttacaaagcactcacaccgaacctggcacaaagctaatactatgtatgtttgttgaataaaagtaaattaaaatatcatcagcctatgcccaggaatgaaaaagaaagtaaaataaatatcaaacagaatttccacttagatgggattgcaataggaacaccaaagrgacccagagtagcaatcaaaacacacgtaacacatttttccactactctcttcatgttaaattttctctgtgtttttaaggcaagaaaaaaatcattgtccaacagaggaaaaaatcagatattaccaattttgcttaccctttcttgtgaccaaaaaaagtatgattcaggccgggtgcagtggctcaagcctgtaatcccagcactttggaaggcagaggaggaaggatcacttgaggtcagaagttcgagaccagactggccaacatggtgaaaccccatctctactaaaaatacaa

SEQ ID NO: 33712 - DNA, 601 bp, Human
gatccttcattatgtaatgccttagcgaaagagtaatttaattgctctggggtctaagtaggaccaaataagaacaaaagatcagtgaaagcaaatctaaatctatgcactaatttaaaatttcaccaggctttcacaccacctgtcacaatgtgaaggacccagtgaagccacacgcataaccatattccttgctcattttatcagagtggcatgacaataaagtatcacgctaggtcaggacatctagaacattgtgtaaccctagttatacaatgaggaaaaatgcaagcactaagcrtcaggaaattcacccggaaatggggaagactgccatcaaattaggtactctgtggtcaaggaggatctgtaagtctcttgtggtagatttgcataaaattatgtctggagatgtgagggtgatctggctgtaacatatgtcaccccattagtcaccagggctaattcagctgatctggctgtctaggcaattgtacctcttgaagctgcactctcagtggaagaggacggctttccctgatgaaggaggagggtttttaggtcaagtgtatgtgagtagctgcactcccctactagaacc

SEQ ID NO: 33713 - DNA, 601 bp, Human
gtcattatgcagcacatgactctacttaaaagtgagaaaataaaatttacttctctgtgactaactaatgacatttacatctttttggacttgatagataatttctattcttatttttgatgggttcaaaggcacaaaaggtaaaattttaacagtgagaaatgacacaatatagtgacattaccttccaactgaacctataattgggaaatcaatatttgaagcttaagtacgacatgttttttggtgtttgtttgtttgtttgcttaaggtagggtcagccggggacagtggctcacayctgtagtcccagtactttgggaggctaaggctggcagatcacttgagtccaggagtttgagacaagcctgggcaacatggcaaaaccccatctctacaaaaaatacaaaaattagccaggcttggtggcatgtgcctgtggtctcagctacttgggagactaaggtgggaggatcacttgagctggggaggtggagggtgcagtgagccaagattgcgccactgcactccagcctgggtgacagagcaagaccctgtcttggaaaaaaaaagaaaaaagagtgggggggcagtcttgctc

SEQ ID NO: 33714 - DNA, 601 bp, Human
gcacaaaagaggaaagatgaggaatatcacgggtgaggtgacctgtagtcccagctacttggaattctgaggtgggaggaccacttgaggccaagagttcaaggccacagtgtgctatagtcatgcctttgaacagccactgaactctaacctgggcaatatagcgagatttcatctcaaaaaaaaaaaaaaaaaaaaaaaaaaaaaacataaagagaaaatgttaaaacttccagagcataataaataatccaataaagaaggcaaaatggaataacaaaaataatcaatccaagacaawgcagaaaaaaaaagaaaaggggcaataaacagatgagaaaagtagcaaataaagggcaagatgggagatttaaactcactaatatcaataattgcagtatatataaatggtctaagcaccccaattaaaaggcatagattatcagaatggatataaaccaagtcccactatacattatacacaagaaatccatcttaaataaaaagtcaccaacaggttaaaagcaaaagtctttcaaaaagcaaaaggatagaaaaagatatattaggctaacactagtaaaaataaagctgcagtcgc

SEQ ID NO: 33715 - DNA, 601 bp, Human
agccactgaactctaacctgggcaatatagcgagatttcatctcaaaaaaaaaaaaaaaaaaaaaaaaaaaaaacataaagagaaaatgttaaaacttccagagcataataaataatccaataaagaaggcaaaatggaataacaaaaataatcaatccaagacaaagcagaaaaaaaaagaaaaggggcaataaacagatgagaaaagtagcaaataaagggcaagatgggagatttaaactcactaatatcaataattgcagtatatataaatggtctaagcaccccaattaaaaggcrtagattatcagaatggatataaaccaagtcccactatacattatacacaagaaatccatcttaaataaaaagtcaccaacaggttaaaagcaaaagtctttcaaaaagcaaaaggatagaaaaagatatattaggctaacactagtaaaaataaagctgcagtcgctattttaatatcaacaaatacttcagagcaatgagtattacatgggataaagaagattattatataatgataaaggagtcaatcctaaacatctatgcccctaataacagagcttcaaaatacatgaagcatca

SEQ ID NO: 33716 - DNA, 601 bp, Human
tacttcagagcaatgagtattacatgggataaagaagattattatataatgataaaggagtcaatcctaaacatctatgcccctaataacagagcttcaaaatacatgaagcatcatctaagagaaccgaacagagaaagagaaaaatccacatttatagtcagagattctttttttttttttttttttttttgaggcggagtctcgctctgccgcccaggctggagtgcagtggcgcgatctcagctcactgcaagctccacctcccaggttcacgccattctcttgcctcagcctcccragtagctgggactataggtgcccgccaccacgcctggctaattttttgtacttttagtagagacggggtttcactgtgttagccaggatggtcttgatctcctgaccttgtgatccaccctcctccgcctctcaaagtgctgagattataggcatgagccaacgcgcccggcctatagtcagagattctattaaaatgatatcatactaaaatgataagtatacagaaagagctataggatataggagatttaaacattatcaaccttcttaacctgacatttatagaacacttcaccaa

SEQ ID NO: 33717 - DNA, 601 bp, Human
gagattctttttttttttttttttttttttgaggcggagtctcgctctgccgcccaggctggagtgcagtggcgcgatctcagctcactgcaagctccacctcccaggttcacgccattctcttgcctcagcctcccgagtagctgggactataggtgcccgccaccacgcctggctaattttttgtacttttagtagagacggggtttcactgtgttagccaggatggtcttgatctcctgaccttgtgatccaccctcctccgcctctcaaagtgctgagattataggcatgagccaaygcgcccggcctatagtcagagattctattaaaatgatatcatactaaaatgataagtatacagaaagagctataggatataggagatttaaacattatcaaccttcttaacctgacatttatagaacacttcaccaaaatataagagtgttttctcttccctccctccctccctccctccctcccttccttccttccttccttccttccttccacgagtctcgctctgtagcccaggctggagtgcagtggcgcaatctcagctcactgcaacctccgcctctcgggttcaatcgattct

SEQ ID NO: 33718 - DNA, 601 bp, Human
ttttttgtacttttagtagagacggggtttcactgtgttagccaggatggtcttgatctcctgaccttgtgatccaccctcctccgcctctcaaagtgctgagattataggcatgagccaacgcgcccggcctatagtcagagattctattaaaatgatatcatactaaaatgataagtatacagaaagagctataggatataggagatttaaacattatcaaccttcttaacctgacatttatagaacacttcaccaaaatataagagtgttttctcttccctccctccctccctccctycctcccttccttccttccttccttccttccttccacgagtctcgctctgtagcccaggctggagtgcagtggcgcaatctcagctcactgcaacctccgcctctcgggttcaatcgattctcctgcctcagcctcctgagtagctgggattagaggctcacgccaccatgcccagctaatttttgtatttttagtagacatggggtttcaccatgttggtcaggctggtctcgaactcctgacctcgtgatcaacatgccttggcctttcaaagtgctgggattacagatgtgagccacc

SEQ ID NO: 33719 - DNA, 601 bp, Human
ttgtacttttagtagagacggggtttcactgtgttagccaggatggtcttgatctcctgaccttgtgatccaccctcctccgcctctcaaagtgctgagattataggcatgagccaacgcgcccggcctatagtcagagattctattaaaatgatatcatactaaaatgataagtatacagaaagagctataggatataggagatttaaacattatcaaccttcttaacctgacatttatagaacacttcaccaaaatataagagtgttttctcttccctccctccctccctccctccctyccttccttccttccttccttccttccttccacgagtctcgctctgtagcccaggctggagtgcagtggcgcaatctcagctcactgcaacctccgcctctcgggttcaatcgattctcctgcctcagcctcctgagtagctgggattagaggctcacgccaccatgcccagctaatttttgtatttttagtagacatggggtttcaccatgttggtcaggctggtctcgaactcctgacctcgtgatcaacatgccttggcctttcaaagtgctgggattacagatgtgagccaccgcgc

SEQ ID NO: 33720 - DNA, 601 bp, Human
tataggcatgagccaacgcgcccggcctatagtcagagattctattaaaatgatatcatactaaaatgataagtatacagaaagagctataggatataggagatttaaacattatcaaccttcttaacctgacatttatagaacacttcaccaaaatataagagtgttttctcttccctccctccctccctccctccctcccttccttccttccttccttccttccttccacgagtctcgctctgtagcccaggctggagtgcagtggcgcaatctcagctcactgcaacctccgcctctygggttcaatcgattctcctgcctcagcctcctgagtagctgggattagaggctcacgccaccatgcccagctaatttttgtatttttagtagacatggggtttcaccatgttggtcaggctggtctcgaactcctgacctcgtgatcaacatgccttggcctttcaaagtgctgggattacagatgtgagccaccgcgcccggcaacataggccatttttcgagccataacataaatctcaataattcttcaagtattttaattatgcaaggtatgttgtctgatcaaacaggaggcaca

SEQ ID NO: 33721 - DNA, 601 bp, Human
agcctgggcaacatggcaaaaccctgtctctactaaaaacacaaaaattagccaggcatagtggcgcccatctataatcccagctacttgaaaggctgcagcatgagaatcacttgaacctgagaggcggaggttgcagtgagccgagatcccaccactgcactccagcctgggtgacagagtgagattctgtctcaaaaaaataaaataaaatttatatggaagtacaaataacctataatagccacaacaactttttgaaaaagagcaatagccaagcacagtggctcatacctataatcccagcactttgagaggctgagtggggagaattacttgagcctaggagttcaagaccagcatggggaacactgagaccccgtctctacaaaaacatcaaacaattagtcgtgcatgggagttgcatgtgcctgtggtcccagctactcaggaggctgaggtaggaggatcacttgacctggtaggttgaggctgcagtgagctataccactgcaacccagcctcagtgacagagcaagactccatctcaaaaataaaaagcaataagtttggagggcttatactaatttcaagaattatt

SEQ ID NO: 33722 - DNA, 601 bp, Human
ttgtactacaactggcccataccagcttgcaagaacccgttgtgcaaacctcttcctaactccacattcagtgatgtcgggttgttagcttgaatagcccggtgtgaatagttacatcacagacattctcaaatactacaaactggggagcttttttcttcctggatagctggttgttaaacatttatcagtattccactggaggtgttcatgatcttgattgtaatgatgattttacaggtgtatgcacacattaaaattcctcaaaatgtacacttcaaaaatgtgtagtttattgtayatcagttataactcaccaaactagaaggcaaaaataatgcatgataaaaagttgcacatctacacatgctcagaaattttgccacataaagactcacactggaaatcattaggtccgattgatgtactaagtgaaaggaacaaaaatctaacagatgctccaaaaaaaatgcataaagcaaaagtgatcaaattaaacttaaagtgtgtattatctataaaaatattaagatcaaataataaaaggaaaatgaacccataatacgctacaattaaagtttatatatatactattagcatc

SEQ ID NO: 33723 - DNA, 601 bp, Human
gcatcacagatgttgagggtagataaataccgtgtgaacatgctaagttattgtctttattagaaaacttcttaaaagtaataaagagttaagaagaaacaggataagtgggataaattgaaataaatcaagatggtagaaacagttcaaatatatgtatggttgcaataaatgtagataaaataaactcacctagacagagattgacaatttaaaaggaggcacctaagcaaaaagacatgtgaaagttaaaactttacaggtaaaaaaaaacacacactcaccaaataccggaaaaagytggtattactatattaatatcatataacacagacttaaaaattaaaagcattattagggataaaaagagttgtgcgtgaagatgaaagattgaatttaccaaaaagatatactaattttaagcacatatatatcaaataaagtatcttcaaaatatataaaacaaaaaattgacagaatacaggaggacattggctcatgcctataatcccagcactttgggaggccaaggtaggaggatcacttgaggccaggagtttgaaatcaacctgggcaacataatgagacccccctcatctcc

SEQ ID NO: 33724 - DNA, 601 bp, Human
taataaagagttaagaagaaacaggataagtgggataaattgaaataaatcaagatggtagaaacagttcaaatatatgtatggttgcaataaatgtagataaaataaactcacctagacagagattgacaatttaaaaggaggcacctaagcaaaaagacatgtgaaagttaaaactttacaggtaaaaaaaaacacacactcaccaaataccggaaaaagttggtattactatattaatatcatataacacagacttaaaaattaaaagcattattagggataaaaagagttgtgcgtraagatgaaagattgaatttaccaaaaagatatactaattttaagcacatatatatcaaataaagtatcttcaaaatatataaaacaaaaaattgacagaatacaggaggacattggctcatgcctataatcccagcactttgggaggccaaggtaggaggatcacttgaggccaggagtttgaaatcaacctgggcaacataatgagacccccctcatctccaaaaaatattttaaaaacaaaatttagccagtgtggttgcagatgcttgtagtccagctactcaagaggctaaagagg

SEQ ID NO: 33725 - DNA, 601 bp, Human
atgtttataaaaattgccagccaggcgcagtggctcatgcctataataccagcactttgggacactgaggcaggtggatcacctgaggtcaggagttcgagaccagcctaaccaacatggtgaaactccatctctactaaaaatataaaactagccgggcgtggtggtgcatgcctgtaatcccagctacttgggaggcttgaacctgcgagacagagtttgcagtgagccgagatcgtgccatcgcactctagcctgggcaacaagagcaaaactccatctcggaaaaaaaaaaaaaaaagtgcccaggtactatgccataaaaaaagtacccaaaaatttcaagaagtaggatcattttaaaaaattgtttttaattgagatagggtctcactctgttgctcaggctggagtgcagtgacacagttataactcactgcagcctcaatttccccagctcaagtggatcctcctacttcagcctcctaagtaactgggactacaggcatgcaccaccatgcctagttaattcttgatttttattagagatgaagtctcactctgttgcccaggctggtcttgaactcctgacctcaagtga

SEQ ID NO: 33726 - DNA, 601 bp, Human
caggcagctggagctcatcctgaacaagccaggactcaaacacaagccagtcagcaaccaggtacagcctaatagcttccactagggtgtggggagtgggggcaggatttacatgacacaaagaagcctcagctgggagtcaggaaggctcatgattgctccacctaaatctcatcatgggaccctgtgcaagtctttagacttctttctattggtgtcactttaaaaaacggacttggggcctggtgcggtggctcacgcctgtaatcccagcactttgggaggccgaggcaggcgatcrcgaggtcgggagtttgagaccagcctgaccaacatggtgaaaccccgtctgtactaaaaatacaaaaattagctgggcttggtggcacatgcctgtaatcctagctactcagggctgaggcaggggaattgcttaaacccgggaggtggaggttgcagtgagccgagattgcgccactgcactccagcctgggcgacagagtgtgacttcgtctaacaacaacaacaacaacaaaaaaaaatctaatgaaaatcaatgaaaaaaaatgagaaaaaacactaaggctcaacagaaaaagga

SEQ ID NO: 33727 - DNA, 601 bp, Human
ttggggcctggtgcggtggctcacgcctgtaatcccagcactttgggaggccgaggcaggcgatcacgaggtcgggagtttgagaccagcctgaccaacatggtgaaaccccgtctgtactaaaaatacaaaaattagctgggcttggtggcacatgcctgtaatcctagctactcagggctgaggcaggggaattgcttaaacccgggaggtggaggttgcagtgagccgagattgcgccactgcactccagcctgggcgacagagtgtgacttcgtctaacaacaacaacaacaacaamaaaaaatctaatgaaaatcaatgaaaaaaaatgagaaaaaacactaaggctcaacagaaaaaggagtaaaaggaatgaacagaaattcacgaaagacaaattgcaagactggtacacatgaaaaaaaactcactattaattagagaaacttaaattgaagtgtgatttttctattgcacatcaaattagcaaagtttttgtcttattaatatttttaaatataatgcccccgtgtaggcaagtgattaaatgctagtgagtgcaaattggttcagccttactaaaaaaacaatttgtcaa

SEQ ID NO: 33728 - DNA, 601 bp, Human
gggcctggtgcggtggctcacgcctgtaatcccagcactttgggaggccgaggcaggcgatcacgaggtcgggagtttgagaccagcctgaccaacatggtgaaaccccgtctgtactaaaaatacaaaaattagctgggcttggtggcacatgcctgtaatcctagctactcagggctgaggcaggggaattgcttaaacccgggaggtggaggttgcagtgagccgagattgcgccactgcactccagcctgggcgacagagtgtgacttcgtctaacaacaacaacaacaacaaaaamaaatctaatgaaaatcaatgaaaaaaaatgagaaaaaacactaaggctcaacagaaaaaggagtaaaaggaatgaacagaaattcacgaaagacaaattgcaagactggtacacatgaaaaaaaactcactattaattagagaaacttaaattgaagtgtgatttttctattgcacatcaaattagcaaagtttttgtcttattaatatttttaaatataatgcccccgtgtaggcaagtgattaaatgctagtgagtgcaaattggttcagccttactaaaaaaacaatttgtcaatat

SEQ ID NO: 33729 - DNA, 601 bp, Human
gattgcgccactgcactccagcctgggcgacagagtgtgacttcgtctaacaacaacaacaacaacaaaaaaaaatctaatgaaaatcaatgaaaaaaaatgagaaaaaacactaaggctcaacagaaaaaggagtaaaaggaatgaacagaaattcacgaaagacaaattgcaagactggtacacatgaaaaaaaactcactattaattagagaaacttaaattgaagtgtgatttttctattgcacatcaaattagcaaagtttttgtcttattaatatttttaaatataatgcccccrtgtaggcaagtgattaaatgctagtgagtgcaaattggttcagccttactaaaaaaacaatttgtcaatatgtatcaagggccttaaaaaatgttcacagtcctttatttctgcaatctatgctaataaaaaaatatcagaatgcctagatagactgatgtgtgtttactacaacattgttcataatggaaaaaaatggaaacaacataatacaaaaaattaaggggatgattaaataagttacaagacattcatattatgtgaaatcttaacaaaagatgttcttgaatccattttaag

SEQ ID NO: 33730 - DNA, 601 bp, Human
ttatgcaaactaattatgatgcatgttttgatatttttaagggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtaagagaattgcttttggagatgtgaaaagatgggtatgtttgctatttttgcttttatagaatgtgttcagcttaataggaaacctgtaacrctctcatattttattttataccagccccttgacccatgtagcccatatctaggtttaattttcattcaatttgagacaattgctagtacttcagagattgctttgctacttgtacactatccagatctcttatattttctctttccttatctactttttattttttgttttaaattttttttttgtttgtttagagatagggtcttgctatattgcccaggctagtctggaactcctgtcttcaagcgatccttccaccttgacctcccaaagttctgggattacaggcgtgagccactg

SEQ ID NO: 33731 - DNA, 601 bp, Human
gtcttgctatattgcccaggctagtctggaactcctgtcttcaagcgatccttccaccttgacctcccaaagttctgggattacaggcgtgagccactgtacccagcctcttcccttatctattgacccttgacactacctactcacttctctaccagcacaacagaaattgagtgaataaaatttggaattcataatagtcaactttccaccttcttaatggctctggtaaaagttgaggacaaatttgaaaattattgaagaggaccatttagacttcatgaatgctaattgcctttayttccctctataagtaatctatgacttacgttgtaacttccaagtgaagaaagaactagacaaaggggtaattcatttattccgctactactaaagactaaactgctaggtaaacacaaccatagaaaagtgccatacaaaattaattaattacccattagctaatttacatttcaaaagtaaattgcctgtttagccctactcataattaaagataaataaaaagtaagatactagttgtcccttcatatcagaaaataatcaaaatacttggtaatatttggggaaacaggcgctttga

SEQ ID NO: 33732 - DNA, 601 bp, Human
gcagtcttaccctatagatgtatttgcacatatatacatgggtgcacacacacagacagatgtttattatagaattctttgtaattttttaaaaactcaaaacaatcttcaacaggattttataaaacaagctatgacatatttgtacactgaaatatcatatagccatttaaaaaatacaagtactgacataggaagatagccacaatattagacaattacatcttcagagcttttttgctacatgatagaatgcaactcaaactttagcaaaaaataaaagataatttattggcttgcrtaactggaaagtccatgagtagatcagaaatggctagacacaggtactcaaatgatttataaagagatttagtcctctctctctctccctcctttctctccacccacatggtggcacagacaattcctaacagctccaggataatcaattactcatactcagtgaagagtgaagatgatcagaaacaaagtcttctatcagggtctctatcaatccctgattagctcctgaaggtcaccctcatattacccactgtggccactgagtaggataccctgaccccagggctatatccctatt

SEQ ID NO: 33733 - DNA, 601 bp, Human
tcagggtctctatcaatccctgattagctcctgaaggtcaccctcatattacccactgtggccactgagtaggataccctgaccccagggctatatccctattcctgtgctgaagaagttaacagacagctccactagaagggggaaggaaagttcgtaaaaagaaaaaaggcgaaaagatgctgaatagttacatcaactcctgacaataacatttgccaaaatgcctcatcctaaaaagtggttgacactcttttccacaatcttagaaagagatcaactgcattactaatgtgtaggytcattgaagattaaaacacattttgatggactttttgaggactgaaaattttgctgttcaaaaattataggagtgttacaagtgacctttgcgatggaaagcatttggactttatagcatctagcaaatcgcaattttgtaccagagaaaatgccactctccttgaaattttcattgtaactaattatgttatattccatatgtttccatagccttgataataaaagaatggaactcagaggtcacatattccaagaaaaaaacggatacagatttagaaggaaaatgagaatgaaaatc

SEQ ID NO: 33734 - DNA, 601 bp, Human
aggataccctgaccccagggctatatccctattcctgtgctgaagaagttaacagacagctccactagaagggggaaggaaagttcgtaaaaagaaaaaaggcgaaaagatgctgaatagttacatcaactcctgacaataacatttgccaaaatgcctcatcctaaaaagtggttgacactcttttccacaatcttagaaagagatcaactgcattactaatgtgtaggctcattgaagattaaaacacattttgatggactttttgaggactgaaaattttgctgttcaaaaattatargagtgttacaagtgacctttgcgatggaaagcatttggactttatagcatctagcaaatcgcaattttgtaccagagaaaatgccactctccttgaaattttcattgtaactaattatgttatattccatatgtttccatagccttgataataaaagaatggaactcagaggtcacatattccaagaaaaaaacggatacagatttagaaggaaaatgagaatgaaaatcacagccaattctcactctttagggaatagactcacccaataaccatgaattttgctgggtatgaaagcaa

SEQ ID NO: 33735 - DNA, 601 bp, Human
cctttgcgatggaaagcatttggactttatagcatctagcaaatcgcaattttgtaccagagaaaatgccactctccttgaaattttcattgtaactaattatgttatattccatatgtttccatagccttgataataaaagaatggaactcagaggtcacatattccaagaaaaaaacggatacagatttagaaggaaaatgagaatgaaaatcacagccaattctcactctttagggaatagactcacccaataaccatgaattttgctgggtatgaaagcaaggagcaacaaaataawaaattatgctctcttagaatgaaggtaaaataaactgttagaaatattttaaaagaatggcaaagatcaataaagcataaagaataaagggaaaaataaatattttgatgaaaaaagaaaagcaaaagaaaataaaaactatgtagtaaaaagttaagactgggcacagtggttcacacctgtaatcccagcactttgggaggccgaggcaggaagattgcttgagaccaggagtttgagagcagcctgggcaacaaagcgagatcccattgctttaaaattaaaaaaagttaagttaaa

SEQ ID NO: 33736 - DNA, 601 bp, Human
aattaaaggtaaacatgaagaaagctaatacggagccaggatattttaaaagttaaaattttaaaaaaaagaaattataccaggtgtggtccagctttgttgccatcatccactggcctccattctttgaagatgttatctctgggctcactttcactttctccaacactcttcctctcataattcttagtgaattcaacatccacaccagtcgttctccacccttatccgacagctctttgacttcctctcccataagaatcttgtcctatatatttcagccactaattcccatgcctakcccttggaaattgcaataacaacttcctaataaatcctccatagcctcaatttcaaacatccccctctctttcctacactagcaattgttcctctctactgtgtaactcccaccaacattcacatatgtagtaacctcctatcttaaaaaataaaatccaacctagactcactttcctctccaagtattatccacttctctcttctgtttcaaacatctggaaagagaagttgttctcgctgcttcccattcccttcccccactatctcttgaagccattcaaaccaaacttttaccctg

SEQ ID NO: 33737 - DNA, 601 bp, Human
ccatggctaaatgaataaagtcaggttgcatattgtgatagaactatcactggggtcactaagatattatgtgaataaaggaaagttgtagaatcataaagatatggtccaattactgcattttcctcttaatgtgtgtagtatttgggaggaatatctgggaagggaaataagaatggggtgatgagtgacaagattttcattatttattccatatgggtctatgtacttctacagtgtttcatttctttgcaaagagcgtatatttatgtactacttatataattaaaatctattaatwattaaatatattaaaagttaaaggatagaaagataaaataataaagagaagataggttatatacagataatccaaatgttaaaaataaaaggaagtgaaaaaatatatataaatgttaataagggacaatcataaaaccagaatataaataaagtataaaatctaagaaaaataaaacaatggaaatgtaattagaataaaaaggtagaagagacataaaaaatgagagaaaggatttcaacatagcaaattaaaagttaaaaacaaagcaaattaaaagtttttttaaaaagcaaattt

SEQ ID NO: 33738 - DNA, 601 bp, Human
aaaatctattaataattaaatatattaaaagttaaaggatagaaagataaaataataaagagaagataggttatatacagataatccaaatgttaaaaataaaaggaagtgaaaaaatatatataaatgttaataagggacaatcataaaaccagaatataaataaagtataaaatctaagaaaaataaaacaatggaaatgtaattagaataaaaaggtagaagagacataaaaaatgagagaaaggatttcaacatagcaaattaaaagttaaaaacaaagcaaattaaaagttttttwaaaaagcaaatttaggccaggcgtggtgaggctcatgcctgtaattgcagcactttgggaggctgaggtgggaggatcgcttgagttcaggagtttgagaccagcctgggcagcatggtgaaaccccatctctacaaaaattgaaaaattagccaggcatggcaaaacatgtctgtagtcccagctacttgggaaactgaggcatgagactagcttgaacccaggaggtggaggttgcagtgagccaagatgataccacagcactccagcctgggtgacagagtaagaccctgtctcaaa

SEQ ID NO: 33739 - DNA, 601 bp, Human
tgggtagccccccaacaccagcctgactcctcttagacatttgcagagatattcatacatctttggaaggctcccaccggtggccccactttctgatcccaagcttgaccttcaaaaatgttctattatttccgttatttcagatctttgacttttctctcactgaagaagaaatgaaggacattgaagccttgaataaaaatgtccgctttgtagaattgctcatgtaagttccggggatcattaatgggtattgaccagtggtattgaatggtcatgtgtcaagcaacaaggctcatawgaaccctgacctatgtccatagcaccagggcaaagcatggtgggccgcatattctgaatgttaacatgcctgagggaaatacatccactacagggccttccacaaccctacactctcactgaaaagaagagtcctggcatctgtgacattttgtgacttcggtgaaggcatgcaggctaaggaacctgaggagaattaattcatcatgtacatatgctaaaacaacagcagcacaaatgttgaaacaacttatttatttattcctaaaaatgaaagtgatgcacaaattagagcaaagtt

SEQ ID NO: 33740 - DNA, 601 bp, Human
attttagtttccagctctacctattagctgacttcctacaagcaaaattccatatactccttcaaaatgtcaagttcagctaaccaactgaagtagctctttattctctaaatattacaggccctttaaaaaagaatatagttttggccaggcgtggtggctcacgccaatactttgggaggctaaggtgggcggatcaccttaggtcgggagttagagatcagcctggccaacatggagaaaccccgtctctactaaaaatacaaaaattagctgggtgtagtggcagttgcctgtaatyccagctactcaggaggctgaggcaggagaattgcctgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaa

SEQ ID NO: 33741 - DNA, 601 bp, Human
ctacaagcaaaattccatatactccttcaaaatgtcaagttcagctaaccaactgaagtagctctttattctctaaatattacaggccctttaaaaaagaatatagttttggccaggcgtggtggctcacgccaatactttgggaggctaaggtgggcggatcaccttaggtcgggagttagagatcagcctggccaacatggagaaaccccgtctctactaaaaatacaaaaattagctgggtgtagtggcagttgcctgtaattccagctactcaggaggctgaggcaggagaattgcytgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaacattcagaaaatgctaagatgattcatatagtttg

SEQ ID NO: 33742 - DNA, 601 bp, Human
ttcagctaaccaactgaagtagctctttattctctaaatattacaggccctttaaaaaagaatatagttttggccaggcgtggtggctcacgccaatactttgggaggctaaggtgggcggatcaccttaggtcgggagttagagatcagcctggccaacatggagaaaccccgtctctactaaaaatacaaaaattagctgggtgtagtggcagttgcctgtaattccagctactcaggaggctgaggcaggagaattgcctgaacccaggaggcagaggttgcagtgagccgagatcaygccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaacattcagaaaatgctaagatgattcatatagtttggacacttactttactgatcctactgtttttcatgggtca

SEQ ID NO: 33743 - DNA, 601 bp, Human
atagttttggccaggcgtggtggctcacgccaatactttgggaggctaaggtgggcggatcaccttaggtcgggagttagagatcagcctggccaacatggagaaaccccgtctctactaaaaatacaaaaattagctgggtgtagtggcagttgcctgtaattccagctactcaggaggctgaggcaggagaattgcctgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaacattcagaaaatgctaagatgattcatatagtttggacacttactttactgatcctactgtttttcatgggtcagaaagtacagtgactggattaatattgaatttctgaattaataaaacaacttcctaatggaaa

SEQ ID NO: 33744 - DNA, 601 bp, Human
tcaccttaggtcgggagttagagatcagcctggccaacatggagaaaccccgtctctactaaaaatacaaaaattagctgggtgtagtggcagttgcctgtaattccagctactcaggaggctgaggcaggagaattgcctgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaacattcagaaaatgctaagatgattcatatagtttggacacttactttactgatcctactgtttttcatgggtcagaaagtacagtgactggattaatattgaatttctgaattaataaaacaacttcctaatggaaatttttcagggggaaaattgtttgacatcaaaaggcaccaccacccaacctcaagaacaa

SEQ ID NO: 33745 - DNA, 601 bp, Human
agtggcagttgcctgtaattccagctactcaggaggctgaggcaggagaattgcctgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcrtcttgaatctttaagtgaacattcagaaaatgctaagatgattcatatagtttggacacttactttactgatcctactgtttttcatgggtcagaaagtacagtgactggattaatattgaatttctgaattaataaaacaacttcctaatggaaatttttcagggggaaaattgtttgacatcaaaaggcaccaccacccaacctcaagaacaaaagagtaaacataaacacataaataacactttcctagaactaacagttataggttaattaatagctcttgaagataaatgacttc

SEQ ID NO: 33746 - DNA, 601 bp, Human
tgcctgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaacattcagaaaatgctaagatgattcatatagyttggacacttactttactgatcctactgtttttcatgggtcagaaagtacagtgactggattaatattgaatttctgaattaataaaacaacttcctaatggaaatttttcagggggaaaattgtttgacatcaaaaggcaccaccacccaacctcaagaacaaaagagtaaacataaacacataaataacactttcctagaactaacagttataggttaattaatagctcttgaagataaatgacttctattgaatcaataatatatcattaagttaagaagagaaaccaggtgcagtg

SEQ ID NO: 33747 - DNA, 601 bp, Human
aaaacaacttcctaatggaaatttttcagggggaaaattgtttgacatcaaaaggcaccaccacccaacctcaagaacaaaagagtaaacataaacacataaataacactttcctagaactaacagttataggttaattaatagctcttgaagataaatgacttctattgaatcaataatatatcattaagttaagaagagaaaccaggtgcagtgtctcacatctgtaattccagcactctgggaggctaagataggagaatcacttgatgctaggagttcgacaccagcctggacaacrtagcaagaccctatctctacaaaaaatttaaaaataagccatcatggtggcatgcacctgtagtactagctacttaggacgctgaggtgggaggatcacttggaccccagactttgagtgagctaaggctacgctccagcctggtagacagagcaaggccctgtctcaaaacaaaacaaaaaacaaacaaacaaaaacagtataatcaatccaccaatgtactaattgttttacagacagttggtgacattattcagtttgacatctgacatatttaaaagcaattctagcaacttcggg

SEQ ID NO: 33748 - DNA, 601 bp, Human
ttaggccccattaatcacaaatactgtatcatttagagatattggaccatgatttttttcagcttttatcaagttgatttttaacatttgaaaatcttaatattttccattttaatttacagtacatgcagaaaactaaatcaggaacacacacattccagacattttacagaccatttcatcattgttatttaagagctaaattcactgccatcatcatcgtcataatcatccagcaaacttattttgctactcatcacctttctagatctcaaactctcaacacgcaggaggtctagtkagaggggcaagtaaaaatgctaatgagactgggtgtggtggctcacacctatagtcccagcactttgggaggccgagacagggcgactgcttcagcccaggagttcagcttgggcaaccgtggtggcacatacctataatccctgctacttgggaggctgaggcaggaggcttgcttgggagcccaggagtttgaggctgcagtgagctatgatcatgccactgcactccaacctgagtgacagagtgagattccatctgtaaaaaaaagaagaaaaaaatgctaatcagcagagggtga

SEQ ID NO: 33749 - DNA, 601 bp, Human
ctgttctgagtaaaatgttgataaggtggccaccaaccttccctcaacacactcacattcaggaggctgtccagagcttcaggaaaaggtgctggcttgagggaaaacagaagaggaaagtaggtaagaaacagcagaggaatgaataggagagaggggtagtggtcagtgaaattctcaaaggatgctattgaaacatacagctgtgcaatttttgagtgaacttttttctgtgggggaattgttttggcaggtggcgcgatcatcctgaatacccatttcatgatgaatactgactgcmgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgaca

SEQ ID NO: 33750 - DNA, 601 bp, Human
accaaccttccctcaacacactcacattcaggaggctgtccagagcttcaggaaaaggtgctggcttgagggaaaacagaagaggaaagtaggtaagaaacagcagaggaatgaataggagagaggggtagtggtcagtgaaattctcaaaggatgctattgaaacatacagctgtgcaatttttgagtgaacttttttctgtgggggaattgttttggcaggtggcgcgatcatcctgaatacccatttcatgatgaatactgactgccgggagttcctgaacagatttttcactcccaygagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgt

SEQ ID NO: 33751 - DNA, 601 bp, Human
gtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttmacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaa

SEQ ID NO: 33752 - DNA, 601 bp, Human
ttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagaggrctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaa

SEQ ID NO: 33753 - DNA, 601 bp, Human
aaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggygcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaagaaaagaaata

SEQ ID NO: 33754 - DNA, 601 bp, Human
aaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgyggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaagaaaagaaatata

SEQ ID NO: 33755 - DNA, 601 bp, Human
cttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctsatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaagaaaagaaatatattttattc

SEQ ID NO: 33756 - DNA, 601 bp, Human
gtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcytggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaagaaaagaaatatattttattcattcacattaggtcactgtcatactgtcataggatgagagagttcttcaaaaattatgttttcccaagat

SEQ ID NO: 33757 - DNA, 601 bp, Human
gtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcrtgaacccgggaggaggagcttgcagtgagccgagatagcgccactgcagtccggcctgggtgaaagagcgagactccgtctcaaaaacaaaaaaaaaagaaaagaaatatattttattcattcacattaggtcactgtcatactgtcataggatgagagagttcttcaaaaattatgttttcccaagatcagttgcttatagataatgttcaatgacctcaagacatatatttttgagaaattatcattttaaaaaatttggtctatactgattgttttcactgattccaatattattac

SEQ ID NO: 33758 - DNA, 601 bp, Human
tacatttctacagcccgggatggggatggactactgtaaatttcacacattcctgagatgggtttggatcataatcctaaaagagaccatctcaaataccataatcccaaatattgaaatccccaaagatcaaaatccctaaagtctaaaatcctaaaaatctcaatcacaggatagttgtatcctgtgaggtcaactcttatgaacggtctctgtgcaactgcccataatctctccctgtaatacacttggtcatatgttaaatttgaaaaaactaaatggtctttagtatatatatatwtttttcccccactattttaaatagcattactttttgcaattcactatgctatgtatttcatcttcacatcattttcaatactggaggtataaatggtatagagactttgagagagttctaattccttttatgcgtttgttgcaaatttgactccctgaaagtgtattatctcagcattgctggtgtgtaagcattgtgcatgtatggaaaaatgctgaaagttcctcagtaaacatagggatgtccttttggtacatccgcatttgtggaagataaactttctccagatcctggctcttt

SEQ ID NO: 33759 - DNA, 601 bp, Human
cctccccgctactgtcatctacctgggaactccatggggcagtaagtggctctgtaacgaaggcttgtgggtcctacatttctacagcccgggatggggatggactactgtaaatttcacacattcctgagatgggtttggatcataatcctaaaagagaccatctcaaataccataatcccaaatattgaaatccccaaagatcaaaatccctaaagtctaaaatcctaaaaatctcaatcacaggatagttgtatcctgtgaggtcaactcttatgaacggtctctgtgcaactgcccrtaatctctccctgtaatacacttggtcatatgttaaatttgaaaaaactaaatggtctttagtatatatatatatttttcccccactattttaaatagcattactttttgcaattcactatgctatgtatttcatcttcacatcattttcaatactggaggtataaatggtatagagactttgagagagttctaattccttttatgcgtttgttgcaaatttgactccctgaaagtgtattatctcagcattgctggtgtgtaagcattgtgcatgtatggaaaaatgctgaaagttcct

SEQ ID NO: 33760 - DNA, 601 bp, Human
gaggtgggcagatcacctgaggttaggagttcaagaccagcctggtcaacatggagaaaccccgtctctactaaaaatacaaaattagccgggtgtggttgcactccagcctggggaacaagagcaaaactctgtctctaaataaataaataaataaataattttttgttttgtggagacagagtcttactacgttgtccaagctggtaatcttggactcctagctgcaagcaatctcctaccttggtttcccaaagtgttgggattacaggcatgggccactatgcctagctaatatactttttttttttttttagacgacgtctctgtcacccaggctggaatgcagtggcgtgatcttggctcactgcaacctctgccacctgggttcaagcgattctcctgcctctcagcctcccgagtggctgggattatgggcacctgccactgtacctggctaatttttgtatttttagtagagatgggctttcaccatcttggccaggctggtcttcaactcctgaccttgtgatccacccgccgcagccttcctaagtgctgggatcacaggtgtgaccaaccatgcccggcctgatacact

SEQ ID NO: 33761 - DNA, 601 bp, Human
tcttcccacctcagcctcctgagtagctggaaccaccggtgtgtgccaccacactcagctagtttataaaaaaaatttttggcagggcgcggtggctcacgcctgtaatcccagcactttgggaggtggaggtgggcagatcacctgaggttaggagttcaagaccagcctggtcaacatggagaaaccccgtctctactaaaaatacaaaattagccgggtgtggttgcactccagcctggggaacaagagcaaaactctgtctctaaataaataaataaataaataattttttgttttktggagacagagtcttactacgttgtccaagctggtaatcttggactcctagctgcaagcaatctcctaccttggtttcccaaagtgttgggattacaggcatgggccactatgcctagctaatatactttttttttttttttagacgacgtctctgtcacccaggctggaatgcagtggcgtgatcttggctcactgcaacctctgccacctgggttcaagcgattctcctgcctctcagcctcccgagtggctgggattatgggcacctgccactgtacctggctaatttttgtatttt

SEQ ID NO: 33762 - DNA, 601 bp, Human
cactgcgcccagcctaattttttgtttgtttttgtttgtttgttttagacagggtcccactctgttgctcaggctggagggcagtggatcacggcccactgcagcctcgatctcccaggctcatgcaatcttcccacctcagcctcctgagtagctggaaccaccggtgtgtgccaccacactcagctagtttataaaaaaaatttttggcagggcgcggtggctcacgcctgtaatcccagcactttgggaggtggaggtgggcagatcacctgaggttaggagttcaagaccagcctgrtcaacatggagaaaccccgtctctactaaaaatacaaaattagccgggtgtggttgcactccagcctggggaacaagagcaaaactctgtctctaaataaataaataaataaataattttttgttttgtggagacagagtcttactacgttgtccaagctggtaatcttggactcctagctgcaagcaatctcctaccttggtttcccaaagtgttgggattacaggcatgggccactatgcctagctaatatactttttttttttttttagacgacgtctctgtcacccaggctggaat

SEQ ID NO: 33763 - DNA, 601 bp, Human
caggtgatccacccgcctcggcctcccaaagtgctgggattatatgcatgagccactgcgcccagcctaattttttgtttgtttttgtttgtttgttttagacagggtcccactctgttgctcaggctggagggcagtggatcacggcccactgcagcctcgatctcccaggctcatgcaatcttcccacctcagcctcctgagtagctggaaccaccggtgtgtgccaccacactcagctagtttataaaaaaaatttttggcagggcgcggtggctcacgcctgtaatcccagcacttygggaggtggaggtgggcagatcacctgaggttaggagttcaagaccagcctggtcaacatggagaaaccccgtctctactaaaaatacaaaattagccgggtgtggttgcactccagcctggggaacaagagcaaaactctgtctctaaataaataaataaataaataattttttgttttgtggagacagagtcttactacgttgtccaagctggtaatcttggactcctagctgcaagcaatctcctaccttggtttcccaaagtgttgggattacaggcatgggccactatgcctagc

SEQ ID NO: 33764 - DNA, 601 bp, Human
gattatctttaaaggaataatatatgcatcttgtgtgtacatgtctgcacgcatgtgcatacacacacacacacaccggtctggaagtctgcacatcaaacttaatgttcatctccctggaagtgggattttggtgggggcagtgcacagaagggaccttactttttttttttttttttttttttgagacagagtctcgcatgtcacccaggctggagtgcagtggtgtgatcttcgctcactgcaagctccacctcctgggttcacgccattctcctgcctcagcctcccaagtagctgrcactacaggcacctgccaccatgcccggctaatttttttttttttagtagagacggggtttcaccatgttagccaggatggtctcgatctcctgacctcatgatccgcccacctcggcctcccaaagtgctgggattacaggtgtgagccactgcacccggccaggaccctacatttttcactttacacacttttattctttttttttcagatggagtttcattcttgttgcccaggctggagtgcaatggcacgatctcggctcactgcaacctccaccttccgggttcaagcaattct

SEQ ID NO: 33765 - DNA, 601 bp, Human
gggaaatctccctttctccgctgtaatttccataaagaaagagatcatttctgctgtggccacagttgtatccctggcacgttatctggagcaggaagcactcaacaggtttatcgaatgagcatgctcataaataaataaagagacagaatttgctaaaatgcctttactcatatatgtaaaaaataaaactgggttttaaaaacttgtttgccagcaattctatttgtagaaatccatctctaaaaccagatctataatatatatggatgcttataaaagcaacagccaaaaagaatgraaaattggaaatcatccaaagtgttgctggagcttcattgctgaatggttagataagttgtggttcaccccagctatgaaataacatgcagctcttaaaaagaatgaggctgtatttgtatggactaacttggaagtgtatctctaatacattaatacatgtcccaaacatgttgctgactgactgatgagtcttataaaatgtgtagcatgattccagaaatgatccaagtgcaggtactccagtagaagattatctttaaaggaataatatatgcatcttgtgtgtacatgtctgcac

SEQ ID NO: 33766 - DNA, 601 bp, Human
gcaccagccagctctttgggtagctgctacttccccttctgccccacacgatggggcccagatgggagagtggggcagccccaccttgcagcccagagaactgagcctgtttgctccctccgcagagtttataagggagtgtcccttgatagctgatggctgcccttgagcaattcaaaagggattttcaccatgcagtctcttctgatgaaaacactcccccttctcctcccattttaaaatgtattagagacaagggcggcggagataagggaaatctccctttctccgctgtaatttycataaagaaagagatcatttctgctgtggccacagttgtatccctggcacgttatctggagcaggaagcactcaacaggtttatcgaatgagcatgctcataaataaataaagagacagaatttgctaaaatgcctttactcatatatgtaaaaaataaaactgggttttaaaaacttgtttgccagcaattctatttgtagaaatccatctctaaaaccagatctataatatatatggatgcttataaaagcaacagccaaaaagaatggaaaattggaaatcatccaaagtgttgctg

SEQ ID NO: 33767 - DNA, 601 bp, Human
cttatccagggctatcttcaggaagtcacggaactctacagacctgggaggacaggcgtcagaggtaagcatggaggaggcaagagcagagagaagccccccacgtcacagactccactgtcccaatcatgcccctcaaaggacagaggaaactttcacaagctaaaacagtgacagggcctacacgacgcccttttcatcatggacaccactgtccagatggggacccagacatcggcgaggagcagggacgtgcccaggccacgcagtgaggagactcagcagtgccgggatttgaacmcaggcccccgatgtcccgcccagggtgtgccatgtggctcctgcggctcagctggggctcctgttccccagtgggagccagcttatttgggtgacttggtttgctctggtgaagatctcatgtcaagtgcacagaggcagcacggtagctcacgcctgtaattccagcactttgggaggccgaggcagacggatcccttgaggccaggagttcaagaccagcctgggcaacataggagaccttgtctctacagaaaattagccaggcatggtggtgggtgcctgtactctcagctacaag

SEQ ID NO: 33768 - DNA, 601 bp, Human
cagcgtccaggtcactggtgagttcattaggctccacccttcagggagcagagtgggaggggaatccactcacctccagcagctgcgcggcactgggtcgggtttctgggttcttatccagggctatcttcaggaagtcacggaactctacagacctgggaggacaggcgtcagaggtaagcatggaggaggcaagagcagagagaagccccccacgtcacagactccactgtcccaatcatgcccctcaaaggacagaggaaactttcacaagctaaaacagtgacagggcctacacgaygcccttttcatcatggacaccactgtccagatggggacccagacatcggcgaggagcagggacgtgcccaggccacgcagtgaggagactcagcagtgccgggatttgaacccaggcccccgatgtcccgcccagggtgtgccatgtggctcctgcggctcagctggggctcctgttccccagtgggagccagcttatttgggtgacttggtttgctctggtgaagatctcatgtcaagtgcacagaggcagcacggtagctcacgcctgtaattccagcactttgggaggccgaggcag

SEQ ID NO: 33769 - DNA, 601 bp, Human
gacaaggtctgggtggcttcgttccccaaggcactcccaacacagagctggcattcaggaggtgcctggggaatacccgctgatggacaaacagctgtccatgctgttccctgggcggggtgagaacatgcccagcgtccaggtcactggtgagttcattaggctccacccttcagggagcagagtgggaggggaatccactcacctccagcagctgcgcggcactgggtcgggtttctgggttcttatccagggctatcttcaggaagtcacggaactctacagacctgggaggacaggmgtcagaggtaagcatggaggaggcaagagcagagagaagccccccacgtcacagactccactgtcccaatcatgcccctcaaaggacagaggaaactttcacaagctaaaacagtgacagggcctacacgacgcccttttcatcatggacaccactgtccagatggggacccagacatcggcgaggagcagggacgtgcccaggccacgcagtgaggagactcagcagtgccgggatttgaacccaggcccccgatgtcccgcccagggtgtgccatgtggctcctgcggctcagctggg

SEQ ID NO: 33770 - DNA, 601 bp, Human
gtttgagctgctcttggaacctggtgtagtcccgatcctgctccaggcggatccgcctggcctcctcccggcggcgcacggcatggtcttgctccatcttctccacttgctgcttttgctgacgctccaggttctctaattccgtgtcaaagaacttcttcttggcctgaaaggagcagaaattctgagaaacttagcgaagtcactttatacctgggagggacatgggaagtggaatggggagaactcagagcttgtgatcagacctaagcttgaatcccagctctactaccccgttgcygtgtgacctggggcaagttacttagcctgagtctccatttcctcatctgcaaaagggagaccagaccatgtgttgttgcacggtgctcaatacaggttatttcccctctggagatcctcctgtgggactcaggatcgctgtgaccttcacggggttctgtgttaacaagtcactgcctaacaagatcgggaagcccccaggaattgggcaattgttgtgaattactctccactacccaatcattcccactatgtagcttccactgagagaacacctggaggcaagaagccctgcagggtc

SEQ ID NO: 33771 - DNA, 601 bp, Human
atgtgctggcaccctgactgtggatttcccagcctccagaagtgtgggaaatgaatgtctgttgttgataagccacccagtcagtggtattttgttacagcagcctgaatgaactaagatacttggccaaagaatagtaactctccaagcctcagtttcctcatctacagaaatggggataacctaggccctgcctcacagtgttaggtgaggatttgatgagataaaggtagaaaaatggactggcacatggcctggcagagtggttgctcagtccacgccaagctctctccacctcccrtaaatccagctcacttattaacatactctgcctgtttctttcttttcttctcttgacttctggaataatctcaaatagtcttggtgacaactggtgtccttacctcgttccttacttcaagtggggcttttccccaggtttccccatgaagaatgatgtttagttttggggatggagaaggcctgggaggttcttgttgcccaccccacttcccagggctgggatgtccacagcgactctgggccaagacagcgctgccacttgcacacccccacctcgaaggagctcctgcttcttcat

SEQ ID NO: 33772 - DNA, 601 bp, Human
cggcttcctgatattgtcatccaaggcccagctctatcacccattaactgtgcaacctcagtgctatgatctaaacgtttgtgtcccctccccaaatgtgtatgttggaatcttaacccctgaggtgagggtattaggagatggggctttttgggaggtgattaggtcatgagggtggagccctcgtgaatggaattagtgcctttttattaataaaagagaccccaggctgggcacgttggcttatgcctctaatcccagcactttgggaggctgagacaggcagaccacttgagcccargactttgagaccagcctggacaacacagaagaccccatttacacaaaaaacacaaaaattagccaagcgtggtagcacgtgcctgtagtcccagctacttgggaggctgaagtcagaggactgcttgagcctcagaggcagaggtcacaatgagccatgactgtgccactgcactccagccttggctacagagctagaccctgtctcaataaataaataaataaacaaaaatccccaaaacccaaaaaaccacaaaaccccaaaaacccagagaccccagagctagtctcccttccacta

SEQ ID NO: 33773 - DNA, 601 bp, Human
agccaaaaattgccctgggatattggcctcgtgttgtttacttcctcacagcaggcttggaccgtcaaaagtccacaggcaccaaactcaaatttgtacccatcctcttgttatttttaaaacataatatgtacggccaggcacagtggctcacaccgtagtcccagcattttgggaggctgaggtgggcagatcgcttgagcctagaaacctgagaccagcctgggcaaaatggcgaaacccagtctctactaaaaatataaaaatcagctgggtgtggtggtgtgcacctgtaatcacrgctgctcaggggcctaaggcatgagaattgcttgaacaggggaggcagaggctgcagtgagccaatatcgtgccactgcactccagcctgagtgacagagtaagacttggtctcaaaaaacaaaaacaaaaaaaatgtatatagttacataaaaaagctcaaacagggccaggcgcggtggctcatgcctgtaatcctagcactttgggaggccgacgcaggcagatcacaaggtcaggagattgagaccatcctggctaacacggtgagaccccgtctctactaaaaatacaaaaaaaa

SEQ ID NO: 33774 - DNA, 601 bp, Human
cccgtgccaccggcagcctcaccttctcatgcttgcgcagcagctcgtgccgctggaggaagtactggtctttgagctgctgcttcaccagctggtgcctctcctgcagctggtgctcttccatctcccacagggctgcttcccggtctgcagaggacatgccaccgagctggtgaggtgctgacaaccagagactcgacaggccccctgccccccacctctgcctggcctcctcatgctggagatgataaccaacctgctgggctcaggaattgccacatgttctacctcattagaccaygttggctgatctgagctgaggcctagaaacttcctttaagcctaaggaatgagagctcccaggagcatggtatagcaggaagtattcaaagtcaggagccacagaaactgcagctataggctggaacccagctccatcggtgggattaggaatggagaggttctctaggcatcagctgccatgtctgccagatggacacagctataccatggagggaggggacgtccttgggagaaactttgaagtgcaaagtttccacactgcatctctaccttcctgatgggcacctgggaagagctc

SEQ ID NO: 33775 - DNA, 601 bp, Human
ctctggggagttcagggaaggcttcccagcagaggtggtgtttaagtggagacctaaaagtattgagggaatgcacaagaaagagagaaataaagacaaaatggaaagggaggacaaaaagagggaaaagagaaaaaagagcaaaagaaagacacacaccgggcaggcacagtggctcacgcctgtaatcctggcactttgggaggccaaggcgggcagatcacttgaggtcaggggtttgagaccagcctggccaacagggtgaaagcccaactctgctaaaaaaaaaaatacaaaaatyagccaggcatggtggcaagcacctgtaatcccagctactcgggaggctgaggcaggagaatcacttgaacccaggaggtggaggttgcagtgagcctagatggcgccactgcactccagcctgagtgagagagcgactccatctcgaaagaaagaaagaaagaaaagaaagaagagaaagaaagaaagaaagaaggaaggaaggaaagaaaagaaagaaagaaagaaggaaggaaggaaggaaagaaagaaagaaagaaagaaagaaagaaagaaagagaaagaaagaaagaaagaaaga

SEQ ID NO: 33776 - DNA, 601 bp, Human
agagtaggggccctcaccagctctggggagttcagggaaggcttcccagcagaggtggtgtttaagtggagacctaaaagtattgagggaatgcacaagaaagagagaaataaagacaaaatggaaagggaggacaaaaagagggaaaagagaaaaaagagcaaaagaaagacacacaccgggcaggcacagtggctcacgcctgtaatcctggcactttgggaggccaaggcgggcagatcacttgaggtcaggggtttgagaccagcctggccaacagggtgaaagcccaactctgctaaaaaaaaaaatacaaaaattagccaggcatggtggcaagcacctgtaatcccagctactcgggaggctgaggcaggagaatcacttgaacccaggaggtggaggttgcagtgagcctagatggcgccactgcactccagcctgagtgagagagcgactccatctcgaaagaaagaaagaaagaaaagaaagaagagaaagaaagaaagaaagaaggaaggaaggaaagaaaagaaagaaagaaagaaggaaggaaggaaggaaagaaagaaagaaagaaagaaagaaagaaagaaagaga

SEQ ID NO: 33777 - DNA, 601 bp, Human
agccctcgaggagcccccaggctggtggggacatgacactgcaatgtgacacacgccaggaaagtgtgtgtagcaggcaggaatcacaagggcccgtgtgcccgagccacaagggcaacacaggatgtggggaagctggccaaataaaagtgtgggagtgcggaagggaagggtgcaggagaattggcaacatagcaccaagctctacctctgtccacacacagaggtgaattcaccatgaggctgatgaagcttccagggcacgcatggtgactcgcacaccccctcccaagaccttataggcgggtgggtcggagtgcatctttcttttttgtttttttaagatggagtctcgctctgttgcccaggctggagtgcagtggttcaatcttggctcaccgcaacctctgcctcccgggctcaagcgatcctcccacctcggccttccaaatagccaccacacctggctaatatttttaaaaaattatttttttgtagagatggggttttgctgtgttgcccaggctggtctcaaactcctgggctcaagtgacccgcccgcctcggcctctcaaagtgttgggattacagacgtgagcca

SEQ ID NO: 33778 - DNA, 601 bp, Human
cacaagtccttgccccaatcctgcacagcaggaatggtcatccccatgcccattttaggggtgtgagagctatggcttaggagggtgatatgatttgcccaacctcacagagccctagagcagcatggcagggctggaaaccatccatcccgggcgtgtctgatgaagatccttccctgctgtggagtttctggccccctgagatctgatggccttggggaaactgaggcagcctgggggcaggggcaggggcaggcagggcggtacctgcagctgctgcagctcgctcatgttgctctcrcactgcgccagcatgtcccgcatctggttctcgtgtttctgctgttgctgcagccgctccgacttctgcctcttctcctcctgctgggagaactgcaccagagagagggtgggtgcctcaggggaccagggcctggctggttgggtagggagccccactcagccctggcccagggagacccctcagggggactggtctgtgcacagccccagtacccagcaccacctcaggctgtgcccgtgttaagtcctcaccctgagctgagacccagccccagccctcgaggagcccccaggctgg

SEQ ID NO: 33779 - DNA, 601 bp, Human
tcaacacctggaatgtttcctccatgcctccccacctctccagaaattgcccgatgggtccaacagcctgagcagttcctgaggttcgaatcagccccgtccccacaagggggcttcaagtaccagctcctggggccaggaccctcaggcatggggcaaacccaggggccaggaagcttgaagaggtcaggaattaccacagcaaaagcagcccacaaggggctcggccacaccccaaccacctttgcccaaaacacagtgatgactcagaaaccctgcagcagcccactgccagctccgycacttcattcacaagtccttgccccaatcctgcacagcaggaatggtcatccccatgcccattttaggggtgtgagagctatggcttaggagggtgatatgatttgcccaacctcacagagccctagagcagcatggcagggctggaaaccatccatcccgggcgtgtctgatgaagatccttccctgctgtggagtttctggccccctgagatctgatggccttggggaaactgaggcagcctgggggcaggggcaggggcaggcagggcggtacctgcagctgctgcagctcgctcat

SEQ ID NO: 33780 - DNA, 601 bp, Human
gggaagtgcctttatccagataccacgaccctactgggttggaaaagtagaatcctttgggagattttcattttgggtttcatgctagaggcttctgggagtttagaacttggctgagtgagaagtaatactcgcagcagcgctgcatgcctgtggcctgccaggagctgtgctcggcacttcatacgggctctctcagtgctcacactgaggcagggatcacccgaggcagggataggaaaacggatgcggaaggtgaatggcttggccaaaagtcacacagtggcaatcagcagagccstgccgggcaggcctcaacacctggaatgtttcctccatgcctccccacctctccagaaattgcccgatgggtccaacagcctgagcagttcctgaggttcgaatcagccccgtccccacaagggggcttcaagtaccagctcctggggccaggaccctcaggcatggggcaaacccaggggccaggaagcttgaagaggtcaggaattaccacagcaaaagcagcccacaaggggctcggccacaccccaaccacctttgcccaaaacacagtgatgactcagaaaccctgcagcagccc

SEQ ID NO: 33781 - DNA, 601 bp, Human
gcttataaagcagggggaagtgcctttatccagataccacgaccctactgggttggaaaagtagaatcctttgggagattttcattttgggtttcatgctagaggcttctgggagtttagaacttggctgagtgagaagtaatactcgcagcagcgctgcatgcctgtggcctgccaggagctgtgctcggcacttcatacgggctctctcagtgctcacactgaggcagggatcacccgaggcagggataggaaaacggatgcggaaggtgaatggcttggccaaaagtcacacagtggyaatcagcagagccctgccgggcaggcctcaacacctggaatgtttcctccatgcctccccacctctccagaaattgcccgatgggtccaacagcctgagcagttcctgaggttcgaatcagccccgtccccacaagggggcttcaagtaccagctcctggggccaggaccctcaggcatggggcaaacccaggggccaggaagcttgaagaggtcaggaattaccacagcaaaagcagcccacaaggggctcggccacaccccaaccacctttgcccaaaacacagtgatgactcagaaa

SEQ ID NO: 33782 - DNA, 601 bp, Human
tatctgctttacaaaatgtaaatctctctcataggcagcagtgacaagtccctgttgatttcttgcagggaatcagtcttgtcatgaggagcttataaagcagggggaagtgcctttatccagataccacgaccctactgggttggaaaagtagaatcctttgggagattttcattttgggtttcatgctagaggcttctgggagtttagaacttggctgagtgagaagtaatactcgcagcagcgctgcatgcctgtggcctgccaggagctgtgctcggcacttcatacgggctctctyagtgctcacactgaggcagggatcacccgaggcagggataggaaaacggatgcggaaggtgaatggcttggccaaaagtcacacagtggcaatcagcagagccctgccgggcaggcctcaacacctggaatgtttcctccatgcctccccacctctccagaaattgcccgatgggtccaacagcctgagcagttcctgaggttcgaatcagccccgtccccacaagggggcttcaagtaccagctcctggggccaggaccctcaggcatggggcaaacccaggggccaggaagcttgaag

SEQ ID NO: 33783 - DNA, 601 bp, Human
cagattccaggcagaacaggtgagaaatcagaagacgcaggccctgaagactgagacacacctcacgctgtggctacgagggcaccagcatcgttcatttattatttcttcttgactataaatcccatttattcaaactctatacgtaaatcacatgcaccaagaagtgcctggaggaatagtccagaatatgttaatagttcttattaactctgtggtggggaggtatagtaaatttgcaactttctgtgaggatacagcaagaaggcagctgtccgcaagccaggaagggagccctcaycagaaccccaccctgctggcaccctgatctcagacttccagccttcagaactgtgagaaagaagtttctgttaattaaagcatcatggtttgttatggcagcccgagctaagatactctgtatgtctcacatataatttcctcagggagatctgtggcaaggaatgagggtcactgacatgggtgagactcttctaacctcgctgttctttctctgaggtaagttatctgctttacaaaatgtaaatctctctcataggcagcagtgacaagtccctgttgatttcttgcagggaatcag

SEQ ID NO: 33784 - DNA, 601 bp, Human
gggcgttcagccacaaagggttagaaagttcctctctctctcaggctggagatccatttgatggtgccacaaagcaagagtccaccaaaataaggagacctaacatgtcctggccagaggcctgtgcatggcacagagcagagcccgagactgagcccaccagctcggataaagttaccttcttgcgcggccgaagcttgtcccgccattccttcaggttctggttatggctctcatccagggccttcagtttctgggtttcgtgctctaccaggaggtggcacttttcattctggaacarattccaggcagaacaggtgagaaatcagaagacgcaggccctgaagactgagacacacctcacgctgtggctacgagggcaccagcatcgttcatttattatttcttcttgactataaatcccatttattcaaactctatacgtaaatcacatgcaccaagaagtgcctggaggaatagtccagaatatgttaatagttcttattaactctgtggtggggaggtatagtaaatttgcaactttctgtgaggatacagcaagaaggcagctgtccgcaagccaggaagggagccctcacca

SEQ ID NO: 33785 - DNA, 601 bp, Human
gcttctgccatgttcctggggcaggggcattccatttccccctgatgctttttcttcctgaagagaagtccaacagactgccagcccaggtctgaaatgcaaggtgggactcctgaacacagtcggggggatggggcagaggcaaacagccctcctgtttcacctgcagacagggtgggccagagtgctatggagcagactgggttgtggaagcctcgtgtgctgaggaatcagtccctgcacacaggagcctgtgcgggggccagcacgcatcgcagcctggcagtacagcctgtgcttytccatgcctccggtgccaacaccccgcacgtgccacaccaactgctccacctaacatgctcagtggcacaggctcaggcagcaaacgtgttccaacccacctgggcagaagaggccaggccagcagaccaagtcctgtgtgtacgcgtatgtgtgtgcattcacacccatgtgcaggaagggggacgcgagatggcatgaaacacgggagaagcagaataaacatttcagcctccctctttccccggtccccgccccccacatagacaaggctttgtcttaagtggaaagcaaactggga

SEQ ID NO: 33786 - DNA, 601 bp, Human
cccacgccgggcgccgccgcggaggcgagcggcctagaggccggccccgcagaggcggcacgccgtgcattgtttcccgaccgtgctgtggagcgagccagggacgccgggagccaggtctcgggccacgacgacaggatgacgcctccgtctttgtgcttcctgggctggcgggcgggctcccctcccccggacgccgccatccgcggcctgctccggcttcgccattggcccgcggcgccccggtcccttcactcccgcccccggcccggcaacaaggagcccggctcccacccgcagycccgtatcactcaccctgcagggtcccaaatgcgaaagccgggttcgcgcgcgaagccggcacgatgaggccgggccgaggcctccgggaaggctgagccgggcgccctggtgccgccgccgcgggccgggagcgggtcggagcagcaggcggaggtggcgccgccgccgccgcggggtcttcctttgttcctgcagcagcgtcgagcgtggccgggacacgccggagctcgggaagtgggaggagggaagcgagggggggccgaggaggaggtggagggaggaccggcggccgcagcgg

SEQ ID NO: 33787 - DNA, 601 bp, Human
atgtgcacagcttgctttaatatttctcagaagctcagatcacatgggagggcgcttcagcctgtcacaaggctgcaatgtgacaagctgagctggatggaggctctcacataaagcctagtcaacaggggcctctgaaatcagcttctatttatatctcaaagcctgccaactcctacacaaccccaagaactaaggatgcagcgttcatatatctaacataagaaaacaaaaaaagggctgctagttttttcctaatgtaggaaaaactacagaacaatctcaatctagaagatgaaarcatagtcaaagctaaaatggtcaaggttgttgataaaaaactaagcacagtggagacagtgtaaaaaagaatcctcatttagtgaggatttaggggatgaagtgggggatgtgtgttcccattaggtattgcattccccttgtattttagaaaaaaataccattactatttattgcctttaaagtaattagcaacttgagcatgcacgtgtcagctctatcaggtatagctagaatgcagattttataaagtttatggcttcctctaacttacagcttaaaaaaacacccgagtgtaact

SEQ ID NO: 33788 - DNA, 601 bp, Human
aataggagcaaaaaatgctttcaaatgataaatatgtatgtatttgcatgcccaccacgcacaaaatatgtgtgaatgtttgccctatgcatgaaagttgggtcactccttaaaaccagtttaagtatgctagcttacattttctacactgaggcccagtctcatgtgacattggctttaaagtttaaggccaagcgatcaacctacctaagtaattttagttaatctgattcttaaaatatttgttttagataaaatggaggatactccatctaaagatttcacacactcagagataacraagtattccaactttgcttcagagaacatgtctaccttcatttcattataaataactttcaactgcgagacacacaagaggtaccaggacatgagtcttctacatgggttcccatcttttagatttttttcccctagaaagccagcttttaaatgccatcacatgtgcacagcttgctttaatatttctcagaagctcagatcacatgggagggcgcttcagcctgtcacaaggctgcaatgtgacaagctgagctggatggaggctctcacataaagcctagtcaacaggggcctctga

SEQ ID NO: 33789 - DNA, 601 bp, Human
caagtaaatctctaagaatttagggtcagctggtttacgaaactccttttacattctccatttgaagtttcagagtatgtcaaagccagtgcctaggaacctgcaatacacaaattatgaaccagatttctcagccaaaggcactattaattttaacaagtgcttgtcttcctcataccagaaaataataaaaccgttccaagctcaaattcaatgtattaaagtcaatatatacacataacctttagtaatggttaatattcaatgctgggttaccagaaaaagctttacatagcaagcrtttgtttccaaggaagatttgcttttctaaaagtcttgttaaaacgctgtgctaaattattaataagttttcctctggatgagaaaatacatattaaagaaaaattattttaaaataaagttgtggagggttttcatgtcatcttaaacatgtataagcatatgtacaaaaagcatatttgagagcatttgcttaaaggaaaattcgtgtgctgtaacttgtggtcagtcattttttccaactacatactagaatacactttttagtgagttattaaaaaacgatgttttaacaagtatt

SEQ ID NO: 33790 - DNA, 601 bp, Human
gtatcaagacgtagtaataaatacttgcatttaattaggttagtgatataagcattcactgtgctgtaatcctatacttgagtatccaaacaaaaaatattaaaaagtcaatccaatgaacacaagtgtgaaacaaaataaccccaaaaaagaaaactgaaaagctataagatgcttgtagatagtcattcattcctgatcagtcatgtcaagcacttgggctgttgcttgaatttcaagctcttatcaggtgttctctccatgtgctttcagcattctcagccccaattcttggttctgyatttctgtccaccagttctttcaaatgtgtttttccttggaaataacttacccattgggctcattctgccactattttgctgcctctgaagatgttctttgtagcaaactgaacacattccatttgtcctaggatttccataaaagccacatcctgtgctacacagcatgggccccggggtctggttagtctcctgagccatatttttctgctatagacgaaacgaaatttcagaaattagtgttatcaccaaaatatagtctaatataatcatcggtataccgttgtaattgctacgca

SEQ ID NO: 33791 - DNA, 601 bp, Human
gagttcaagcaaacaatttttaaaggtgttaagggtacttcttgagacaatgaataagttgtcagttcaactttaaattatagaatatttccaaaatgagcaaatggagctagataatctaaagtttaaaaaaaaattggatgcccagcacaaatggttgagaaaaaagtttgataaatggctcatgaactcgaggctgcattttgtataggttaccatattttacaaccagctagggatttttagctgtgcctgtaacttgtttaagggcaaaagggcagctctgccaaaacaccttgtytggcccaataatattctacagtctcactcgacaatccctaaacctcaattacaaagaaataaaaaagcacagcatttccaacacagtatccttgagggggttagggagtcaggtgtaagtaacacacatctttactcaatgacttaagagtcatgtattaaaagacactgaaatcctcgattgcaaagccaagggtatctattaacttattattggaccagtacagacatcttgatttcttctttgtaatatcataaaaactctgaaacgttcaatcttaccttgatttttcagatgtgc

SEQ ID NO: 33792 - DNA, 601 bp, Human
ctcctctttggtccttcaatgggaaggaaagaatccccccaccagccatttcttgcactatcaaattcagaactgaacaagtattaaatgaaaaacatacctggctctgacacctctgttttcggggtagttattttgtcctctcttgaaatgctcatttctgtcatttgctgagttacaggcaaggcagccacaggcacatttctatttgagttcaagcaaacaatttttaaaggtgttaagggtacttcttgagacaatgaataagttgtcagttcaactttaaattatagaatatttycaaaatgagcaaatggagctagataatctaaagtttaaaaaaaaattggatgcccagcacaaatggttgagaaaaaagtttgataaatggctcatgaactcgaggctgcattttgtataggttaccatattttacaaccagctagggatttttagctgtgcctgtaacttgtttaagggcaaaagggcagctctgccaaaacaccttgtctggcccaataatattctacagtctcactcgacaatccctaaacctcaattacaaagaaataaaaaagcacagcatttccaacacagtatc

SEQ ID NO: 33793 - DNA, 601 bp, Human
acaaatttccacatcggcagtcaaaccctgtacaaacgaagaagtagagtcatttgagaacttgaggcaattaaaagaaaaaaaagccttagtcactatagaaaaggaaccagattttcattgctttgtaacataaaagacagtgaactcttttcttccacttcctggtgataagacacagtcaactcttacagagtctatcacgttaacctggaaaaggaacttttaacttcctttgacatggtgagaaattcaaataactatgttcagtctttccttgcaagggcaatagcgaagtgtytggtaagccaaaccacgtggagaaaacaaaatgggctatctgccagctaatttctaccagatgctctccctctatcgactcctgtagatgcaacgcaggataaaatttacacaggctctggagttaggctaagctggattcaaaacacagtcctaccatatcttaagtaatgcttcctcaagtgaaaacaaccatcaaggtctgagatttgaaggagacaagaaaaaaagcaccaagaacattccctgcatagctcaaagtaggtggcgcttactgttagttcagtaacattttccctag

SEQ ID NO: 33794 - DNA, 601 bp, Human
attgcaataaatcagaagtagtgcctcgtgtacatacttaactatttacagatgaaaacaggcattaccacaacactaactatactcatttatatataaaaaacacaagtttcatacatcacaaaaaaccttccattataacacagaagtgattattaccagacaagcatcagtgaagtatactgccttttctagttgttattgtacaatgctgtagataatgcagcccatgcaatacacccaagaacactagagtcctacacccaagtacaatatgataaagcagccctctgcaagtggygctggataccactaagaagtctactgcagccatgttggttatgattttccatgcagaagggtacagttacattaagaactgaagtcttttaaaaagctttaaacattctttcttgaaccaaaacattcgacaaaagatgcacatgaaaaattattcagatacctttgcaacttaaaattcagatgcatgttattcaatagagctgctgtatgtgaaaaccaaacgtagagtttaaatttcttcttgtaaacaaattaatcctagtgcagttctgtgctacacatttttagcaatgagtaa

SEQ ID NO: 33795 - DNA, 601 bp, Human
cccatttccgaccccaagtgaggctaggaattacgatgccttttaaaaggcacctcgacttgcaacacttcgaggggggccccagccccgcagccactgggaaccgcgcgtccgcttccccccagcgcgctccccacccggcccggccacgagtggactccaggctggccgccatgttgccggagtcgccgccgcaccccgagcgcggcccgcccgcccgaccgtggcccgaacccgggccccgcccgcacggcgaggaggcagtgcggctcggctgggcaggggagggcgggaagcccayagggcccgcgcccacctggtgccggagtggtgaccagcgggagggacgtcaccggcgccgaggttacgttggagatgggcgctaaagtcgtcacgttcgggtgctgggtcgtgttcttgtccgcggacagcacgcagagcacgcccaggcaggtggcggcccaaagcagtgagcgggagagccgcgacatcgtgtcctcagcgctggcgttcgggagaaagctaaggctcgcaacgctcagtcaacccctcaatcccctgcggcgccgcctccgagactacgctcccccgcgggagcgcg

SEQ ID NO: 33796 - DNA, 601 bp, Human
tccggagaaggctacctccggagagaggcgccgggagggtgaacaaccagtggcagggagaggcagctcggccccaccgccaacctcagaggcgcgacgcccggccccatcctcaaccccaccgctgcccccgcggaaggaagccacgtccccatttccgaccccaagtgaggctaggaattacgatgccttttaaaaggcacctcgacttgcaacacttcgaggggggccccagccccgcagccactgggaaccgcgcgtccgcttccccccagcgcgctccccacccggcccggccacsagtggactccaggctggccgccatgttgccggagtcgccgccgcaccccgagcgcggcccgcccgcccgaccgtggcccgaacccgggccccgcccgcacggcgaggaggcagtgcggctcggctgggcaggggagggcgggaagcccatagggcccgcgcccacctggtgccggagtggtgaccagcgggagggacgtcaccggcgccgaggttacgttggagatgggcgctaaagtcgtcacgttcgggtgctgggtcgtgttcttgtccgcggacagcacgcagagcacgcccaggc

SEQ ID NO: 33797 - DNA, 601 bp, Human
cattctattcctatctgcaaaaccaatgtaattaaatctcaagcgaccttctcagactcaagtctgagacacgaacgagcattaccgtctttaagtttctctttcccggacttccggagaaggctacctccggagagaggcgccgggagggtgaacaaccagtggcagggagaggcagctcggccccaccgccaacctcagaggcgcgacgcccggccccatcctcaaccccaccgctgcccccgcggaaggaagccacgtccccatttccgaccccaagtgaggctaggaattacgatgacttttaaaaggcacctcgacttgcaacacttcgaggggggccccagccccgcagccactgggaaccgcgcgtccgcttccccccagcgcgctccccacccggcccggccacgagtggactccaggctggccgccatgttgccggagtcgccgccgcaccccgagcgcggcccgcccgcccgaccgtggcccgaacccgggccccgcccgcacggcgaggaggcagtgcggctcggctgggcaggggagggcgggaagcccatagggcccgcgcccacctggtgccggagtggtgaccagc

SEQ ID NO: 33798 - DNA, 601 bp, Human
aatcatacgagactgcaggttttaaacctctagtgtttctcccgcttattacctcaaacttatcttccttctctcttttgtgttgtcacggtatatggcaatttctgctttaaaatgtatgtatgccttaaccagccctatgcgactgcacataacaaaagacacgctcctgatcgggttttagaaaacccacagacctgggcacaaacccccgttccacgacctactaaacatacgctatctgagcacaggacatagttaagaaaattttaaaaacaattgaaaaaagaataaacatacwatgtcaggagagtttactcatctccgtctctgcatctacctcctaggtttcactacctaccttccagtttagccttaggatacgtacgcaaaacacccggtacatacatgggtacttttcttccttttcgcatactttgaagtgtgaagttttcactaactacgtgctcaaacgtcagctacattctattcctatctgcaaaaccaatgtaattaaatctcaagcgaccttctcagactcaagtctgagacacgaacgagcattaccgtctttaagtttctctttcccggacttccggag

SEQ ID NO: 33799 - DNA, 601 bp, Human
ctacctttcagaccacactacatccacttatgatttccagaaaatacatacctcctttgcacgcacttcaattacacaaagacaaattaatttgatacttccaaccttctcttacacacacactacaattctgaaaggaaactgtcaaattaagactgagacaaacatattctgctctatcatcttaaaatagtgcggttagaattcccagtattatactgcaatttacttccctcgttttgaaatgttaccattacatcttccttaaactaaaaacaaaacattaagtttactatatacyttattaaacttttataaaatactaaaactagaggagaatttgtagaatatgaatgccgtgataaaaatcattacacttcggcattcttcggtcaagaagccaatgttaactacgtaaacattactccttaactaatgttaactagaataaccaatcatacgagactgcaggttttaaacctctagtgtttctcccgcttattacctcaaacttatcttccttctctcttttgtgttgtcacggtatatggcaatttctgctttaaaatgtatgtatgccttaaccagccctatgcgactg

SEQ ID NO: 33800 - DNA, 601 bp, Human
tcccagggattctcgattcataaatgatccactctcgacaggatcctccacaactggagacaacatctaaaagcccatattcaagtgcatacaattcaggttaacaaggtatttgtcaatagttcatcctaggccaaacaatccagaaacaagtactcatcaccataattcaatttctggagaagaacggactataaaattgggctctattttccagtgagaaaaagcagcaaaataaaagaaaaaaaagaattgggctccattcattttcctagaaactagatgcctccaaacattctcstttgctttgctcctgcctaaaaaatagttctgcagaggcactgctttcaatacttcatcattagtacttattaaagactgggacatgtacggtggggtggggaagggttcataaagtaaaaataaattttctgaagtttgtatagataaaacatgctgtttaaaaacctttgtgcttgacgggtgtagcaaagtgaaatgtctgaaatgttctttacaatgaactaaacttgctacctttcagaccacactacatccacttatgatttccagaaaatacatacctcctttgcacgcactt

SEQ ID NO: 33801 - DNA, 601 bp, Human
atttgaatctgtattacttatctttttgaacaataagcattacatacagcatcaaaattactaattcagataaatgataaaactttatactggtttactaagaaattccaatcattacaaagctgtaagtaaacgcattagaaaaacaagctagtggtcactctcagtacagtgcctgatggtatctgtctaaccaatcctttttcacaggacaactattggaagacacccacagccactaaggatttaggcatttcaaagcatccttaatacataaaaatatcgagaaaaaggctttgayataataccaacactacacataggaaaaccactacccccaaacatcagataaaaccctgagatttttagtagtaacagtagtagtttaacaggttgaacccaagcactgatgatgcccattctgctgcaaacaaagataatttcccagggattctcgattcataaatgatccactctcgacaggatcctccacaactggagacaacatctaaaagcccatattcaagtgcatacaattcaggttaacaaggtatttgtcaatagttcatcctaggccaaacaatccagaaacaagtactca

SEQ ID NO: 33802 - DNA, 601 bp, Human
tgttgagttatgtgaacaatagctctcatctgttggggggcaggggaaaagagacaaacagcatcaaccacccatttgtattatctttgactctgctactaagctctatgaaatcaaacccaaacactttagaagtgggcagggggaaccactttaggtgttttgacctaaagttaaacccacagaccaaaccctgtcattctccttttcccactgacttagagattacgcaggatccttctaacttttatccattaaaaatccacattaatatactgaaaaaataaatctgcaacacttwgatctcagaattgtgggaagactactgtacaatcaagaaaggcagccatcatctaaaaagtgggcaggtggctcacgcctataatctcagcactttgggaggccagggtgggaagatcacctgaggtcaggagttcgagatcagcctgaccaatatggtgagaccctgcctctaccaaaaatacagaactctgtctcagggaaaaaaaaaaaggcggagacagtaagttgaagtggtcagggtctgtattaagaggttagtaaacagatgaggcaccccataacactgtagaaactctat

SEQ ID NO: 33803 - DNA, 601 bp, Human
ctgatttacaatctcattggaaaaatcagcagcttcaagtagaattttaacgttttgctggacgaatagtaaaggttaaaaattaatcaagttactcagattaaaatacagaaaatggatgggtatagaaaagctcatttaaccacagcaccaactatgctgcagaataaatttatcaatcaacaatccccagtatcgcaacaccaaaagtgccagaatgaggtttcccagacctgcaagatgcaaacatagcggctaaactgtgatgaattcctagaaaagtttaaaaaaaaaaaaaaaagtgtgggggcagacaacgcatccacacttacagcatccacactatagctaaatcactaaaccaagcttcaaatatcatcctttaatcaatcaatatgaatatactattcatattccaattctaacaagatgagaattatggcaatgcttcaaacaaagcactgaaacaaggctttctgaggcaatgatcttcctcacctctctgcggtcagcttccaagcagccaatatgaatacttaccggaacagaagtctgtcgtgttccccacttgacaatcactaactgttgagttatgtgaaca

SEQ ID NO: 33804 - DNA, 601 bp, Human
acagttattagtttatctaacacatattaaagtaattacttaaaatgtttcagccaggtccagtagctcaagcatgtaattccagcactctgggaagccaaagtgggaagactgcttaagcccaggagttcaagaccagcctgggcaacatagtgagacaccatctctacaaaaaaatttttaaattagccagctatggtggcatgcacctgtaatcccagcttctggggaggctgaggcagaaggattgcttaagcccaggaatatgaggtggcaatgagttatgattgtgccactgcaytccagcctgggcaacaaagagactgtctcaaaaaaagtttgttcgtgtaccacctaactatattatgcaccctgtgtgaagtaaaactgatctaatactaatgaaatgttcagttacaaaattcacattgggatggggcaacccctaccaaaattaaagagtcaaaggtagtctttcaaggttagacacactgcacaaaaatctttttcctattcaattattatctatgcatcaaattaggaatatgcctttcccactgatttacaatctcattggaaaaatcagcagcttcaagtagaa

SEQ ID NO: 33805 - DNA, 601 bp, Human
ggaaggttgcagtgaaccgagatcgtaccactgcactccagcctgagcggcagagcaagacttcgcttccaaaaaaaaaaaaagaaaagaaaaaaagaaatacaaaggtgcatgaacgttatcgtacaatttcataaaaagtgtatttatttagatacacataaaaaagactagaagaaattaatcactgaaaacattttggttgctctggatgatgagaattataatttgctttaggcttctatatttcccaagatttccactaaatctataaaaagtactttatagactcaatgtacamagcctcagcaaatctgctcacattcaccgactataaaacactggagctatgtgtcactgtcacaaaaggtagagattaacgttaattgctgtggtccaagacttttaagtttttactcatctttaaaattatactaacaacttttacataattatttaaaactaatccatcaagaaagcttaaaaatactgaaggaaaaggaagaaaacagtcatcttgaattacctgtagaattggctgttggcactggagtggccgtggaaactattaaaaaaagaaaaaagaaaaaccatatacatc

SEQ ID NO: 33806 - DNA, 601 bp, Human
ggagaatgagagacggcctaattctctaatcaagagcaggatgggtaaagtgtataccataatgcttacattaagagagaaaatacaggctgggctcggtggctcacacctgtaatcccggctctttgggagtctgaggtaggcggatcactttaagtcaggatttcaagaccagcctggccaatgtggtgaaaccgtgactctactaaaaaaacaaaaattagttgggcatgatggcaggtgcctgtaatcccagcgactcaggaggctgaggcaggagaatcgcttgaacttgggaggkgaaggttgcagtgaaccgagatcgtaccactgcactccagcctgagcggcagagcaagacttcgcttccaaaaaaaaaaaaagaaaagaaaaaaagaaatacaaaggtgcatgaacgttatcgtacaatttcataaaaagtgtatttatttagatacacataaaaaagactagaagaaattaatcactgaaaacattttggttgctctggatgatgagaattataatttgctttaggcttctatatttcccaagatttccactaaatctataaaaagtactttatagactcaatgtacac

SEQ ID NO: 33807 - DNA, 601 bp, Human
atggaccagcttaactccttctcaccttgtacaggatgggacactctttgaactcaccgtactacttcacatctcctccgcatgtgctgacccgctgctccacttcagaggctctctccaagttttccagtgcagtttcactaccaagctatcaccacatctgcatcccacccaatacacattccttcttacaaatttcccaatacgctgtgctcactgagatctttcattgttcctacagtagacaaaatgctggcttaaccctaccatttaccctagtacttgtcttggaatagacgcrtttaatattggtaaaatgttaagtatttaatatttactcttcctctcaagttagtaaattttaaggagttcttatccatgctgttgagggcacggtaaaaactttccaggttgatgggaatgaaaataataaatctttctggagagccttaaaataatcataccctctgacctagaaattctgtttgactcaaacctatcagagataaatacaaatgcaattccatgtaagatgttcactgcatggagaatgagagacggcctaattctctaatcaagagcaggatgggtaaagtgtata

SEQ ID NO: 33808 - DNA, 601 bp, Human
tctgttctctagaattattgtaacaggctatctaatctcctgagttccttctggcatcgttccaatctactctccacaatgccagaataagttgttttattaaaatgcaagtctgatcatatgacctataaactttaaaatctttcaggataacatctaagtctaccagcaaggcatacaaaggtgtttcccaattctgctcacctggtgagcaactggtgatggaccagcttaactccttctcaccttgtacaggatgggacactctttgaactcaccgtactacttcacatctcctccrcatgtgctgacccgctgctccacttcagaggctctctccaagttttccagtgcagtttcactaccaagctatcaccacatctgcatcccacccaatacacattccttcttacaaatttcccaatacgctgtgctcactgagatctttcattgttcctacagtagacaaaatgctggcttaaccctaccatttaccctagtacttgtcttggaatagacgcatttaatattggtaaaatgttaagtatttaatatttactcttcctctcaagttagtaaattttaaggagttcttatccat

SEQ ID NO: 33809 - DNA, 601 bp, Human
tttacgaccacatcaccatataatcatcagctcaaaataagttttgtatcatttgcagacttccatggcatgactatttccatggtaaccagtttcaagttaccaacatggtatcactgaacatgggctgggaagagctactacacaataactggctagcaaaagctggtccaagccagctccacacaccactgcgtaagtgtttcaagatgagttgtccttgttacagcatttgactacttcttcctttgaaaaactacgcccacaaccacatactgttagtttcttgcacatacttctmtgggcttttttactaccctacccccatccctatttcctcccgtcttcttcctagcccttagacattactgtttcctagagtctggtcttcaagccccatcccttctttctatatgctcctccagtgcctctactactgcctatgcctatttatatttttagccaagagctcttgcctgacttgcagtttcctgaatactgaacagatcccacttaaatggattctaggtatcttaaactaaaatcccaaatgacaggcccaaccatcaatagactgctcttcctctttcttgcttacttt

SEQ ID NO: 33810 - DNA, 601 bp, Human
ggaggacccagggtggagaaagctgcagagaactacatcaagagtgaacccagttctcaagaaatgaacaacagttctgaataaattgttcccccactccctgcaccccattttcttttcataaccaaccttctgaaaattacttttctccaaacacctctggtttcagcaaccttcaacatcctacttagtcaatgtcttctaatgagtgttaaatatttacgaccacatcaccatataatcatcagctcaaaataagttttgtatcatttgcagacttccatggcatgactatttccayggtaaccagtttcaagttaccaacatggtatcactgaacatgggctgggaagagctactacacaataactggctagcaaaagctggtccaagccagctccacacaccactgcgtaagtgtttcaagatgagttgtccttgttacagcatttgactacttcttcctttgaaaaactacgcccacaaccacatactgttagtttcttgcacatacttctctgggcttttttactaccctacccccatccctatttcctcccgtcttcttcctagcccttagacattactgtttcctagagtc

SEQ ID NO: 33811 - DNA, 601 bp, Human
taagagagcttattttgtctcaggaaatcattaggtaagtcaggcttcagagtgcaagggcttcaatatgaggatatgcttatgctggtgggccgctagggatgatctggggaaagatgaggaagattaatcatatgagatttatatttttataaaaatgtaaggtgctatgcaaacattcatttttgtactatttcagaaaaaagggtttgaaggctaaagagaatttggaaaacaaatgttacttctgtttaaagtacataactgaacagacttcaaagtgatatgcttaacccacgaragacagggaaagggtgccaaataactgttgatgaagcacagaaatgagtaatcttttcactgcattagactttcaaacaatcgaacaaaaacctcaataggaatcagcatcctcccaaattctactaatataaaagaggaagttctgtgctttaacagtaaatatacactaaaagagcagggcttgacagttttcagatattgctaaatacctgaattgttgctaaaagtagatctttaaagaccaggactctcgtaacaggctgactacccataatcccaaggttgactgaatcctagg

SEQ ID NO: 33812 - DNA, 601 bp, Human
cagacgaatgggcatggtatgttccaataaagctttataagaacaggggccctgggcccacagttccccaacgtaagattctaagagcccaaggttaagtaagctctagtccaccacactgcatgaggccaaaatactatttgagttgccattactaaaggcaagaactgcaattacttttgcaccaacctaatagctgatgatactgctaaagaaatgtacactctgagaaggattagtttgaatgtaaaatcattttagggactaaagcactctttttttttttttgagatggagtctygctctgtcacccagactggagtgcaatggtgcattctcagctcactgcaacctccgcctcccaggttcaaacgattctcctccctcagcctcctgtgtagctgggattacaggcatgtgccaccacacccagctaattttttatttttaggagagacagggtttcaccatgttgaccaggctcatcttgaactcctgacctcaagtgatctgccgccttggcctcccaaagtgctgggattataagcatgactcacctcgtccagccagtatatcacctattaagtttctattggtagta

SEQ ID NO: 33813 - DNA, 601 bp, Human
aatatctatgtatctatcttgtataaaatctatgtatacatctggataaaatttgcaaaaactcttatcttgctcactgccaagggcaagaacatttaggtgaggaaactataggttcttcataatctttctcctaagacaaaaactattaaagtcgtaagttctctcttacaagggtattgagatttgcctatcttcttcacttcaggagttggcaaacttttcttaaatgggttgaaagcaaatattttactctttgggcactgtgtgatgcaaaagcagccaaagtcaacatgcagaygaatgggcatggtatgttccaataaagctttataagaacaggggccctgggcccacagttccccaacgtaagattctaagagcccaaggttaagtaagctctagtccaccacactgcatgaggccaaaatactatttgagttgccattactaaaggcaagaactgcaattacttttgcaccaacctaatagctgatgatactgctaaagaaatgtacactctgagaaggattagtttgaatgtaaaatcattttagggactaaagcactctttttttttttttgagatggagtctcgctc

SEQ ID NO: 33814 - DNA, 601 bp, Human
aaggggagggctgaactgtgggtttagctggaatgaaaacaaaatgtctttttaaaaaaccttaaatttctagcttcccagttatctaacagctttaaaaaataatcctgccaacttcaacatgctttcaattttttagagaccaaaagccaaatttcagttaatggttcactaacatagctatgcacccaagaatactaggatttaagtgtattttaaaacaataagcaatcataaaattgttaatatctatgtatctatcttgtataaaatctatgtatacatctggataaaatttgcraaaactcttatcttgctcactgccaagggcaagaacatttaggtgaggaaactataggttcttcataatctttctcctaagacaaaaactattaaagtcgtaagttctctcttacaagggtattgagatttgcctatcttcttcacttcaggagttggcaaacttttcttaaatgggttgaaagcaaatattttactctttgggcactgtgtgatgcaaaagcagccaaagtcaacatgcagacgaatgggcatggtatgttccaataaagctttataagaacaggggccctgggcccac

SEQ ID NO: 33815 - DNA, 601 bp, Human
aagaggaaacagaaaaagcgatttccatttaaaataatctaagaaaaaagtaacagttatcaaagaacactggttctggtggctgtacaagttggtaactttaatgacaactgttttgtattccttctcgtgaagacagaatggcttcactgaaactgagaaaaaggtggcataagcatgaagaaaaagaaatcacaaaaagcaggtagaagattcattagcatcagttttttaaaaatatggagggaggaaaggattcctaacctgtgtacctacagtatcctgtggcgtaacctaactrtgaattaaattagattatgtcaaatcatcatttaataacaagctaattttcacattactgagcaatgttaagaaatggttaagaaagtgaggtgcacatctggtagtgattctggctttttagacctttctcagtgaaaaggacggatatattatcttccctcaaatcgccatgctctctcatacagcacacaaccaatccctaacggtaatcagaagttacaaattagattttacatacaagttgtactgaaatgtttggaaaaacattattacttaattctaaagtgtcacgtcaaat

SEQ ID NO: 33816 - DNA, 601 bp, Human
tttattccacttttgaaatgacagccaaaaatccacctaattgattctcatttggcacgttcttctcaattctgttcactaaattaaaattactaaatttaaactgccaagagccatgatgttgtctgcacaagacaacattttccatcactttcagaaagttatatttggcatgttaaggaaaaaaaatataatcccacagcagcagctatttaaaataagacagccacaggattcatgcagaatattttaaatattcctgttgaacacaatgatttaattgattttttcttcacggatkatgctcccaaacatcctatatgcatccatggaaatttaaagatcctggaatagcgtcttccatgtgggacatcttaaaagatagtattttggcttcagtgagttacacaaatgaatcaccagtccttattaattcaatgggtctgtttacagagtgtggtaatttcgttctttagatttgcagaatttataaagaaagaaaattacagcctgcacacccaagaccaggacaattcctccaatgaaactggctgcatcaaaggtagactttcgcacaggttgtgaggttggagtcacagtg

SEQ ID NO: 33817 - DNA, 601 bp, Human
aatcaatttagctctatacttttcaacagccataagaaaaatgttgggaggttcaagatacgaaggctttcaattctgtataacagactttagcttaagtttctccgctctgaaataaattttcaataaaatattaacagtatgatatctaaaacaggtttactactgctcacatcaagttacatcctctgaccaatccttaccttccttaatgtcaaagaacaaatcatagacattaagctagagcttacctttcactgtcttctaaggcactgttctttatattctcaatgacataagrtgctttacaagtatgaacaataatctgttatacacactaatggtatcctttcatttctttaaatctggaatgtagttccttgtgtggcatcttatttctaatgtagaaaaaacagctgttatcaagcacaaaattttaatctaaggataccatttagtactactaaattaataaatttattccacttttgaaatgacagccaaaaatccacctaattgattctcatttggcacgttcttctcaattctgttcactaaattaaaattactaaatttaaactgccaagagccatgatgttgt

SEQ ID NO: 33818 - DNA, 601 bp, Human
tgcaagtaaaacaaacagctgtaccaacgagtaacaaagaaacagtaaatcttcatcttaacaacctttaatagttatctaaatgcagagtttgtttatgaaatgaaacaaagcagtttgtcatttcttactataaaatattgaaaatcaagtgcgaaactcagccactattggctaaagaaactaaataaaaaacgttaatgacctagaaaagcaaaagcccattttaaactacttaaagcctctgcactagtccaatgagtcaaaggcaagggagaagtaaacctctaaaactgaagamgaccctctaaaggagaaaactatagaagttaaagtatgcatgcttattatactatgggaaaccaagaaggaagggagagaaaaagaaaaagcacagtctattcatccaggacaatcagtaaaaatctacagtaacctgatcaaccaaaaaatccttaggtgttgtgaaattacattggtcacttctgttatcttaaaacttaaaatgattgtctcatttaaaataaatgattctaaaataatatgattgtctcatttaaatagtaaatgattctaaaataatgtatatccttcttgcctc

SEQ ID NO: 33819 - DNA, 601 bp, Human
tattttcgaattaatcctacagcactcactaaaaactaacagccatggcaccataatacattttgtgaggtacctagaatattactaatggaaacaaaaaatgtgaggtaaaccgacctttccccaagaaactttgaagccagagattttaaacaattaaggcacttgaaaacattaagtatatgtacaaatgtgcaagtaaaacaaacagctgtaccaacgagtaacaaagaaacagtaaatcttcatcttaacaacctttaatagttatctaaatgcagagtttgtttatgaaatgaamcaaagcagtttgtcatttcttactataaaatattgaaaatcaagtgcgaaactcagccactattggctaaagaaactaaataaaaaacgttaatgacctagaaaagcaaaagcccattttaaactacttaaagcctctgcactagtccaatgagtcaaaggcaagggagaagtaaacctctaaaactgaagacgaccctctaaaggagaaaactatagaagttaaagtatgcatgcttattatactatgggaaaccaagaaggaagggagagaaaaagaaaaagcacagtctattcatcc

SEQ ID NO: 33820 - DNA, 601 bp, Human
tacagcagtatctgcctgtgcaacaaatatctgtaaggtaaaataaggtatttgatagaagaacatctgcaagaacaaatcagatgaaaaatctgaaaaggtttctatataccttctggattttaaaaaaacccaaaaattaatggctcaagatactacattgctaaagttaggggaaaaaagtaaaaaggctgtgagttctgttgcaagagctcatttgtagacttgcaaaatctaactaattttatattatgcttgttgttagagcagtgctcaaaattacagaagcttcaaattgttrtgttttcacaaaatttgctacatatgttgacatgaatgtgtgtcagggaattcatacccaggtaaatgacaattacatcagtatagctaatttttgccaccttgggaggaatggaattctgcctattttcgaattaatcctacagcactcactaaaaactaacagccatggcaccataatacattttgtgaggtacctagaatattactaatggaaacaaaaaatgtgaggtaaaccgacctttccccaagaaactttgaagccagagattttaaacaattaaggcacttgaaaacatta

SEQ ID NO: 33821 - DNA, 601 bp, Human
agttcagaaaagactttaattttaaatagatattttatataatttacctctccagctgaaacatcttgttagcttcttcaatgaaattggcaaatatcatcctttccatattattcattttcttttattaattctatcccatgttcttatttatcttccattttgttgaatattagtttgttgtcataaaaattctacagtaaaaatctaattttattttattttttgatctggggactctaggaatctgattgcaatattaagttacttgacagtcaaagtgaccagacctccaagctaygtttatctcatttctcaaaaaaagacacacctctaaggaacaaggtaaaacatttatttaattttttttttaatttcagaagcggtgtatgcttacaactagaaaatgagaaatacaagcagaattaaaaatcaaaatacctgtagtctcatttatataaaaatgtctactttaaaactttatgcttgactgtaggtgtttaagttgtgaaacttattttctcttgcagtgtatatgaaagatcactttccaagtacttttagtcattaatgtaatgactttataatatgcagttgtata

SEQ ID NO: 33822 - DNA, 601 bp, Human
ttacattctggaacacaaaactctaccctaaatgacaaaaacaacagttacttgctctattttcatcttaccttagtgtcaaatcaacagtagcatagacacagctaataaaatgacagttttgattttggaaggcatgtaacataagccacaggcacaacttctcagaagagctgtgatcttttttttttttttttggagatggagttttgctcttattgcctcaactagagtgcaatggcgccatctcagctcactgcaacctctgcctcctgggttcaagcgattctcctgcctcagsctcccaagtagctggggcacacgccatcacaccccgctaattttttgtgtttttagtagaaacggggttttaccatgttagccaggctggtctcgaactcctgacctcaggtgatctgtctgcctcagcctcccaaagtgctgggattacaggcgtgagccactgcacccaggtgtgatctttttaatggctgaaattaatacatttatagttctcctaatcctatttatcaaataggaataaatataagcagactttcaataacaggatatacttagaaacaaagtatctccattttcg

SEQ ID NO: 33823 - DNA, 601 bp, Human
aagcccctaaatctgaacactgtgaatgcacctttctctgtcttcactcttttccctgcaaaacttaaagcgttaatatgtccttcaggaaaaggcaactacaagaatagagaaagagtttacattctggaacacaaaactctaccctaaatgacaaaaacaacagttacttgctctattttcatcttaccttagtgtcaaatcaacagtagcatagacacagctaataaaatgacagttttgattttggaaggcatgtaacataagccacaggcacaacttctcagaagagctgtgatcttttttttttttttttggagatggagttttgctcttattgcctcaactagagtgcaatggcgccatctcagctcactgcaacctctgcctcctgggttcaagcgattctcctgcctcagcctcccaagtagctggggcacacgccatcacaccccgctaattttttgtgtttttagtagaaacggggttttaccatgttagccaggctggtctcgaactcctgacctcaggtgatctgtctgcctcagcctcccaaagtgctgggattacaggcgtgagccactgcacccaggtgtgatct

SEQ ID NO: 33824 - DNA, 601 bp, Human
atggggtttccaatttgactttaaacaaattcatcttcttttggtaagtcttgatgaacgcaggagttaacaaatatgatcactgaaaacgtgatcttattccagtttctaatgaacatattcttgtatttttaaatcaaccatattaaagaactgccgtgtggataaagcaagtcgatactgattctgggtagataataaaaataatttccaaaatcaatgttcaagatatcttcagtattgccaaaaaggcatttttcattcagtttctttcagggtggaaacagtcccaacctagaargctgatcagaagactcccacccacataccagcaattggtatctgcatggctacgtacgcagcttcctctgaatccaggtactactcagtcatcactgctgcttccttggggctgtccaaagcctttggtgctaacaataaaggactagaaacacttcttttcttcacagaagatgtacatcatactacatgtgtttcctctggacagatctcttaggcaattcataaaactcccatacagatgaatctttaaacactcacaggggtttggggggcttttattttaaaggttctattattt

SEQ ID NO: 33825 - DNA, 601 bp, Human
ataatccacgtttaataaagttagttgttgttttaatcgtccaggaaaaacttcagaattatgtcaaaaataattttcataactcggactctatgcataactgaatcttccaagaagctaatattcgtatgaacaacctgtccgcatgaaataagaagttactatatatatttaaggtactactgggagagtaaaacattgtttaaaagaatcatccttgtctgcaaggatctttatgtagaatatatatacaatatatatattctttttttgttttttaatacggagtctcactctgtcrcccaggctgaagtgcggtggcgtgatctcggttcactgcaacctccacctcctggtttcaagtgattctcttgcctcagcctcctgagtatctggaattacaggggccgcgccaccatggctggctaatttttttttttttgagatggagtttcactcttgttgctcaggctggagtgcgatggcgtgatctcggctcactgcaaactctgcctcctgggttcaagcaattctcctgcctcagcctcccgagtagctgagattacaggcatccaccaccatgcccggctaatttttgtat

SEQ ID NO: 33826 - DNA, 601 bp, Human
gaggaccaggagaacaggttctcacctgggctaaggatacagcctctacaacaccaccacacacattagatcctcatttgtaaatgtaaactgacaaccgaggatcaatacacatttaaggaaaacaaaagcaagaaaaagacacacacactcgacaaacagaaccaacccctgagaaacagaatcaatacaggaaaaggagatgaaaggccactgcgtccgtcatggaagcagcagctatcccgaagaagaaacggtgtctagaaatgaatcacattactgctgaggtcagcgcttccgmagacaggctacagaggtgggagacgggagtctgagtggcccactggggtcgcgtgccctcagagcccggagaagggagacgtgcagaacagacagaggagtggcctttcctccctcacctgtctgaaaggctccccacgacacatgtccagcctctgagggatgaggccaatgacatcccagggcccaggcctcccagcttgtccttcacttgatcctagtcagtgtggtccagacagcagaataaagaattagaggaaggatgaaaagttacatccaggaagaactacaggactccact

SEQ ID NO: 33827 - DNA, 601 bp, Human
actggcaccacagcttcctgcaaaggggatctcccacccggaaaagcagactcggggcaaggtaggacaagtgtcccacgtcattcacagccacaatgcagacagcgagcctctggactcaggagacaagctgcctacaaacaccccggccacgtgccacacccagggcagagcgcctctgatgagcaggtgctgaggaccaggagaacaggttctcacctgggctaaggatacagcctctacaacaccaccacacacattagatcctcatttgtaaatgtaaactgacaaccgaggatcmatacacatttaaggaaaacaaaagcaagaaaaagacacacacactcgacaaacagaaccaacccctgagaaacagaatcaatacaggaaaaggagatgaaaggccactgcgtccgtcatggaagcagcagctatcccgaagaagaaacggtgtctagaaatgaatcacattactgctgaggtcagcgcttccgaagacaggctacagaggtgggagacgggagtctgagtggcccactggggtcgcgtgccctcagagcccggagaagggagacgtgcagaacagacagaggagtggcct

SEQ ID NO: 33828 - DNA, 601 bp, Human
catgagggctggaggcgagtgccacttacccactttgaagttggtggtctccagtgtagggcaggtgaacagcctagggaagaccatgtagatggggacagagaggcccctgcacacatccccgtcggcgatctgaatgttctgaatctccgtggcgtcgcgggcatagccttctgcacaccctgcgggagggaggccacatcacgcggtcagggccagcagaggctgcggggtccacatccgcaccggcaccacccaccagtctgctccaagaatcctccagggtcccctcccctcactytccttagacacgcggctactgctaaggcacagccacgctcttacttttgcttccccgacgtcctctcgttttttagagtcagggtcatggtctgctctgctgcccaggctggagtgcaatggtgcgatctcagctcactgcagcctcaaaccaccctcccacctcagcctcctgagtagctgggattacaggggtgcgccactgtgcccagccccccagcatcctcttaaccatggaacgtgagggtggcagtcgagggggacaggcaagcgccaggcctggtggcacggccctcaccgc

SEQ ID NO: 33829 - DNA, 601 bp, Human
acagtcccctgctactgagaaggctcggtcccttcctactgggtctctctgttctacttcttcgtagtgtggagtgatctcccaattaacatgattcttattaagatggaggtcccattacaatatttataggaagagttaaaaacatggaaatgttcatgatacaatgttaagggaaaaaggcagaatataaaagggtgtctgtgacctgattcagatcccatggttaaaatatgaacacacaggttcatggaaactcactagaggcatctaggccgcggggctcaaggccttcctgctkctgagcgctcactctggggttttcacgggtcctggaccttcacacagagccactttctcagtatccacaccaccccccactcctgtggtgctcgttcacgggagttttcttcacggagctcagcgtcacctgcccatgtctacacagagctcagcgtcacctgcccatgtctacacggagctcagcgtcacctgcccatgtctacacagagctcagcgtcacctgcccatgtctacactgatgtgggtctgtgtgtttccccatgtgacagtggaagtcccacaagcaccaggactgcct

SEQ ID NO: 33830 - DNA, 601 bp, Human
catgttttcccctcatgtaactttgcatttaaatatattctgggaaactgctgggcacagtggctcacacctgtaatctcagcactttgggaggccaagacaggaggatcacttgagtctaggagttcaagaccagcctgggcaacatagggagaccctgtctacaaaaaatttgaaaattagctgagtgtggtggcactcacctgtagtctcagctactcaggaggctgaggggagggatcgcttgagccagggaggttgaggctgccgtgagctgtgatcctgccagtgcactcagccygcgtgacacagtttggaaaactgtctctctctatgtatgtatctgttcagggaaatggcagcgtgagattttatggcagttcttgagacttcagaaacacttcggcaccagccaaatccccccaagagagcaaggaacacttttccagttgcttaaaaaatttaaagttataatgaaaaatgttgtaaaaagaactacagaggctgggtgtggtggctcacacctgtaatcccagcactttgggaggccaaggcgggtgggtcacgaggtcaggagttcaagaccagcctggccaagatg

SEQ ID NO: 33831 - DNA, 601 bp, Human
gaccaaattcatcaagtcaaggaccttttcctgctaccaccttgcggagaggggccttcaccagcccaccctgcacatgggtttctgctgttcagaacctacccagtaacaacaggagcaaacatacatgttttcccctcatgtaactttgcatttaaatatattctgggaaactgctgggcacagtggctcacacctgtaatctcagcactttgggaggccaagacaggaggatcacttgagtctaggagttcaagaccagcctgggcaacatagggagaccctgtctacaaaaaatttraaaattagctgagtgtggtggcactcacctgtagtctcagctactcaggaggctgaggggagggatcgcttgagccagggaggttgaggctgccgtgagctgtgatcctgccagtgcactcagcctgcgtgacacagtttggaaaactgtctctctctatgtatgtatctgttcagggaaatggcagcgtgagattttatggcagttcttgagacttcagaaacacttcggcaccagccaaatccccccaagagagcaaggaacacttttccagttgcttaaaaaatttaaagttataat

SEQ ID NO: 33832 - DNA, 601 bp, Human
tcccgaaatgaaaggttttagtatgtattgaatgaaaaaggattttatggtcaactaagtaagggaaagctggtttaaacaaagacaaaagtgttcctttattgtaggagttttcagattatgtaatatgcttatatacattttcagaagttagtagtatgcagtgttcccagactcatttgttgacaaaattatctttatggaaataggttttgaatgaaaaatgtttcggcaaacacactgagtagaattatagtagtagactgtatttcctattcttcaacctgccttctttgttaayatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaag

SEQ ID NO: 33833 - DNA, 601 bp, Human
atcttataacaatttttgatagttctgacctttcctttgcaattcagtgcagtaggatactgaaactgacattatttggtgagtagtaaactttctaatgaatttactattttattcattgtattttaaagatgtttggcttttttccttttaaagactcaggtaagcaataacttattcaaatattattacatttatttgtgttcaggtagttgttttagattacttgaagcttatggctgtgtatgtttttaagaaaatgatagaagtttaattcagtaagaacagagtgttaagtatgttttttttgaaatcaggtataacttaggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaatagggttcacactcctatgtgaa

SEQ ID NO: 33834 - DNA, 601 bp, Human
tggacagaatatgtaacccaaatttccctacttttggagacaaaatatggttttaaataagtcaaagaagaaataataatgggaattataaataagtagataatgacttctgtgtaaccaagtttttagagaatgctaaagctgtacttagagtagtacttacagccttaaatactttatattagtaaactggattggaaatttttgagcaaggtattcaaacagttacaaaaggacaaacctcaaataacttggaaggaaataataagagcagacgtgaactagaaattggaattgttargatcaacaattttgaaaagatgcagttggcaaatctttatgaggattagttaaggagaaacaaggcacaaataagcaatgttagaaatgaagtttatagtagaaactttaaaaatttatatataccatgaattcctttatttaaatttgaaaactcaggtgacatggacagtatcctaggtaaatttaatgtactgtttcaagaagtagaaaaattggttgccccaattaacattaaagaaattgggccaactattttaccaaatatctaaggaacagatgattctaaattatacaaact

SEQ ID NO: 33835 - DNA, 601 bp, Human
aacacagtttttaataataattaaagaaaaactaattttttccccattgtataatgacatgtactgtttgtgttaagataaagcaaaatgtgtcaacatttggaactgacataattttgggaccgaatgtattttaaaatgtggactgaactttaagtatgtgttaatgacttgaaagtacagttaaaaaactgctttcttcttttaagattcttagatgttgcatttaaagaaaactcttattattatttttttctttttacaaattctttgtttgcttataattttcatagtttaaaastgtccatattgtgaaatagtaatttaaaaaaagtctagactggatgactgcatataaagggcttaacatgagataatttttgtggataaatggtatgtattctatttttggccactaaatattttggaagtttttgttttctatttttattttagttacagtttaaataaagatgtattttccatcatttctctcttcctgtcttctaatagtcatatggaattatgttaatgatagatgtttaataaatatttggtgattgattattcctagttgcacttctatttcagaacataatgg

SEQ ID NO: 33836 - DNA, 601 bp, Human
gttagctttttacctatgttaatgtaaaaggtgttaaaattggtttcttctctgcattttggaaatcatgccatatgttgttttcttgtatggccattttctagttattgtgtcctgtctgacatatctgatgataagatgatataagaataatacaatctgcattatatttttagagatagttcttatttttttagaaaacaaaaacaacaagaaaaccatacatcagaaactgaaatctagtccacaaaatgaaattgccaatcagctatcagtgctatttagaacctgtggcttaccytcaccaagaaatgtggccacctgtggtcttcagctctctattacagcggttcttggatgcttgttttcctttaagaggcaaatgatgtgtaaactaccttagatagaagattgacctgttgcagtatctccagcagctaatggagcaagtagtaggacgtatagtatgtttcctgatggttttagtttgtgataagtgaaaagaggcataggtagtgagatgtgaggggaaacaacttgtaagactgacgtggtatgctcttgggattagaggaaggaagttggtagggaagatagataa

SEQ ID NO: 33837 - DNA, 601 bp, Human
atgtcagcgtttggcttaacagatgatcaggtttcaggtaagttggtttccaactcctttacacccttcgtttccttcatctttccgttcttccctttccttctttctttaattgaagaataacttggatatggtgaagtgcacaaatcttaagggttctgcttaacaaatttttacatatgtgtacacttatgtaaaagactaactagattaagatgtagatgatttccagcacttcagaaagctttcttatgtcctctccccaagagtagcaccctcccccttaaagaataagcactgytgggttcaagtaaatttttgaaagtaaaatttagaaagtttttaaaaatctgaactattttataatttgattagttgcagtattcgaattatatttgatttgtcttatctcctcatcttagagaaattgaaaattaaatgtagattttcttgttaaattgcttgagtatacagtgggtttttatataaataagtttttaaccttaaagcagtacctatattgttttattctgtttaacttttggttataatttcttcattattttttcctgctttttctcttttcggattctaataacac

SEQ ID NO: 33838 - DNA, 601 bp, Human
agtttctgtttttctgttgagattctttattttacattcattaagtctatattttcctttaattgtttgaatgtatttatgtttgattctttaaaaatatttagctgctttaaaatgtttatctgcaatatgtaacacttggacccatttggagtcagtttctattgactgggttcctctcccccacacacactccccccaactccagtagggtcacatttttctgtttctttgcctgtctgatagtgtttggttgaaaactagacattctggttaatatgttgtagtgacttggacttayattcttttgaggattttctgttattgttgatctagcagggagttgatttgtatggacttaacataaataacaaacagaaaagcgctctctaaaagaaaaaggtatttgggaatagagcattgcattgaaaatatgcatgccatagtaaactatgtgcatattcagtgaggtaaaggcagacaaaggtttttaaaggaaaaaatgaggagaatatataattgttttgaaataattattgttggctacaaagatcattagcaagagtgatgccagtctgaggttggacaggcagtttctggg

SEQ ID NO: 33839 - DNA, 601 bp, Human
tatacttattctatagtacttttagtatcttttaaccaaacttattccttgagcttgctgggggaaggccttgtgttggatactaaactgacttttttttgactatccagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtaaaatagagtttagaacacatgtttgggaaagtacatgtgtagaagtgtttattacagcattgttgtaaacacttcatgtatttagtcatgccttaaacacaggaaaaattttgatttactgacatgatttgatgttaaaaaaccaaatagaacaatatgtcaggtatgtttccaattattggaatgaaaaaaatacctcaaaaaagtgtttctatgaatatagatacagagtgaaagaccagtcattagtcagtggtgacccttggaggggaggatagtgaagttcagactggtgatttcacactttattttgtgttatagatgctattttatctccctcctttctt

SEQ ID NO: 33840 - DNA, 601 bp, Human
cctcattgaaaaccttggagttctgcagaatgtgactaagtacttaactaatctctagggtgccttccagataatgaagtgtgatttttgtattgtctatgtgtgttgggacctttaaagccgcattccacttcaaaacaaacaccaggtggtgctctaactatttgtttaacgggtcagatagtggtataatgtatttccagccccagaagcaagtgattaaggttatcaattacattaaaacaaaaacaaaacataggctaaaatgaactgaccacttttggaatagaatcctatcatyctgtggtgatactttcagagttacctggctaggtgtggtgcctcacgcctataatcccagcactttgggaggccgagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactcca

SEQ ID NO: 33841 - DNA, 601 bp, Human
tactttttgttgtataatgagtctttgacattgtcagttatttagatcaactactggttataatttgagcagaattaccaacataaaatgtattacttataatttgttaacatagcaatctcttacaatgtgttaatagtccatactaaaattaagaattctgagttgttacttaactcccataaaagggactttggaactgtgaattttattccaaataaatgtagtcttaatatgtttttcagttaaaaggatcaacaagatattgagcatcattaaaaaaaaaccaaaagggataatrttactctttttcatataaagccagtgcctgttacaggaagactatgtgatgttgccagaaatgtaactggtaaggagaagaacgctaaaaatcatcagagatcgggagatattgctgtttgacagcctaaaaaaatgaaaaagcatataattaaaatctttaaaatcatatgccaatataatgaaaagctgagtagcctttattatgtaaatattgaaacatacatagaataatcaactcttcatgtagtcatgtggcttcaacacttaccaatattttggcattcttttttcatcattt

SEQ ID NO: 33842 - DNA, 601 bp, Human
acagtgattctttttatttttaattgtgacagggtgtcactctgttgcccaggttggagtgtactggcttgattacagctcacctgcaacctcaacagtgattcttaatgtcaacgtgtgctagtctgtgtttgaatttccctaattgtttcaagattcgtttgttaaattgacttgttcaaatgaggggcctaacaaggttcacactttgcattgttaatgtgtcttgagtcgttttttctaatagccattagaaaaaacttacatgtttctaaaatcccttacatgtttctaaaatcaraactatgtgtattatttattactgtgtaactattatcccaaaacatagatacttagacaacaaaagttaattatctcatacagttttagacagatatcccggaatggtttagctgggtgattttggctcagcatctctcatgaggttgcagttaaaaatggctgctggggttatagtcatctgaagcttaaccagagctggaggattcagttctttaccatttggacttctccatggggctgcttgggtgacctcatgacatgacagcttcaccagaatgagtaatcagaagagagtgag

SEQ ID NO: 33843 - DNA, 601 bp, Human
gttttttctaatagccattagaaaaaacttacatgtttctaaaatcccttacatgtttctaaaatcaaaactatgtgtattatttattactgtgtaactattatcccaaaacatagatacttagacaacaaaagttaattatctcatacagttttagacagatatcccggaatggtttagctgggtgattttggctcagcatctctcatgaggttgcagttaaaaatggctgctggggttatagtcatctgaagcttaaccagagctggaggattcagttctttaccatttggacttctcyatggggctgcttgggtgacctcatgacatgacagcttcaccagaatgagtaatcagaagagagtgaggtagaagataaccttttatagcctgtcctcagaaatgtcactgtcatttctgcaatattttcttggtatacaggtcagccctattcagtatgtgagggactaacagggagcagatactcatgtgcttgttgcttatttggtcatttttgtattgtggagttaaatctttctaatttctaagaatataaacgataccaacccattgtcataaatgctatacatgtgcagaagcc

SEQ ID NO: 33844 - DNA, 601 bp, Human
tctttttgaaaatatacataaaacatagcttatatatagtcatgcactgtataacatttcagtcaacagtggactgcatatatgatggtggtctcataagattataatggaggtgaaaaatttctattgcctagtgatgtgtagccatcataatgtagcacaaggcattacttacgtgtttgtggtgattctggtgtaaacagacttactgccagtcatataaaagtgtagctcacataattatgggtagtacctaatacttgataatgatgataggtgactctcttactcatttgtgaakttactatactatatttttaaatcattagagtgtactcctacttatttaaaaaaaaacaaagctgtagaaccaggctcagataggtccttcagaaggtattccggaagaaggcattgttatcataggagatgagagctccatggatgttcttgaccctgaagaccttccagtgggacaggatatggaggtggaaaatagtgatatcaatgatcctgatgctgtataggcctaggctaatgtgtatgtttgtgtcataatttttttctaaatgtttaaaaaagtaaaaatttaaaattaaaa

SEQ ID NO: 33845 - DNA, 601 bp, Human
ataaatatttttgtatagtagcacaatgtactttaagctaaagtattaaaaaagttaaaaaatcaagtttataaagtaaaaacattacagtaagctaaggttaatttattgaagaaatggaattttaaaaaataaatgtagtatagcctaagtgtatagcgtttgtaaacctttagtagtgcacagtaatgtccttggccttcacattcactcaacacaagtacctcacttggagcagcttttaatcctacaagctccagtcatggtaagtgccctaggcaggcataccattttttatctkttttgccatattttcactgtaccttttttatgttttgatatgtttagatacacaaataattaccatgtgttagaattgcctaagtattcagtacaggaacatgctctacaggtttgtagactgctatgtaccatatagcctagctatgtagtaggctatatacatctaggtttgtgtaagtatactatatgattatacagtgacacaattttcagaacctactcttgtcattaagcaatgcatgaccatattttttattactcaaaacattgcttactataaacaatgtctgcattttgc

SEQ ID NO: 33846 - DNA, 601 bp, Human
ttagacatgctaagtaacctaacatacacatctttgggatgtgggaggaaattgaagtgcccagagaaaacccacacagacttggggagaatgtgcagactctacacagaacagtaaccccaactgggaataatttttttttccttctcagtgttttaacgaaacaatgtcgaacaaaagatgttatttgaggatctgctgtgtaaaaggaatcttgtgtagagatataataaacctctgaaatttttaactctagggatgtttttcaaaatcaatttatagcagtttatgaaaacatgcaaaaaaaaaaagctttatgaagagttgtaccctataaatttttattgaggggaataactgtggttttgaccaggagttccttactcattgatgaccacagtctactactacgtggaaccttaatctcagccttttttgatgatgcccaagttaatatttatattgttttgttcatgggataatatatgcaaaatgactttataaactaaagctttggagttatgcctgagttccagtgatggttcttagctcttcatggttctgttcttagctattgactgcaggtaagttgcttaatttt

SEQ ID NO: 33847 - DNA, 601 bp, Human
gtaccaacagtaccagcaacaggccggctatggtgcacagcagccgcaggctccacctcagcagcctcaacagtatggtattcagtattcaggtgagcaggtgttgaaagggagttggctcatggttttttgtttctatactcattaaactttaagttcttaattccttgatttgtagtacattgatataataggtattaagtttttattaggggaaacaacatttgttttatttatttttaaatattttacattaatattgtaaatcaacatttcagttttctggtggggagataaaacytacagtagatgattctgcagtaacttgtagtataaaaagtttttaatacaaagctgtcttactaacattatcagtttatctcttaggcgacttagtgcaagttttcccccttccctccacctctccatttatatgtaacacgtaattccagtgtactcttagtacctgtagaaatatgaacagtttactatacatggaaaggtgatgttatttaaataagagctcaattaagctacttagattttaaaatctcttgcaagtatgtaggaataccagaaataggccataaaaataaaatcg

SEQ ID NO: 33848 - DNA, 601 bp, Human
gggtcttcactctgagtaaaatttagtcttttcaaattattatctttgtatttctgatcctactagtctattaacttgaatttgattgagagatatggaaatagtcaactaaatactctgcttggagactaagaggtggtggtggtaacattggaccatctttgacactgttggtttgccagtttccctctgaccttttccagttttgttcatggactatgtcataaaggtttctttcatgagtaaattttgaacccaggttcaaggtgagttcagaatatactcaaattcattcaatcctttttttttttaatgcagggttgtacatattttaataattttcttatgtatctggtatttaatgctgacaggattccagtcaatggagaggtttcattgcaagtagctgcaggtgtgtttcatggtagagataaaagttttcagtgaagcagactttcgttgtaaaaaaaattacatcctagtaaataatgaatatagatgttgctttttatggggcaatatggtatgctttttatgtgttatgctgtactgctaagtaaaaattttgagttgtaaaggcaaaaaacatcagataccaaat

SEQ ID NO: 33849 - DNA, 601 bp, Human
ggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctwgggtgaggtttagccatcttacttggctttttactattaacatgatgtactaaagtagagccctttgagaatacaagatattatgtataaaatgtaacactgatgataggttaataaagatgattgaatccattagtggtcttgaaattttaatttagtcactaacattatgtgaaaaaaggaacaatttttcagaagtccttattggtgtttggtcttaaaatgaagtataaacattttaactaacttacagatttccattcagagaaaacagtgccatttggtttttgcccttccttt

SEQ ID NO: 33850 - DNA, 601 bp, Human
acatttatataagattgtttcatttttatgaattcaataaaattgtggcagtgatccaaattatacattataggttatatatcatattaatttcaactctctattgttcatgttgaactcttactggggccaaaacaaatataatttcaggaaaagttataaaaatactctaataataaaagctttcctggtagtcaaggctgaatacatgatttctgatgactaagactgaccctaaaaagtgttatctaatagatggaatcacagtgctttgttcttttcatactcattcaatggcagyttttatgtggtttgagatggctatttccttttattcattaatatatatgagagagcacataggttagttgcataattgttaggacatttagaatgtgtccttctattctacaccaccatttggtccaataaatttactcttttgattgtacttttagtaagattgctttctgctatttgactataaatatgacatatgtgtataaaacacttatatgtatttttagttttactgtttttattttaatcttcctagagataaacttgaaaaataactattttttccaaagaagcatataaa

SEQ ID NO: 33851 - DNA, 601 bp, Human
taatataacatagccatagggatgacaccaaggggtgaatgagggttatggggctcaaaattctgtctaccacatatgatggagctcttcattttcctctcacattatgagattctctattaagtgttcagtttaattattcttttagatattaaattttaaaggtaagaccaaattaactttttaatataaatgataaaagtttacaaatatccaactatctgttacccaaaaattaatctttcagagtaaaaagaatttagttatggaaataataaattgaaaagttacctttcgccastgtctttgtttctggtttttcttttttctcaattttttccttgtgagttgcttaaacagaaaattttacattagtacacatttttaatagatttcaaaaccaagctttcttttgacctcagtttcataagtgctaaaacctaatctgtaatattttgaaaatgtatgacattaataagtctaattcagaaataaagagttaccagtgtaataacagttgtattgaattcaatgttaaagtctaggcattaagacttagcaagcttgttgaaaatcagatctactctttctcaagtcatta

SEQ ID NO: 33852 - DNA, 601 bp, Human
tggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggcaaaagtactcatacttcaaatctctttgttctctgctgaatctgtctacatttaaagactcatgatattacattgagcccacctggataatccaggataacctccctattttagaacaatcttcactgcctctgcaattttttttttttttttgccatgtaatataacatagccatagggatgacaccaaggggtgaatgagggttatggggctcaaaattctgtctaccacatatgatggagctcttcattttcctctcacattatgagattctctattaagtgttcagtttaattattcttttagatattaaattttaaaggtaagaccaaattaactttttaatataaatgataaaagtttacaaatatccaactatctgttacccaaaaattaatctttcagagtaaaaagaatttagttatggaaataataaa

SEQ ID NO: 33853 - DNA, 601 bp, Human
gccacttaaaataacacccatttattatcttccagtttttatgattccaaagtgttggctcagcatggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggcaaaagtactcatacttcaaatctctttgttctctgctgaatctgtctacatttaaagactcatgatattacaytgagcccacctggataatccaggataacctccctattttagaacaatcttcactgcctctgcaattttttttttttttttgccatgtaatataacatagccatagggatgacaccaaggggtgaatgagggttatggggctcaaaattctgtctaccacatatgatggagctcttcattttcctctcacattatgagattctctattaagtgttcagtttaattattcttttagatattaaattttaaaggtaagaccaaattaactttttaatataaatgataaaagtttacaaatatc

SEQ ID NO: 33854 - DNA, 601 bp, Human
tggtcaaaaattgtgaaccaaatatgttattttagtttttttattgctgtggtaacaaattaaaacaaacttagccacttaaaataacacccatttattatcttccagtttttatgattccaaagtgttggctcagcatggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggyaaaagtactcatacttcaaatctctttgttctctgctgaatctgtctacatttaaagactcatgatattacattgagcccacctggataatccaggataacctccctattttagaacaatcttcactgcctctgcaattttttttttttttttgccatgtaatataacatagccatagggatgacaccaaggggtgaatgagggttatggggctcaaaattctgtctaccacatatgatggagctcttcattttcctctcacattatgagattctctattaagtgttcagtttaattatt

SEQ ID NO: 33855 - DNA, 601 bp, Human
aataactagagagtgaatttggaatgttcccaatgcaaagaaataataaatgtttgaggtgatggacatcccaattaccctgatttgatcattatatattatatgcttgtatcaaaacatcacatgtaccccataaatatgtacaacaactatgtacctataaatattgaaaataaataattttttaaaaagaaaattctgaatttgagattttaaaatcaaattcaaggtataatactggtcaaaaattgtgaaccaaatatgttattttagtttttttattgctgtggtaacaaattamaacaaacttagccacttaaaataacacccatttattatcttccagtttttatgattccaaagtgttggctcagcatggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggcaaaagtactcatacttcaaatctctttgttctctgctgaatctgtctacatttaaagactca

SEQ ID NO: 33856 - DNA, 601 bp, Human
gactatagttaacaataatttattgtatattttaaaataactagagagtgaatttggaatgttcccaatgcaaagaaataataaatgtttgaggtgatggacatcccaattaccctgatttgatcattatatattatatgcttgtatcaaaacatcacatgtaccccataaatatgtacaacaactatgtacctataaatattgaaaataaataattttttaaaaagaaaattctgaatttgagattttaaaatcaaattcaaggtataatactggtcaaaaattgtgaaccaaatatgtyattttagtttttttattgctgtggtaacaaattaaaacaaacttagccacttaaaataacacccatttattatcttccagtttttatgattccaaagtgttggctcagcatggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggcaaaagtactcatacttcaaatctcttt

SEQ ID NO: 33857 - DNA, 601 bp, Human
tattacagaggtgagccactgtgcccagccaattatttctttttgatgcaagaaaatcatttatggtgcagaagttgtctatttgtctatttttgctttggttacctatgcttttgaggtcttactcaagaaatctttgtccataccaatgtcctaaagtgtttccccaatgttttcttcaagtagtttcatagtttcaggtcttacgtttaagtctttaattcagtttgatttgatttttgtatatggtgagagatagaggtctagtttcattcttctacatatacagttttcctagtamaatttattgaagagactgtcctttcctcaatatatgttattggtgctcagtagcaaaatagaatgactatagttaacaataatttattgtatattttaaaataactagagagtgaatttggaatgttcccaatgcaaagaaataataaatgtttgaggtgatggacatcccaattaccctgatttgatcattatatattatatgcttgtatcaaaacatcacatgtaccccataaatatgtacaacaactatgtacctataaatattgaaaataaataattttttaaaaagaaaattctg

SEQ ID NO: 33858 - DNA, 601 bp, Human
aaaagccatttatcaaagatggtgcaactaaatgagttaggagtagaaagagtagaatcagaatgactaacccaatttctaatcacagtgaattgcacacgtattaatattaacctaaaaagatgatacaaaaactgtattttaagacatataagggcagatataaatatacatgaacgatgtgaaagtgataaaatgtcttcctgaaagtgaccaaggcagcaataacctctgccacatcatcaaacacacagacatctgaaggtcacactgacatccacatcaattagacagcctggcycaaacttggctcacctcactcaacttctcttttcatcattgttttcttctttttcttctaccttgtctctgttgtttttaatgaactacagaaataggctagatttctcagtggatatggggtcctacatatgtatcaaggtagacattaaaggtctactcttccccaggaggaatccctgaagtgttctaaccaatggctgcctttcagcaagcagtatgcaacagagcaagaaacatgctgtgttctatgcaagtgcctccagaaatcacagctcttcaaagggagattctactttaa

SEQ ID NO: 33859 - DNA, 601 bp, Human
ttatatctgcataatctgcatgtctagagctcttggagtttccctagaacttatccacagtttaatgtacagcaggaattactatttcattattattttacatttgaaaaatctaagtatcaaaaagccatttatcaaagatggtgcaactaaatgagttaggagtagaaagagtagaatcagaatgactaacccaatttctaatcacagtgaattgcacacgtattaatattaacctaaaaagatgatacaaaaactgtattttaagacatataagggcagatataaatatacatgaacsatgtgaaagtgataaaatgtcttcctgaaagtgaccaaggcagcaataacctctgccacatcatcaaacacacagacatctgaaggtcacactgacatccacatcaattagacagcctggcccaaacttggctcacctcactcaacttctcttttcatcattgttttcttctttttcttctaccttgtctctgttgtttttaatgaactacagaaataggctagatttctcagtggatatggggtcctacatatgtatcaaggtagacattaaaggtctactcttccccaggaggaatcc

SEQ ID NO: 33860 - DNA, 601 bp, Human
gcacaatgcttctttcagagaaaacagaggataaatgtatactggattagcaattttgatggagagagtaaatattccactatactcagatcatatgtataatatagtgatatagagactgcattatgtaaatatgtgtttagaaataaacttgtctaaacctgttaaacttgccaacttttttttttgtttatactaatttgtatgaaattgttatatttgcttactctaaatgacagctatctactccttgtaagttacagttgatttaaccttaactttatagtatggaactatagaygtgtgaaattcagatttctttttaatgccattataatttataagtgggcaatgattattttctaagaggtagaaccacatatatagccaactcattataatcattgactttaagtataaaaataataaaatattttctactattttagacactcttcaatcacattcactctggaaatagataactttgcctcatagtagaaaaaaatgagtgacaactaaacaatgatgtggctataataaagaaaatatcatgaaactaaagcaacacccaacttctatttacttttgagtacacatt

SEQ ID NO: 33861 - DNA, 601 bp, Human
ctctaaaaatcagcataataataaaactacctgaataaattttagcacagcaaaattaaaaccgtgcaatatctggcttcctcctatctcccatgttacagcacttttccaaaaatttattcctctactggactgctttctttcttttgaatattttatgtatttttccatgtgtcaactgttgtcagactgcattctctatattttctatatttttccacatatttaaatttctttatttcttttttatttatttttgtctttttgtttttttgtttagatagactcttggctctgttgmcaggctggagtgcaatggtgcaatcttggctcactgcaacctctgcctcccgggttcaagcaattctcctgcatcagcctcccgagtagctgggatttcaggtgtgcaccaccaacatcagctaatttttgtatttttagtagagatggggtttcaccatgttggccaggctggtcttgaactcctgacctcaggcgatccacccgcctcggcctcccaaagtgctgggattaaatttcttcatggtcaattcacatgcaaaaaaatggctctcccatttgaattaataatgtcttccca

SEQ ID NO: 33862 - DNA, 601 bp, Human
ctggaatgtttattagtgtctgtctggaaagaaagtttcactggagtggtcaacagcacctcaatctcatgcaactcattcacctaaaaaacacttctagagagtctatgttgacctgggctcacagctagttgctggagctctaaaaatcagcataataataaaactacctgaataaattttagcacagcaaaattaaaaccgtgcaatatctggcttcctcctatctcccatgttacagcacttttccaaaaatttattcctctactggactgctttctttcttttgaatattttatgkatttttccatgtgtcaactgttgtcagactgcattctctatattttctatatttttccacatatttaaatttctttatttcttttttatttatttttgtctttttgtttttttgtttagatagactcttggctctgttgccaggctggagtgcaatggtgcaatcttggctcactgcaacctctgcctcccgggttcaagcaattctcctgcatcagcctcccgagtagctgggatttcaggtgtgcaccaccaacatcagctaatttttgtatttttagtagagatggggtttcaccat

SEQ ID NO: 33863 - DNA, 601 bp, Human
atgaagtcttgctttgtcatccaggctgtagtgcagtggcacgatctcggctcactgcaacctctgcctctcagtttcaaggaattctcctgcctcagcctcccaagtagctgggattacacgcgcctatcaccaagcccagttaattttgtattgttagtagagatggggtttcacatgtccataaactttcaacatctttgtggcttctgtaactacactcaggggattttcttcttcctataaatcatttctaaacctcctttgctggtttctgctctttcctgcagtaaactcataygtttctgtgactgaaaccagcagctttctgcggatgactttaaattgaaatcattccagaattccacactggaatgtttattagtgtctgtctggaaagaaagtttcactggagtggtcaacagcacctcaatctcatgcaactcattcacctaaaaaacacttctagagagtctatgttgacctgggctcacagctagttgctggagctctaaaaatcagcataataataaaactacctgaataaattttagcacagcaaaattaaaaccgtgcaatatctggcttcctcctatctccc

SEQ ID NO: 33864 - DNA, 601 bp, Human
gtattgcacttaattgactacgccagcacttcccaaaacactgtttctcagatacttcagatatttacaggaagatgttgatactgtattaggtattggagaatattctcatggccaaattcatttggcaacaataagctaacctggtcgtttagcttggactttctcaaagctgaagtgtattgagaatttttaagaaggggaattatgatacacacattattcaatattgtttaatcataaaattctcatacaaatattactcaattactctataaacttttttttttttttgagatgragtcttgctttgtcatccaggctgtagtgcagtggcacgatctcggctcactgcaacctctgcctctcagtttcaaggaattctcctgcctcagcctcccaagtagctgggattacacgcgcctatcaccaagcccagttaattttgtattgttagtagagatggggtttcacatgtccataaactttcaacatctttgtggcttctgtaactacactcaggggattttcttcttcctataaatcatttctaaacctcctttgctggtttctgctctttcctgcagtaaactcatacgtt

SEQ ID NO: 33865 - DNA, 601 bp, Human
atttaatgaaaaaatgtaatcaagtttcttgactttggtaccctaaatgatgatttcaggctaagccaagataatatcagaaggtcccattgagagaatgaaaatgataatgccagatgctggttagcttgcaaaccaaaaatcatctgtggtattgcacttaattgactacgccagcacttcccaaaacactgtttctcagatacttcagatatttacaggaagatgttgatactgtattaggtattggagaatattctcatggccaaattcatttggcaacaataagctaacctggtcrtttagcttggactttctcaaagctgaagtgtattgagaatttttaagaaggggaattatgatacacacattattcaatattgtttaatcataaaattctcatacaaatattactcaattactctataaacttttttttttttttgagatgaagtcttgctttgtcatccaggctgtagtgcagtggcacgatctcggctcactgcaacctctgcctctcagtttcaaggaattctcctgcctcagcctcccaagtagctgggattacacgcgcctatcaccaagcccagttaattttgta

SEQ ID NO: 33866 - DNA, 601 bp, Human
gtcattaaggaaaattggaaaagaaagagggaagaaaggtaagtcacaagtgtttatgttaagaacagtatttttcaggaaaacaatgaaaaatactgttcttaacataaacacttgtgacttaccagagttttatacagtttatgaagtgctatattagatagactactaaaagtgttatggcttttaatttgtacatgaaaacactattttttaaggcaatagtaacttagcatgtcaacaaggaggcatttgtagcatgcaggggatggatgtacaggaatttctgtgaaagacaatktccataccaaacagcccagtgaagtagtctccttttataagcacatgatcattttgcttgataactgaaagatcttaagggtcattcaagaaactgaaatgccaacaaagtcttttttaaagacaacaattagtaatgcaagtgtaaaattatcgcattggtgttgactaacagaaataaaacaatgaaatccattagaagataactgaaagacctatagtctaatgatttggccttagaaaaactgaaagtgaagaaattcagatattggctcctgtttatcttaagtcagcgataatt

SEQ ID NO: 33867 - DNA, 601 bp, Human
ttgaaatacttttgtttatttacaaacataatgtttcatctgtactatgtcattaaggaaaattggaaaagaaagagggaagaaaggtaagtcacaagtgtttatgttaagaacagtatttttcaggaaaacaatgaaaaatactgttcttaacataaacacttgtgacttaccagagttttatacagtttatgaagtgctatattagatagactactaaaagtgttatggcttttaatttgtacatgaaaacactattttttaaggcaatagtaacttagcatgtcaacaaggaggcatytgtagcatgcaggggatggatgtacaggaatttctgtgaaagacaatttccataccaaacagcccagtgaagtagtctccttttataagcacatgatcattttgcttgataactgaaagatcttaagggtcattcaagaaactgaaatgccaacaaagtcttttttaaagacaacaattagtaatgcaagtgtaaaattatcgcattggtgttgactaacagaaataaaacaatgaaatccattagaagataactgaaagacctatagtctaatgatttggccttagaaaaactgaaagt

SEQ ID NO: 33868 - DNA, 601 bp, Human
cttagttgagctaactcaactaagtcatcatataaaattttcaaaaccaaagcctcagaaattaaaaaaaactatatctttatcttgcttagctaaaatcataatgtaattagttttctttaatttaaaaatgctcttaattaaatctttgcttagtaacaaaaaatgaaaaataaaatgacatatttatatgtctgatctgccattagaggttaagttttgaatacttacctaatgatacatttatataattgatggcaattgttctcaatactgagacttgctttagcaattgcaattrtttagctgataaaatcacatttgtgcttttgttttaaactctaaatgatatttgaatgtccttttaatagataaataactctttgtgtagaaataaaaatagtagactgaaaaggaatatggtaatataatgctgtctttaataaatctgattactgatagaaatgaaatacaatatttgtggcctggaaaataaacattattttaaagtgttccggtgatgagtttttatcaataaaatgtggctcccaaatccccaaagatatgaaaaattaacatcaaaaaatacattcacattcct

SEQ ID NO: 33869 - DNA, 601 bp, Human
gagttgtcaaaatacagatttttgggctccatcatccaaaaaaaattaaaatgccatggatctggaccctaggaatatgcattttatacaaactccttagatgaatctaattagactgcatttacagaatcactgatctaaaacctttcattcctttttcccaaaataattactcttagaggcactatagactcccatgacagcaaataagagtgtttgtttttatgtatgttggaagtttagaatgcagggagtatttttaatataacatcccctccaaatgaaatattatctgccccaygttgtgatgggatagttatatacataacatgttgaagagtgtactgaattaattaaaatcttcacgcttcagagagtcttctttagctgaatgctgacaatgtaatgaaacttttcagcttgtatgttgaaatattatcaaagtacagtcagccctccatttccctgggttccacattggagcattcaacaaaccacacgcctgtaatcccagaactttcggaggctgaggcgggaggatcatttgaggtcaggagttcaaggccagcctagccagcatagtgaaaccccatctctacta

SEQ ID NO: 33870 - DNA, 601 bp, Human
ttttccaaaagactatcaggagaactaacctctttgcaacctgttaggtggcctctgaataaaaatgctctttaattgggagagtaaatcaagaacagagtaacagaaccaaatgatattgttgttaaactaatcaaatgagtaatcttcttaagatcatcttatgatcttgactagtttatggcctatggtgaaagtaaacaaacaaacaaaaaaaacatagtatgtaaacatcattttgggcagacctggtcttcaggagttggttttttttctattccctctagattaaagacattgyacttaactttaaatcctcacagaactttagattctcctgaggtcaatccaactcaaagctcaattgatgaatctttaccgtatctgctttaaagcatacatattatgaaataatttacatttcaatattcctgaaatatgcattttattaatccaccaaatccgaaggcagctttaggaccaagagagtttattgaatttaagcaacatgttacattcttaattgctccaaattatgcatatcaaacatatgaaataacaaagcttgttactaaacagatacacctctaaggatttttgt

SEQ ID NO: 33871 - DNA, 601 bp, Human
aaattgtttccaacttggagtgttttatcaaatactcagttccagcccttctgctaattgtctctatggagcagcagaatgtcttttccaaaagactatcaggagaactaacctctttgcaacctgttaggtggcctctgaataaaaatgctctttaattgggagagtaaatcaagaacagagtaacagaaccaaatgatattgttgttaaactaatcaaatgagtaatcttcttaagatcatcttatgatcttgactagtttatggcctatggtgaaagtaaacaaacaaacaaaaaaamcatagtatgtaaacatcattttgggcagacctggtcttcaggagttggttttttttctattccctctagattaaagacattgcacttaactttaaatcctcacagaactttagattctcctgaggtcaatccaactcaaagctcaattgatgaatctttaccgtatctgctttaaagcatacatattatgaaataatttacatttcaatattcctgaaatatgcattttattaatccaccaaatccgaaggcagctttaggaccaagagagtttattgaatttaagcaacatgttacatt

SEQ ID NO: 33872 - DNA, 601 bp, Human
gaggaaattgtttccaacttggagtgttttatcaaatactcagttccagcccttctgctaattgtctctatggagcagcagaatgtcttttccaaaagactatcaggagaactaacctctttgcaacctgttaggtggcctctgaataaaaatgctctttaattgggagagtaaatcaagaacagagtaacagaaccaaatgatattgttgttaaactaatcaaatgagtaatcttcttaagatcatcttatgatcttgactagtttatggcctatggtgaaagtaaacaaacaaacaaamaaaacatagtatgtaaacatcattttgggcagacctggtcttcaggagttggttttttttctattccctctagattaaagacattgcacttaactttaaatcctcacagaactttagattctcctgaggtcaatccaactcaaagctcaattgatgaatctttaccgtatctgctttaaagcatacatattatgaaataatttacatttcaatattcctgaaatatgcattttattaatccaccaaatccgaaggcagctttaggaccaagagagtttattgaatttaagcaacatgtta

SEQ ID NO: 33873 - DNA, 601 bp, Human
acgacaaatataatgcttcatttcttccatacaaaaataacctcaaaaattgaaaagcactagttcagggtaatcttatagtggttgttttcaaaataaaaacctattttgtcaaataattgattacaaaagtcatcatattaaagcaatttttcccatttgtcattttataaactttcaataatgaaacagaagtttcacaagaggaaattgtttccaacttggagtgttttatcaaatactcagttccagcccttctgctaattgtctctatggagcagcagaatgtcttttccaaaaractatcaggagaactaacctctttgcaacctgttaggtggcctctgaataaaaatgctctttaattgggagagtaaatcaagaacagagtaacagaaccaaatgatattgttgttaaactaatcaaatgagtaatcttcttaagatcatcttatgatcttgactagtttatggcctatggtgaaagtaaacaaacaaacaaaaaaaacatagtatgtaaacatcattttgggcagacctggtcttcaggagttggttttttttctattccctctagattaaagacattgcacttaacttt

SEQ ID NO: 33874 - DNA, 601 bp, Human
ttaacaaagcaaacaaaatagcacaattctattttggttactacaatattttctgtaaaaaaaataatttgcacttatatgaaaatacagaaggaaagaaagacgacaaatataatgcttcatttcttccatacaaaaataacctcaaaaattgaaaagcactagttcagggtaatcttatagtggttgttttcaaaataaaaacctattttgtcaaataattgattacaaaagtcatcatattaaagcaatttttcccatttgtcattttataaactttcaataatgaaacagaagtttyacaagaggaaattgtttccaacttggagtgttttatcaaatactcagttccagcccttctgctaattgtctctatggagcagcagaatgtcttttccaaaagactatcaggagaactaacctctttgcaacctgttaggtggcctctgaataaaaatgctctttaattgggagagtaaatcaagaacagagtaacagaaccaaatgatattgttgttaaactaatcaaatgagtaatcttcttaagatcatcttatgatcttgactagtttatggcctatggtgaaagtaaacaaacaaa

SEQ ID NO: 33875 - DNA, 601 bp, Human
cttggaatacctggttttaaatccccatggacaaatatgtcaatcatatatcgacagaatgcatactgatctgacagagtagaaagaaaaagagcaatgaaaaaatgtcatcaacacttcatttttctacagagaaataatttaacaaagcaaacaaaatagcacaattctattttggttactacaatattttctgtaaaaaaaataatttgcacttatatgaaaatacagaaggaaagaaagacgacaaatataatgcttcatttcttccatacaaaaataacctcaaaaattgaaaagsactagttcagggtaatcttatagtggttgttttcaaaataaaaacctattttgtcaaataattgattacaaaagtcatcatattaaagcaatttttcccatttgtcattttataaactttcaataatgaaacagaagtttcacaagaggaaattgtttccaacttggagtgttttatcaaatactcagttccagcccttctgctaattgtctctatggagcagcagaatgtcttttccaaaagactatcaggagaactaacctctttgcaacctgttaggtggcctctgaataaaaatgc

SEQ ID NO: 33876 - DNA, 601 bp, Human
cacaatcttagaaacaaagactattaaaacagacaagtacaagaattgcttggaatacctggttttaaatccccatggacaaatatgtcaatcatatatcgacagaatgcatactgatctgacagagtagaaagaaaaagagcaatgaaaaaatgtcatcaacacttcatttttctacagagaaataatttaacaaagcaaacaaaatagcacaattctattttggttactacaatattttctgtaaaaaaaataatttgcacttatatgaaaatacagaaggaaagaaagacgacaaatrtaatgcttcatttcttccatacaaaaataacctcaaaaattgaaaagcactagttcagggtaatcttatagtggttgttttcaaaataaaaacctattttgtcaaataattgattacaaaagtcatcatattaaagcaatttttcccatttgtcattttataaactttcaataatgaaacagaagtttcacaagaggaaattgtttccaacttggagtgttttatcaaatactcagttccagcccttctgctaattgtctctatggagcagcagaatgtcttttccaaaagactatcagg

SEQ ID NO: 33877 - DNA, 601 bp, Human
taatcattctagcttattttgctcacagacaacatcctcgagtcaaatggcatttaacaaacccatgttaccaatattttcgggggtgattctgcatgttgctgggtccaagattaaatacaagagaaaaattttgctcagatgtaatacattcggtcatacatcatgtgatgtgctaagaagtctgctatgagagccttctacccctgaaaattgtaccaccacctatgtgcatctcctttattgcttgatattatataatctagcatagaagagatgataaagatcttctccagtaaayattgtatcttttattttctaagtgtgttccataaagttttgccacataacaaaggcagaacacttgaacccttccctcatgctttcatcaaattaatcctcatggtgtgagacgaaaccactttagttatcctgaagatatttgtaaatggtgaaattaattttcttagatggctcataaaaataggataattattttgtagccatatctggaaccccatttttacagttttgatgtttatgaagtaatattgctttaataacattctgatcttctcatgtaacataaattacaaggtat

SEQ ID NO: 33878 - DNA, 601 bp, Human
cagagtataagcagcagaattggctctaaaaatcaggaataaaagacaggaagaaaatgtattttaatttaccacaggttatttttctctattttctaaatgttattgacgtgctattacttttgtagtagaaaagtgaatttacaaataagttaattctactttgggacatttgtttctttttgatgtggttttaactaataatacacaaaatgtatagcagatttatatttacaatgtttttaagttaagaaattgtttattccaatgatataataaggataaaaacaaagataacacygaaaatgaattaaatgatatggacatggcctgatgaatttcaaagccatgaggtttaattttagtaagtctctgagtttgactcaacagactttgttgttgattctttacattgaaaataagaatttccttcaaaaaattttacaattttcaaaatcatccaatcatgatttggatggatgggtatggggaactctctaaagaaagacaaaatgaaacaacataaaattaccccctcgaaggagctctggtcaatgaattgctctgaacgctaaacttcatcaatttaaccataaacaca

SEQ ID NO: 33879 - DNA, 601 bp, Human
ttcaggtacatcctcttattgggtcttcatcctgaccttgttataaaaggcagcccagagcagaaaatgaagcctctgaaacattaaaataatttgcagagtataagcagcagaattggctctaaaaatcaggaataaaagacaggaagaaaatgtattttaatttaccacaggttatttttctctattttctaaatgttattgacgtgctattacttttgtagtagaaaagtgaatttacaaataagttaattctactttgggacatttgtttctttttgatgtggttttaactaataayacacaaaatgtatagcagatttatatttacaatgtttttaagttaagaaattgtttattccaatgatataataaggataaaaacaaagataacaccgaaaatgaattaaatgatatggacatggcctgatgaatttcaaagccatgaggtttaattttagtaagtctctgagtttgactcaacagactttgttgttgattctttacattgaaaataagaatttccttcaaaaaattttacaattttcaaaatcatccaatcatgatttggatggatgggtatggggaactctctaaagaa

SEQ ID NO: 33880 - DNA, 601 bp, Human
acaaaattgatcaaaatctcctattacaccctctcatagcatcctgtgtacctcctttatgattattataattttaattatgttattaatactgtaacttctcagagattatagtctatgctttttttgcatcctttgtgtctagtatctgaattaattacatcatattagatgcagaataaataattgttgaatatagcactgatcagtccacacaaaaaattaaggtgaataatatcagaccttgagatttaaatagatgaattttagttaatttattatatatacatatattacacayacttatataataaattatatgttatagtacatatatataacacatatatacgtactacagaataaattataaatattacaagtgtgttaattcagaagagaggggactcattgaaggctgaaataggtagagaaggcttgatgctgtatgtggacattattcttaggatcagtttaaatatttacataggcaaagaggaaaggcagttagtccattcaggagatggaagttacaaaatttaattaagaatttcatgctttttcatagcaatatagagtgtgacaagactaacgcaggcag

SEQ ID NO: 33881 - DNA, 601 bp, Human
aagattttaagtaatagttaaaagttttgataattatcattgcccaaagtgtagctttggagttaagccccaacctttcttttgagctgctttcatagtgaacaataacatgtggttcaagtattcctgtgatataagtgcagactaaaataaagacattaatgtccccaaatgtcttccatatgacaatggaagaaggaaatatttagattttacaaattgtgaactccaaattatgtatgtatatcttttcctgatagtatgttttcatgacaattttgattttcacaaaatcaaggaygctgtttttattgactttcatattacatgagagtggaggctgggaatggaactgtcgcaaaatacaggtaatcactaaagaaaaatagattaagcccatctgtgagaattaagtgtagttaccccaatagcaaaagaacttagactatttttcatagtgtatgtccaatgcatctatgccaaatagatttttttttgtttttataaggtctacactcaaagcaaaagtgcttttgtgaatacaaatataagacccctattctaagacaaaggcagtgtctgtgttaaagtgaaaaaatgg

SEQ ID NO: 33882 - DNA, 601 bp, Human
agaatattggaaaacattttttaaaatatagtagtttctttgtgtttgtccaagagtctataggatgatttatggttcttgattatcagggcctataaagtgtttaatggtgctgggatataaagtggaactctgtcaaaattattgaggcacgaacattgttatggaaaaataattccctaagggataggaaaatggtttcagattttccactgccttacactacccccagagacaaaggcagtaacgaggaactgggttagtatccatgatgaagtacagcatggctggggaggagttycgaagtcttcagacaacttaccccaaccttaattctagctttgaattgttgagtggaaatggccaagaaaaacatgttgaggacaaatggaagttgggggatcataagttgcacagtcctgagcatcagtaaaagaagatcagttctgtcaagattcctctgccattatatccaaacatacacagacgtggggggcaaaactagtcaataattttgatgtccaattgtattactccaataacagagaaacctaaaagtgctattattttgttctcagaggaggagaaattacttaactac

SEQ ID NO: 33883 - DNA, 601 bp, Human
ggacattcaaagattgtaaacccaataccgtaagctttggagaatgatctcagaaaataaaagtgatttctatttccaagtttgctactggcaagatgccttcggttcctaggctgagtcatcacttgcactgactttcctacagatcattgattctcagcatccactttgtcctcaggggcttttgtcccagtttaggaagtccacagacttctctgaggaatctctaactacccaaggaagtgaggaggatattaaatctgacaaaaaagtgaagagattattacatggaaactctgcmcttctgcattaggaaggagagatacatcagtggtttgagtcaactcttatgacacttttcagcttatctatcttgtttgtcaaaagcagaatattggaaaacattttttaaaatatagtagtttctttgtgtttgtccaagagtctataggatgatttatggttcttgattatcagggcctataaagtgtttaatggtgctgggatataaagtggaactctgtcaaaattattgaggcacgaacattgttatggaaaaataattccctaagggataggaaaatggtttcagattttccac

SEQ ID NO: 33884 - DNA, 601 bp, Human
tacaataagccataaactgatcatttttccttggcacaaacataagttgttcaacaagttataatctacttgtttaagagaatgagtatttggatggataggaccttatttatgtgtaatttttaaaaatcgcatgacttcagcatgcagaagtcttccaaaactgtttaatcagcacaaagccagtttatttcttttagcccacattttgtcaaaaaataaacaaccaaatagaaaatcctgcacatatcatgtatgtagcggtgttttagtcttcagactcaaacttgagaataagacyaaaataaaatttgagagacaatttcagctaggagacaattttacctataaacttttaaagtcttcaaaatgaaggccttggttgaagtaactcaaataaaactttacttattctaccaccttccaaacacatcttcagtgtaattcagaccatatcatgggctccagacacatatatggtcaatgtctttaacatcattatattcaacagcctaataaaaaataaaacattaacacattttatgcttcctctgcaacattaatgctcaataaagattttatggatgaaaatgacttttaa

SEQ ID NO: 33885 - DNA, 601 bp, Human
tgcacaaaaacatccaaaaagcactggagaatcaagagacgtcatttcttcagacaaatatctagctctttactttaaaagcattatgtgacacaaacttcagttatacctatttcaaaaattgcttcctttattctgttctgcaatgactttaatgcaaatacagatttaaaatttattgctttaccatatgaacaaaaatgtctaatttggaagaaccgaaataatgagaaacttgggcattgaattttgtaactgcacatgaatattgattggattctaaaataaatgatcccaaagwttgaatatttagaacctaccatacatctagcaaaatcaaaaagaatcttgaatcttagaagtgagtttccaagcaattgaattgctaaaacctatttcttcattttttctacctgatataaaaaaatttggcatattacttcagctgtcctattataaagcaggcagtaagacacatttaagcatagattcagccagagtactaaggatcagaaatatgtagaaggatttgcgataaatgccacttcaaccattacttgtaactcttccaactatctgcctcttgcctaacacaaaagtg

SEQ ID NO: 33886 - DNA, 601 bp, Human
attgtaagagttaatacagaaagataccacatatcttcacctagtttccttcaatggtaacatattgtaaaactatagaacaatattccaactaggaaactggtattgatacaattcacctgtctcattgaattatattttaatagttatttaaaatatatgagatttcaaatgtttatgtgacatagccacaaattattaccagtaggttaataattgggaaagcgttgctatataaaatgaaaatatgtccagattgacctataattctttttcttatggattttgtaatattactcaragtatcataagactctgcttatttccctatatttctcacaaccttattatatgaaggattataataagtgtcttatctactgcagtagttccagcatccaaagaagtacttggaacatagtaggcattcagtatctgtctaatgaatcacctattaatacagagtaggaggcatttgctattgtaaggggcactttagtaatttcctgcacaaaaacatccaaaaagcactggagaatcaagagacgtcatttcttcagacaaatatctagctctttactttaaaagcattatgtgacac

SEQ ID NO: 33887 - DNA, 601 bp, Human
tgcaaaagggtcacttttatataagcttccccatcttttaaacttagagcacagtctatgttgtcattaaaaaaataatagctaactgaagccaggaattcattttgcaattgtgtcaattattttaaagataccattattaagtaaactttaaattagtttgtgtacaaccttatagtgactggaaataagataaatacaagcaccccctcccaccgcagcaaacacacataacagattcttgagacttagacccttaaacatgtctgctcatcactcaatccatttggccaccctttcygtccacaccaggccaaagagcaaaatgttttcacagaaattctctgggttgcatattcttaattgcctgaactattgtggacaaaacatcacatttttaaaatcttaaagcacttgtaagggtcatacatgtgtgtttactgtccttgttgcttctgtcctggagaatttgcttgaccagagctctctccagggcggtctgcaggagtgaaaggaaactgaaatccatagccattgtacccatccaagtagacacactggaagaaactgatgggacctaaggaacagagcatgacagttt

SEQ ID NO: 33888 - DNA, 601 bp, Human
atacaagtaagacatctcacgaaggcatttaaggctaaaatgaattccttaaactttgatggcattcatattttgccattatgagaaagaaaaacattttacttcacagaaagaatgtattaaagtgaaatgaaaatatttttatatttgtcacccaaatttagtgattgatctaaaatttcacccaggtgacatttttattaagacacagtctggagaaatttcagaattccacatctcatttgctaatattttaaacaaacgattcaccagacctgactaattgaatggtgtatttccrctggactgaatgtcctaattatcattcaagacatatcttaaagatttatcaagcatttactctccaccttaccatgtctaaagctcagagatattttgagctctaaaagagtatcacaagaaatttatagcagtctgtagtacaactattacccattcttagagcaaagccacaactaaaatagaaatagacaaaaataaaataaaatcattaagcatcaacttattgggtaaattaagtttagatacccatatgatgcaaaagggtcacttttatataagcttccccatcttttaaact

SEQ ID NO: 33889 - DNA, 601 bp, Human
gttaatttcacagggtcaccaaattgtgaagtctcagaaagcattcattttcttttttttttttttttttttttggagacagtttttctctgtcacccaggctggagtacaatggcacaatcttggctcactgcaacctccacctgcctcccaggttcaaacaattctcctgcctcagcctcccaagtagcagggactacaggctcacgccctgtgtctggctattttttgtatttttgtagagatgggtttttgccatgttggccaagctggtctcaaactcctgacttcaagtgatccraccaccttgggctcccaaagtgctgggattacaggtgtaagccaccgcgcctggccagaaagccttcattttctaaagctgctattgctatccctatcccattatttaaaatgttcagcagaggagacaggcagaccttgaagcacagtgtttcctaagtattgccttagcatgttgaattctttgaaacatcttatttcatagacgaatattaacaataccaaatgatccgagcaagaaattctgatacagagttaagccagaaatcaactcctttctgacaacagagatgactggaag

SEQ ID NO: 33890 - DNA, 601 bp, Human
gcaagactccatctcaaaaaaacaaacaaacaaaaataaaaaacagagagtgacagagtcagaaaaacagtaactatgtattttaagaaagagaagactgtggctcactacattttctcttctttccaaggaagtttccataactagtgaaaaaaattatcagggacactaaagtaccaaggttcctttgttaatttcacagggtcaccaaattgtgaagtctcagaaagcattcattttcttttttttttttttttttttttggagacagtttttctctgtcacccaggctggagtacartggcacaatcttggctcactgcaacctccacctgcctcccaggttcaaacaattctcctgcctcagcctcccaagtagcagggactacaggctcacgccctgtgtctggctattttttgtatttttgtagagatgggtttttgccatgttggccaagctggtctcaaactcctgacttcaagtgatccaaccaccttgggctcccaaagtgctgggattacaggtgtaagccaccgcgcctggccagaaagccttcattttctaaagctgctattgctatccctatcccattatttaaaa

SEQ ID NO: 33891 - DNA, 601 bp, Human
ggtctcactatgttgcccaggctggtttcaaactagcctcaagtggtcccccaaccgcctctgcctcccaaagtgctgggattataagcatgagtgatcgtgttcagcccagtttcttaccttatataatgtacctgatactttctcccacttcctggaatatttgcccctttcctcattttgagaatacaaaaaatgctttttcctatacatacagtttttctgttttgagaccacttctggcaatcataataactgtatctggagaagcaccatggttctccaatggcagtagttctayggaaatgtaacctattcctaggattttgaaattgtcacctactatagtcaaaaatggtatggcaccatttttccttctcttatagaaatcctttaagaaaatatgtagtccttgtattctggaactgcctagcacatagcagctttttggtaaatgttgaattgccataatttagcttcccagctagaggcattataacccaatttatgttggagaatcggagcaaccgtgaccttaacggtatgttcaaataattcattacatttagagtgaaaacaaacaaataaaaccaacccacct

SEQ ID NO: 33892 - DNA, 601 bp, Human
gaaaccgacagagtcctgaggtcatcccgggaggaagggagactacttccagaagcagcagcacaaagggctctgccgagactctgcggagggggtccagggtactgggggtggaggggtcccctcttgcagtgtggggttactgtttgggtaaagcgaagtcccaggcagtttcctgtgcacatttccacatggcctgcatgaggcgagtgaaacccatgtctttgggcttttccaggcctctcatcagccgttgcttcatgatggaaacaaattccttattgctcagttcgccattgcytagaggaagaggcaaaaacaacagggataagtgttggccttggaacaacaccactgatataattccattgtccacacaaagtggatttcaaagcccagacattctccacagccaaactcaattctcttatcctagaattcattagtttattccttcctcgatatttccaactgcaactcagtgacagttcagtgtagtgtgacaaaagttgaatgaaaatacagtatatgccaggtcttgtgccaggtgtttagaacaaggagataaatgagctttgtgctttgtccctggaaatacttc

SEQ ID NO: 33893 - DNA, 601 bp, Human
ggtagaaagaaaacaggtctgcttccagcaagatctcaaatccagtggggacataaaatgaaaagggcctagaggaccctaaaataaaggagacagggaactttggggatgtttattgcaaatggttataatttaagtgatatttacaattgtttaagacagagggcaaacaggctctgagccaggcctcagctttagaggcccatcctggagaggaaatggcacttgcagggaacatgagctcaatcactattgctcactaagcacagggtcacactggagtcatcttagggaggctgcraggaagaaaagggagtgcacagagccatgaagcaactactttaaattctgaatcttgctgtgttcccactgagcatgctgccttcctagagcaggccttggagccatcccagggactaacacagatccttcctggggcgcaggcttctcacactagcgtagggtgcctaggtcatcctcatcattgtttatcatcacagacttctttctgcctgccagatatcttccctacttgtggctttaaaacaccagcaggagggaagtcaaggaatgttcttgttagtataaatccatagcaaaa

SEQ ID NO: 33894 - DNA, 601 bp, Human
agacgcaagtctagcttacgtgttaggatcatggtgtccggcttctttctgcacatcaagcacggcaggcggcggcggaagcgctgtggggaagtcgaggcaggcggaggcggctcggcttccgcgtcgggacccacggcggcacccgagacgcgcgccctcgcggtcctcaacgcatccttgctcgccgctccctgcccctcgtcacggccccagaaagaaagcggggttttctaaagatcgaaacgagggagcgctcagggagttgggcgagaagtccgtgagccggcgctcctgatgmggagaggtgcggccatgtcctggctgggagcgaagcgccctcgctcgggcagtcggagcgaactgtctcccgcgcgctccgccagccgggccctcccgctgggcccaccccccgaggggcggggccagagcgggcggcaccgcctcctccccgctgtctgggtcgcaggccttagcgacgggctgttctccggccccgccccattcccaggctgcgccccccgcccctcttcctcgtggccgcagcctcaggccgccctctagccccgccccgcccaggccccgcctctcctctgtcccg

SEQ ID NO: 33895 - DNA, 601 bp, Human
aaattactttgtaaaaatgtacttttcaggaaatggagtagaattatacaaaaagaaagcaagaaaatgatagtcttcagcatgctgattactttgggtagggagtggcaggcagcagatgggggagtggcatgggcgtgttaccaaggtgctagcttttgttttcagcggtgggggtcttgcatgcttacaacattttttttaaaaataaaacatttaaacgataaaactgctgaaaataagtcatagatcagtaatactcgcgaacaagggattatgattatgccaacttttaaaaagyggcattcccagcttaccttcataaagctgtgcatactgggggaaaccagttgcccgtagccaatcacaagcttccttggcttcaatttctagaacagaacagaagaaagacaaaattagccatgtgtacctcgccatgcttatttttcctgaataagctttcgttttatgatacaagcaaaacatgactgccatagaaaatacagataagcaaacagacatacacgcttaattcgaatggtttacattttgtatgcatcgtttccagttttttcacgtgtacatgaggatgtattttccc

SEQ ID NO: 33896 - DNA, 601 bp, Human
ccatacagtatagaagaatcttaacaatacaatattaagtgaaaaataaaaaccccatgaaattacatacgacacactaccctttttataaaggtaaaaattactttgtaaaaatgtacttttcaggaaatggagtagaattatacaaaaagaaagcaagaaaatgatagtcttcagcatgctgattactttgggtagggagtggcaggcagcagatgggggagtggcatgggcgtgttaccaaggtgctagcttttgttttcagcggtgggggtcttgcatgcttacaacattttttttwaaaataaaacatttaaacgataaaactgctgaaaataagtcatagatcagtaatactcgcgaacaagggattatgattatgccaacttttaaaaagtggcattcccagcttaccttcataaagctgtgcatactgggggaaaccagttgcccgtagccaatcacaagcttccttggcttcaatttctagaacagaacagaagaaagacaaaattagccatgtgtacctcgccatgcttatttttcctgaataagctttcgttttatgatacaagcaaaacatgactgccatagaaaatac

SEQ ID NO: 33897 - DNA, 601 bp, Human
cccatacagtatagaagaatcttaacaatacaatattaagtgaaaaataaaaaccccatgaaattacatacgacacactaccctttttataaaggtaaaaattactttgtaaaaatgtacttttcaggaaatggagtagaattatacaaaaagaaagcaagaaaatgatagtcttcagcatgctgattactttgggtagggagtggcaggcagcagatgggggagtggcatgggcgtgttaccaaggtgctagcttttgttttcagcggtgggggtcttgcatgcttacaacattttttttaaaaataaaacatttaaacgataaaactgctgaaaataagtcatagatcagtaatactcgcgaacaagggattatgattatgccaacttttaaaaagtggcattcccagcttaccttcataaagctgtgcatactgggggaaaccagttgcccgtagccaatcacaagcttccttggcttcaatttctagaacagaacagaagaaagacaaaattagccatgtgtacctcgccatgcttatttttcctgaataagctttcgttttatgatacaagcaaaacatgactgccatagaaaata

SEQ ID NO: 33898 - DNA, 601 bp, Human
tattacacagcagccaaagcaaatgcataacaggcccatacagtatagaagaatcttaacaatacaatattaagtgaaaaataaaaaccccatgaaattacatacgacacactaccctttttataaaggtaaaaattactttgtaaaaatgtacttttcaggaaatggagtagaattatacaaaaagaaagcaagaaaatgatagtcttcagcatgctgattactttgggtagggagtggcaggcagcagatgggggagtggcatgggcgtgttaccaaggtgctagcttttgttttcagsggtgggggtcttgcatgcttacaacattttttttaaaaataaaacatttaaacgataaaactgctgaaaataagtcatagatcagtaatactcgcgaacaagggattatgattatgccaacttttaaaaagtggcattcccagcttaccttcataaagctgtgcatactgggggaaaccagttgcccgtagccaatcacaagcttccttggcttcaatttctagaacagaacagaagaaagacaaaattagccatgtgtacctcgccatgcttatttttcctgaataagctttcgtttta

SEQ ID NO: 33899 - DNA, 601 bp, Human
ctgttcctagggatagaagcaagatgaatcattatgcatgtaccacaaaagatagatgcaagaatgttcacaacagcacagcttataaaagcaaaacagagaaagccaaaatacccaccaaccagagtgtggatatgaataaacagtggtttcttgtgtaatacacaatggtgtattacacagcagccaaagcaaatgcataacaggcccatacagtatagaagaatcttaacaatacaatattaagtgaaaaataaaaaccccatgaaattacatacgacacactaccctttttataaasgtaaaaattactttgtaaaaatgtacttttcaggaaatggagtagaattatacaaaaagaaagcaagaaaatgatagtcttcagcatgctgattactttgggtagggagtggcaggcagcagatgggggagtggcatgggcgtgttaccaaggtgctagcttttgttttcagcggtgggggtcttgcatgcttacaacattttttttaaaaataaaacatttaaacgataaaactgctgaaaataagtcatagatcagtaatactcgcgaacaagggattatgattatgccaacttttaa

SEQ ID NO: 33900 - DNA, 601 bp, Human
gcctattacctatatgtgagaaagtaactatgttattttaggaattctaagttagtatacccagagccatattttagattccttttctaatccaaattaacaatttttaaaaaatctggtaggtattaaatgcaagtgaggagtgtaagaattaaatcagtaattttcttttatttgcctggactcctttctgaaaggactggcttttaaaagatgatagtttactgatgtatagaagatgttctctgaactcaacttccactgtgggttgaaaggcaggaagtataaattgccaagtacscaaatcaagcttaacagggggacatgtgtgggttggtatggggtgtatagtgtatgtactcacccagcacacagtggcaggaaaaacggggggaggcaatggcccagaacaatacgcagtgtaccccaaaagtagtcttatgcttcaaaagacttgggaacatgaagggaccccaaatgtaacttgtgcaaatgcaccctgcattttaggattaggaaagaggagacacagggaatggaattgggtcttagcaaacatatatatcacaagaaagtgctacctggcagcaaatcaatgcca

SEQ ID NO: 33901 - DNA, 601 bp, Human
atagagatgcgatctcactacgttggccaggttggccttgaactcctggcctcaagtcatcctcccacctcagcctcccaaagtcctgggattacaggcatgagccaccattcctggccaatatttgactctgaatacacaccaagatgaaataacagagctgatattaaggaatattttttaatatttacagagtataatatcagatctataaatgtaaattgaaattttcatatgcctattacctatatgtgagaaagtaactatgttattttaggaattctaagttagtatacccagrgccatattttagattccttttctaatccaaattaacaatttttaaaaaatctggtaggtattaaatgcaagtgaggagtgtaagaattaaatcagtaattttcttttatttgcctggactcctttctgaaaggactggcttttaaaagatgatagtttactgatgtatagaagatgttctctgaactcaacttccactgtgggttgaaaggcaggaagtataaattgccaagtacgcaaatcaagcttaacagggggacatgtgtgggttggtatggggtgtatagtgtatgtactcacc

SEQ ID NO: 33902 - DNA, 601 bp, Human
agaccagcctgagcagcatggcgagaccttgtctctacaaaaaaaatctaaaaaaattttactgggcatggtggcatgcgggctgtggtctcagctacatgggatgctgaggtggaagatcacctgagccccagagtttgaggctgcagtgaactctgattataccattgcacttcagcctggatgacagagtgagaccctatctgaaaaaaataaataaaaagtaaaaaaatccctttggccttcaaaatggctaatgccacacagtggaacagacatggctgtcagcagttttggagaygcaggtaattagtcctgctccagctcctgcgggtgcacaactgttcattatgtttttattgtttcttatgattactggttttatggaatgatatggaatttcttattcttagtaatctattttctagagataatatatcagaatgagtataaagttatagtctatccttttttttctgaaggctacagttggattactgacattgttccctaaatgataatataagcagaccaaggaagtggctatagtccagagatttatgaatacataaaatttagtatcacagaatgacatttcttc

SEQ ID NO: 33903 - DNA, 601 bp, Human
gcactgtggctcacatctgtaatcccagcagtttgggaggccccaaggacagaagatcatttgagctcaggagtttgagaccagcctgagcagcatggcgagaccttgtctctacaaaaaaaatctaaaaaaattttactgggcatggtggcatgcgggctgtggtctcagctacatgggatgctgaggtggaagatcacctgagccccagagtttgaggctgcagtgaactctgattataccattgcacttcagcctggatgacagagtgagaccctatctgaaaaaaataaataaaaartaaaaaaatccctttggccttcaaaatggctaatgccacacagtggaacagacatggctgtcagcagttttggagacgcaggtaattagtcctgctccagctcctgcgggtgcacaactgttcattatgtttttattgtttcttatgattactggttttatggaatgatatggaatttcttattcttagtaatctattttctagagataatatatcagaatgagtataaagttatagtctatccttttttttctgaaggctacagttggattactgacattgttccctaaatgataatat

SEQ ID NO: 33904 - DNA, 601 bp, Human
tctcaaatcctttaatctgtagaagagttcattcagttctctcgagacaatgaagaagctgtatcagaactgaaaaccagagagggggaaaacagtcgactcaatggaggaattcctttctctggactacataaaaagatcccttggtaagtaaatatacccaagaaaaggagagcggaggtagccgctgtggaaatttacaacagctctgaaattgccactggataaaggcaagttatcaccctcttggagtcccaactatgagggcaaatcatgggcctcctcagtagagtgctactasaataccaggaagaggagtgtctcggtgtagggtaaccctttggaccagacctgggtgaaatcagtcatcacagcaggaaactagaatcaccacaagctaaaaaattctctttggctgggcactgtggctcacatctgtaatcccagcagtttgggaggccccaaggacagaagatcatttgagctcaggagtttgagaccagcctgagcagcatggcgagaccttgtctctacaaaaaaaatctaaaaaaattttactgggcatggtggcatgcgggctgtggtctcagctacatgggat

SEQ ID NO: 33905 - DNA, 601 bp, Human
tttgttgagcgcctaaaacccaatttgccaaatagcccagtttaccaaagcagggataaaactcttcagcaatatactaagcacctactgtaggacacctcattccccgtcaagttctatgggactataaggcaattgaagccaatcgggcatcactgtcctaaaggagcttcggctttaatgtgggggaaactcaaaatattgcttctggtcaaggagaagtggttcagaacattgttatatgtttaaacaaatcagcaggcaatgagtccccagtagaaattataatttaagccacaawgactgtcagaagaatgctccgttttaatgtggctgggctgtgtgtatgtgtgtgtgtctttgctcacgtgtgatcagggaaaggtcacggaaagaaaactgagccacagaaagatctagagaacaatgaaaagtggtaggaaatggaatgtaatccactcacatggcatcaagagctaaggagaattcaagatatgctttttaaaaacaaatattagcactgcaatatggccttgcaggaattgatataactcccctaaaaagaaagggctagctatgaagttgctatagaacaacagaa

SEQ ID NO: 33906 - DNA, 601 bp, Human
tcatttaactgtctgttgcctatatgttaaagaccatgctgagttattttatagccttatttcgtcctatcattattttatacgaggggaaactgaagaggttgagaggagcgttcttggaattcaaatgatgctcctgtctttatatgccaccccccatttattcctctgaacatgcttaatttccatcgtacccttttaggaaaccttaatccacgtttccaaaccacctgagagttgttacttgttacaccaattatatcaaatatggaatgctattgtgtgagtacttcctaggacrgcgtggatgctattttaatggcaatactaaataacaatattttacttagtttttaattaaaaggtctatgatcactctatggtttgccaataaaaacctaacacaattagcaagaacaaaagcaaacaaagcctatctttgtgagaagtactgtgttcttaaaaaataaaaaaggaaaacactcaaaacgtgtccatttacctgcatagagcctcaatggcatctctgtccaaaaaatcatgctctctcttgaccaaggaaatatcgatggggaacaggaaatctatgagaaaaataaac

SEQ ID NO: 33907 - DNA, 601 bp, Human
cgagatggatgactgcttgagcccaggagttcaagaccagcctgagcaacacagcaagaccgcatctctacaaaaaatacaaaaattagctgggtatggtggtgtgcacctgcagtcccagctactccagaggctgaagtgggaggatcacctgtagctgggaggtcaaggctgcagtgaaccatgattgtgccactgcactccagcctgagcgacagagtgagaccttgtctttaaaaataaaaaaaaataaaataaaaaacagaacaaaaaaaaaacaggctgggtgcggtggctcacrcctgtaatccctggactttgggaggccgaggtgggtggatcacctgaggttaggaatttgagaccatcctggcaacatggtgaaacccagtctctactgaaaatacacaaaattagctgggcgtgatggtgggcgcctgtaatcctagctacttgggaggctgaggtaggagatttacttgaacctgggaggcggaggttgcagtgagccgagaccacgccactgcactccagcctgggcaacaagagcgaaactccttctcaaaaaaacagaaacaaaaacagaaacaaaaaaaacaaa

SEQ ID NO: 33908 - DNA, 601 bp, Human
ccgagatggatgactgcttgagcccaggagttcaagaccagcctgagcaacacagcaagaccgcatctctacaaaaaatacaaaaattagctgggtatggtggtgtgcacctgcagtcccagctactccagaggctgaagtgggaggatcacctgtagctgggaggtcaaggctgcagtgaaccatgattgtgccactgcactccagcctgagcgacagagtgagaccttgtctttaaaaataaaaaaaaataaaataaaaaacagaacaaaaaaaaaacaggctgggtgcggtggctcaygcctgtaatccctggactttgggaggccgaggtgggtggatcacctgaggttaggaatttgagaccatcctggcaacatggtgaaacccagtctctactgaaaatacacaaaattagctgggcgtgatggtgggcgcctgtaatcctagctacttgggaggctgaggtaggagatttacttgaacctgggaggcggaggttgcagtgagccgagaccacgccactgcactccagcctgggcaacaagagcgaaactccttctcaaaaaaacagaaacaaaaacagaaacaaaaaaaacaa

SEQ ID NO: 33909 - DNA, 601 bp, Human
gtaatcccagcactttgggaggccgagatggatgactgcttgagcccaggagttcaagaccagcctgagcaacacagcaagaccgcatctctacaaaaaatacaaaaattagctgggtatggtggtgtgcacctgcagtcccagctactccagaggctgaagtgggaggatcacctgtagctgggaggtcaaggctgcagtgaaccatgattgtgccactgcactccagcctgagcgacagagtgagaccttgtctttaaaaataaaaaaaaataaaataaaaaacagaacaaaaaaaaaacaggctgggtgcggtggctcacgcctgtaatccctggactttgggaggccgaggtgggtggatcacctgaggttaggaatttgagaccatcctggcaacatggtgaaacccagtctctactgaaaatacacaaaattagctgggcgtgatggtgggcgcctgtaatcctagctacttgggaggctgaggtaggagatttacttgaacctgggaggcggaggttgcagtgagccgagaccacgccactgcactccagcctgggcaacaagagcgaaactccttctcaaaaaaacagaaaca

SEQ ID NO: 33910 - DNA, 601 bp, Human
gtattatatgagaaaggcagaaaacagaactaccactgctttccttgcctacaaagaggaaagaaatactgggtgtcattctaccttcatgatgtttttccaagttgaaaaaaatactgagatggggtgtggtggctcactcctgtaatcccagcactttgggaggccgagatggatgactgcttgagcccaggagttcaagaccagcctgagcaacacagcaagaccgcatctctacaaaaaatacaaaaattagctgggtatggtggtgtgcacctgcagtcccagctactccagaggytgaagtgggaggatcacctgtagctgggaggtcaaggctgcagtgaaccatgattgtgccactgcactccagcctgagcgacagagtgagaccttgtctttaaaaataaaaaaaaataaaataaaaaacagaacaaaaaaaaaacaggctgggtgcggtggctcacgcctgtaatccctggactttgggaggccgaggtgggtggatcacctgaggttaggaatttgagaccatcctggcaacatggtgaaacccagtctctactgaaaatacacaaaattagctgggcgtgatggtggg

SEQ ID NO: 33911 - DNA, 601 bp, Human
gcatgaaaacattaaaaaaatgtctggagtagttcatattccagatgcagactccttcccctcccgaaactgcatctggtttcattcccgatgatatagtaatgatattacactccacagtgaagttcttggaattaggtttctttcagaaaatgggtacacaccctgtacgtttctatcagtcatttaattggactacaaaagtgacagcgtttctgtggttaagaggactgtttgttttttcctctcttaaaccatgagaactagtctagtccatacactatgctaaatatcccatctrtctgccccaaaccactgcttactttggctgcttcatataacactgtattatatgagaaaggcagaaaacagaactaccactgctttccttgcctacaaagaggaaagaaatactgggtgtcattctaccttcatgatgtttttccaagttgaaaaaaatactgagatggggtgtggtggctcactcctgtaatcccagcactttgggaggccgagatggatgactgcttgagcccaggagttcaagaccagcctgagcaacacagcaagaccgcatctctacaaaaaatacaaaaattag

SEQ ID NO: 33912 - DNA, 601 bp, Human
ctgcttgaaatacacccgatagaggtcccttttcttctgaacatttgtttaggcctctcgaaaggggcatcattttcatgaaaagtccatttatgtggacatgtggacaagagccctggggttttccattacaaaccagttgatgactattactgtgaactctgaagaatttccttttttaaaaaagaaaatccaaccctaggcctttctgcacatactcaaattggggcctgataatttaatttttaaagcgctctgacatccatcactgcatttcctataagatgttattctatgcagsagagaaaactgaagcccaactagcatatgtggcagagtctgcttcttctaggcttttcttttcaccaaagatctagcagcacagacttattcgcttcagagaaaggtggcttctcaaaaggtactcagagccagtgtaaattgcaaagtacagaggatactttttttcccagaaatggaaaacaacatttcaaactgatattctgaaaaagcattcaagaatttaatcatgaccctttggcctgaaatgctgcagtgatatttttatgacccaagaattcctaagctattgctgctgtcc

SEQ ID NO: 33913 - DNA, 601 bp, Human
ggccagtatggtgaaaccccatctctactaaaaaaatacaaaaaattagctgggcgtggtggtgggtgcctgtaatcccagctattcagggggctgaggcagagaattgcttgaacctgggaggcggaggttgcagtgagccgagatcacgccactgtactccagcctgagcgacagagtgagactccatctcaaaaaaataaaaaaataaaataaaggaagctgcttgaaatacacccgatagaggtcccttttcttctgaacatttgtttaggcctctcgaaaggggcatcattttcaygaaaagtccatttatgtggacatgtggacaagagccctggggttttccattacaaaccagttgatgactattactgtgaactctgaagaatttccttttttaaaaaagaaaatccaaccctaggcctttctgcacatactcaaattggggcctgataatttaatttttaaagcgctctgacatccatcactgcatttcctataagatgttattctatgcaggagagaaaactgaagcccaactagcatatgtggcagagtctgcttcttctaggcttttcttttcaccaaagatctagca

SEQ ID NO: 33914 - DNA, 601 bp, Human
tgctggttagcaatctaaatccaaaaaatctatagtcccacacttgtaacttttggttattgccaaactttatatttaagactatgtcattgttctcataaaacccactaactctacaagtcttcttgccctgagtagaaaaagaagctcctacttacttcttgaccaaaggagctgtaagatctgtaaatgtcacaggtacatgaacactctaaactaagaataatgctagagtaaatacgagatcacttataagatccctgcataaaatatggtccagtacaaggggaggaggtaggtsggaaagattttgtaaaatgtttaagctgaatttctgcaaccatattaccacatgtatttaaaatcaactgttcagaaaatatcaacaaggcaaagacaaaagtctataaaaagtctgtcagtctagagagaacttctaaatcacagggcaaaatttcaaataatactggagcttcgttatttgctggcccttgaattccataggccaagaaggtatttggaagaggcaggtctagcaaatgaagtgactatcacataatcagtacaacaactatctcaactacactatgcagctgacagc

SEQ ID NO: 33915 - DNA, 601 bp, Human
gggtcactcaggttggaatgcaatggtgctatcatggcacattggagcctggacctcctgggctcacaggatcctcccgcctcagcctcccaagtagctgggactacaggtatgcaccatcatgcctggctaatttttgttctttattatagaaatggggtcttgccatgtttcccaggatggtctccaactcctggaggctcaagggatcctcccatcttggcctcccaaattgttgagccactgtgcccggctacgtgcttaccttttaacagaccagaaattgtgacaaagttaaaayctgctctaaggtgggctgctttgcatggctcaggcatctgatggactgctttacaacaaagtgaatactgcaggtgacagtgtggaaatctatttttcattatacaactgtcacttgatgtacatacttctttgctgtgtttatagaaggagtcatttttaattccaaaggaaaatagcaatttggaatagttttcagaagctgtaggaaggcaagcaatagaaagaacatttcacaagaggtatcctcgtagtgaatcacagttcacaatactacgtgcacatgcttcaagacaaagcg

SEQ ID NO: 33916 - DNA, 601 bp, Human
ctttttatgttggtagcacccagctaatggcattacagacctaaagcccagagttataccctagggtttctgtggttttcatttgtcctggaggacccccaaagaatgtactctgctgggaccttatttccttacagagacagtactgatatcaaatcatagttccagctacacaaacgaggcctactgcgggccaggcactatgctaggcacttcctatatatgacttcatcttcccaacgaccctatggtacagatattatgattaacctagattttacagatgaggaaatggggctcrgggaggtcacagatcttgtctaagtccacacgattaaaacatggtggctctcaaacccagtaacttctaggttcctttctttttcttctttttttttttttttggagacagtcttgctctattgcccaggctggagtgcagtggctcactgcaacctccgcctccccgtttcaagcaattctcatgcctcagcctcctgagcagctgggactacaggtgcccgccaccaggcccagctaattttttgtatttttagtagaagtgggggtttgccatgttgcccggctggtctcgacctcc

SEQ ID NO: 33917 - DNA, 601 bp, Human
cagaatggaaattgaagccctctttaatatccaatatttagaacagcttcctgttataggacaatataatgtgtgctatagtcacggcaaatgatcatttaaagaatttgcgtactgtaacttcaaggatccaaatcttaccgggttcaaaattaagcactcaggtaagactctttttgcaacagccatcctattgtcattttgataccaatactttcacctctgccaaacagcaatatcaatttaaaattagggaaatttagtttcgttgaaaataaaatacttacaaaaaaaaaaaaaacccaaaacctcatggagaaataatgcaacagttgaaaaaagaaacactttaaatatgctgaactaaacggtatgtacaactatgaatgacagcccttcaaggccccaattttcctgccatctcccagatgatcatcacttagtcttcctcaaatgaacctgtaatgtgtctgtttgccatctgctatcaccagttttctagtttttcctacgaattgcaattctacattttcataagatcagatcatttaattcacacaaattcctgggaaccgtgagacctcctcagggctttatcttc

SEQ ID NO: 33918 - DNA, 601 bp, Human
ggcgaaaccccaactctactaaaaatgcaaaaattagctgggcatggtcgtgggtgcctgtaatgccagctactcgggaggctgtggcaggaagaatcgcttgaacctgggaggtgaaggttgtagtgagctgagattgtgccactgcactccagcctgggcaaaagagccagactccatctcaaaaaaaaaaaaaaaaaaaagaaagaaagaaaagaaaagtttgtgatgtctcctttcatagaaatagaaacagcaaaacagcaacaaagaaccaagtagagtttttggcaaaataaayagtgtcttgtatttgaaatcaaaactcaaatttaaaaaattagttttagttatctccgatgaatcataatcttggacagcctgtctaaaattttagagtccttgcacagaatggaaattgaagccctctttaatatccaatatttagaacagcttcctgttataggacaatataatgtgtgctatagtcacggcaaatgatcatttaaagaatttgcgtactgtaacttcaaggatccaaatcttaccgggttcaaaattaagcactcaggtaagactctttttgcaacagccatcctat

SEQ ID NO: 33919 - DNA, 601 bp, Human
tgagcaatgcaaaaatccactgggattccttaagcatgatccctttattatgtaataggcattgagttagtaattaggcaaaataatagctgatgtgatcaggtcaaaaacaatagataaaataatgtaatggactagttgcaactattggcttcaactacataaggctatcaagtctaggcgatatcattcaagatgtagatgcttacggaacaacaaactaagagttggagaaacaaaacctattacaaaacacatcattcacttttttgtttgccccttttccccctcattctattaygcaatttgtatactcactcgtttccgatgaggactaatttctagcttcatcaccgcacatttgtttaaagtatttagacgcctatagagcaaagaaataacgttagcaaagataggcaaccactctctaatgagtggataaacacctgtttttaaacaattcatatatttaaggagtttcttgaaactcagtaatacctaatacctagaggagtattagaaacttatttaaaaagtgagtcatttaaaaataccttggccgggcgtggtggctcacgcctgtaatcccagcactttggga

SEQ ID NO: 33920 - DNA, 601 bp, Human
gacaatgagtggcaagcatggagcgctggcttctaggactcttctgcatagctcagtgggcgctgaggttccagttcatttgtttaaaagctttgactccccaagaaggcaactttttgcagctcagggattctggcataattaaaatttgaacccggaagtcagaaatatgttctttgaccagactcattcctgtttactctaatttgtgacacttactcccagtactacacccacctcttctcctaagatctcataaaaagtcttcacaactcacacgcagaagaaaataccatccagytcggttgtgtaccaccatttgactaaactgtgtgggatctcctgccttctcctcttcctcttccaattcctttcctccctccaaatctcttattattcttcaatattgcacaaatcggccttcgctttcatctctacagctttgaagcacagttattgttatatttgggaagacagaagagttggaaataaacctcagtttatttcctctatgagcaatgcaaaaatccactgggattccttaagcatgatccctttattatgtaataggcattgagttagtaattaggcaaaataatag

SEQ ID NO: 33921 - DNA, 601 bp, Human
gggctggggccgtccttcgggtgggagtcgtctggggacccagggaccaggtcttgttttggagaaaagacatcaaactcttcaagccgggaccacctcttgctgtccctttggaaagtccatttgccactgatggcacaaggctcatcctcgtctgaatcgtcactctgcaaagacagaaaggagccattcacacactggggctggcagccagcagggagcagggcatgagcaggaggctgctcataatatgccagtagtatcaatttcccccttgtacttcatgattttaattttaaattttttttttttttttttagaaatagggtctcactctgttgtacaggctgtattgcccaggctgattctgaactgctgacctcaagtgatcctcccacctgagcctcccaaagtgctgcggtgacagggataagctactgtgcccagccccacttacatattctttttcttttttaaattttttgtagagagcagtagtcttactatgctgcctaggctggtctcaaactcctggcctcaagcgatcctcccacgtgggcttcccaaagtgttgggattacaggcatgagccacagtgccc

SEQ ID NO: 33922 - DNA, 601 bp, Human
cttctcctcatccatcccctcttgcaagatgggcccgctgatgatcaaccccagctttgagggcgctttgtgcttgctgtgatgggagctcttgagcttcaggctctccatccgtttcagcagactgcgcgtcttggacttggcagttttttcgtggcctttcatgctgaagctgaagctggacagttccttgggagagggcaggctgccgaaagagtcgtcattgcctgccaagttgctggaggagcaaacgctgatgacggagttagtccggggggtggcagcatcctcgctggggggmgcgtggctggggaggctgccagtgctgctgaggctgcggacggaagacacctcctggcgctcgctgaggtccatcagcgtgcctccggggctggggccgtccttcgggtgggagtcgtctggggacccagggaccaggtcttgttttggagaaaagacatcaaactcttcaagccgggaccacctcttgctgtccctttggaaagtccatttgccactgatggcacaaggctcatcctcgtctgaatcgtcactctgcaaagacagaaaggagccattcacacactggggctggcagcca

SEQ ID NO: 33923 - DNA, 601 bp, Human
gaaacccatgtcatgcatttcaggctgtcaagcagaaattccagctctccaaatgacctctctgaacaggacccgaaagggcaaggccaaacaggaaaagaaccttgtgtaggattcctccctgctccacagatcccaccatgtgaggcttttacagttggttttgagtcactggaaacactgaccagaactcaagaagtattatggactttcagattcttgagggtttggtgggatgggggtgggccactccgaaatgagaatctaaaatatgcagttttaaatagccagcagggaaaayattactctaagcacagaggaactccagagaagacagactgctttgccttttgaatgctcaccagcagccatggcatgttactgtttatagctccaggaaaggtaaaacgaaagagcaaagttaagtttgtatttccatacagttaagtgtgtggtatcatggctataagtgtgcataatactcgctttgtcgggggagaaaagcccgacggcggaatgtgaaaagaacacattacgatccccaccgagaatctgaagcatgtgaggataaaccggtcaatacttatttctgtcattcaga

SEQ ID NO: 33924 - DNA, 601 bp, Human
tgcacgtaaaaacgtacaattgcatcagtcattagagactgggaaatttattttcacatcattcaataattacacagaaacctgttccacaaacaaggcggcaaggaagaaggtgatgacatgggtttccaagaggtcaccatgcagactctcttgtcaaaagaacgctatcaaggccaggcgtggtggctcacacctgtaatcctagcactctgggaggccgaggtgggaggatcacttgaggtcaggagttcgagaccatcctggccaatatggtgaaaccctatctctgctacaaatrcaaaaattagccagacgtggtggcgccctcctgtagtcccagccacttgggaggctgaggtgggagaatcgcttgaacctgggaggcagaggttgcagtgagccgaggtcacgccactgcactccagcctggatgacagagcgagactccatctcaaaaaaaaaaagaatgctatcaaggaagctacaagcttcagttggtcccatttttccccaatgccaacaatcttaagatcaaaggacactcacattggtagatctgtagaaaggtttccgagagtttgttcgtcattagtggctc

SEQ ID NO: 33925 - DNA, 601 bp, Human
atgaaaaatcttatctgagatatgtacaagaacgtaagaacagagatctctcagccttgagtacaaaatgttcagtatctctggagatttgcatgagtttaactgatttgttccttcttgaagtgggaaaagctgctaaaatattcagttctgaattgaactgaactgaaaatattcagttcagttcaattaataaataaaatacactgaattagtaatttcttaagttttagaaagcatgctcgagaggctataaaaatgcatatgaatatgcaaatatataaaaatgcaaataaacccrtaaacaatctacaggtagaaaatgctgatcccgatcttcaggtctccttgaatacataactctttaaaagagcatgtggtggaaaaatcaagtcactcaaatgtagctccataggacaaactgattaaacagctccatggttacagcacataacaaatacctcggtgaggaaaatgtgacctgtgtttttataaaatatgaaaggatgaaacaaccaatgaaataatccagaccagctccatttctcataaaataaagtccactgtgccaatcctagagacaatttgagcgctaagagag

SEQ ID NO: 33926 - DNA, 601 bp, Human
tgcctgctcttttagtttacagaacagttttttctttcctaagcatgaaaaaaaaaaatccctaatttatcaatctcaattactgaaaacactatacacttttgtttagtgttgatgaaaaatcttatctgagatatgtacaagaacgtaagaacagagatctctcagccttgagtacaaaatgttcagtatctctggagatttgcatgagtttaactgatttgttccttcttgaagtgggaaaagctgctaaaatattcagttctgaattgaactgaactgaaaatattcagttcagttmaattaataaataaaatacactgaattagtaatttcttaagttttagaaagcatgctcgagaggctataaaaatgcatatgaatatgcaaatatataaaaatgcaaataaacccataaacaatctacaggtagaaaatgctgatcccgatcttcaggtctccttgaatacataactctttaaaagagcatgtggtggaaaaatcaagtcactcaaatgtagctccataggacaaactgattaaacagctccatggttacagcacataacaaatacctcggtgaggaaaatgtgacctgtgt

SEQ ID NO: 33927 - DNA, 601 bp, Human
acctgcactagcataactaggccccaggcctctagctaagaaatacttttcaagttcctttagagctgaggaaaaggatcagttcgatggattttgtctgtgggggttaagtccagtgagactattttctcatgcacgccaacagaccagtctcaggtatgtctttattagcggtgtgagaatggactaatatagcggtctaaccttcttgcttgtttcaggaaagagtcccacaaaaccacagctacggagagtcctaggaagaatgtaggctgccccctgtgtgcatgcacctcccatrcagcccgtacctgggagaggaattctctctcttcagggtgttgagatggaagagggaaggcgctaagcacacggccaggttggttggggtcatctggttttcttttacggctgctgtgacatcgctcaggaaataaagcagggtctgcagaacctcccggttctcgtcaggcagcagcatgatggcagccttgatggcctgcaggcgctggtccttgggcacatctgcacgacaccagcactttctccatcagcttggtgaatttgcatggacattgcaaggaaatgtcccagagcaaat

SEQ ID NO: 33928 - DNA, 601 bp, Human
ttccagataatttgttgctttttctttctttctttcttttttttttttttgagagagagtttcattctgttacctagtggagtgcagtggcaaaatattggttcattgcaacctccacatccctgggctcaggtgatcctcccacctcagcctcccaagtagttgagactacaggtgtgcaccaccacacccggctaatttttaaatttttttttgtagagatgaggtctcaccatgttgcccgggttggtcttgaactccggagctcaagtgatccacccacctcagcctcccaaagtgytagaattacaggcgtgagccactgcgcccggctgcttttccaagtaaagggacaatttcattaaacatgattaactctagctgatacattataatatatgtaaataagacattctcaggctatttataccgtctccagctgtggaaaaggtcttcaggtaagacatgaacaagggtcaagcctaagattttgtacctattcacattatccttaataaaggagccaaacttctcaattccttacctggaaaagcttcttgcactcggcgatcatatgggccagcccttgagtggcagctag

SEQ ID NO: 33929 - DNA, 601 bp, Human
caatgcccatcagtggaaaagactgggtaggaacaatggcctggtccttaaagcagtgcaggcatcttcccgccggaggtgggctatcatgctgaccgcacgtgttatcacgaggatatgaacagatcacctccataaatgtatctgaaatcttatttccatgtaaggtctttggaaagttagagtagggggagtgaattacattggtcaaagcaggtttctcagatacggaagtggatacagcagtttaattccagataatttgttgctttttctttctttctttcttttttttttttttgagagagagtttcattctgttacctagtggagtgcagtggcaaaatattggttcattgcaacctccacatccctgggctcaggtgatcctcccacctcagcctcccaagtagttgagactacaggtgtgcaccaccacacccggctaatttttaaatttttttttgtagagatgaggtctcaccatgttgcccgggttggtcttgaactccggagctcaagtgatccacccacctcagcctcccaaagtgttagaattacaggcgtgagccactgcgcccggctgcttttccaagtaaag

SEQ ID NO: 33930 - DNA, 601 bp, Human
ggaacctgtgcggaacatgacagacagaaaggaggtgagtccacctgtactcaatctcaatgcccatcagtggaaaagactgggtaggaacaatggcctggtccttaaagcagtgcaggcatcttcccgccggaggtgggctatcatgctgaccgcacgtgttatcacgaggatatgaacagatcacctccataaatgtatctgaaatcttatttccatgtaaggtctttggaaagttagagtagggggagtgaattacattggtcaaagcaggtttctcagatacggaagtggatacagmagtttaattccagataatttgttgctttttctttctttctttcttttttttttttttgagagagagtttcattctgttacctagtggagtgcagtggcaaaatattggttcattgcaacctccacatccctgggctcaggtgatcctcccacctcagcctcccaagtagttgagactacaggtgtgcaccaccacacccggctaatttttaaatttttttttgtagagatgaggtctcaccatgttgcccgggttggtcttgaactccggagctcaagtgatccacccacctcagcctcc

SEQ ID NO: 33931 - DNA, 601 bp, Human
aaacaggccatccacacagtcctggaggaagtgttggtagtcagctgagtcatcattacccaggtgcccgagtgcttccagagtgaggggcttcagctcttgttcggtataggaattacgacatcggctcatttcctcgggaacctgtgcggaacatgacagacagaaaggaggtgagtccacctgtactcaatctcaatgcccatcagtggaaaagactgggtaggaacaatggcctggtccttaaagcagtgcaggcatcttcccgccggaggtgggctatcatgctgaccgcacgtgktatcacgaggatatgaacagatcacctccataaatgtatctgaaatcttatttccatgtaaggtctttggaaagttagagtagggggagtgaattacattggtcaaagcaggtttctcagatacggaagtggatacagcagtttaattccagataatttgttgctttttctttctttctttcttttttttttttttgagagagagtttcattctgttacctagtggagtgcagtggcaaaatattggttcattgcaacctccacatccctgggctcaggtgatcctcccacctcagcctc

SEQ ID NO: 33932 - DNA, 601 bp, Human
ctttaaacaggccatccacacagtcctggaggaagtgttggtagtcagctgagtcatcattacccaggtgcccgagtgcttccagagtgaggggcttcagctcttgttcggtataggaattacgacatcggctcatttcctcgggaacctgtgcggaacatgacagacagaaaggaggtgagtccacctgtactcaatctcaatgcccatcagtggaaaagactgggtaggaacaatggcctggtccttaaagcagtgcaggcatcttcccgccggaggtgggctatcatgctgaccgcaygtgttatcacgaggatatgaacagatcacctccataaatgtatctgaaatcttatttccatgtaaggtctttggaaagttagagtagggggagtgaattacattggtcaaagcaggtttctcagatacggaagtggatacagcagtttaattccagataatttgttgctttttctttctttctttcttttttttttttttgagagagagtttcattctgttacctagtggagtgcagtggcaaaatattggttcattgcaacctccacatccctgggctcaggtgatcctcccacctcag

SEQ ID NO: 33933 - DNA, 601 bp, Human
aggagttcaagaccagcctggccaacatggtgaaaccctgtctctactaaaaatatggaaattagccaggcgtggtggcaggcacctgtaagtccagctactcaggaggctgaggaaggagaatcacttgaacctaggaggcactttgcagtgagctgagatcacaccactgcactccagcctgggtgatgagaatgaaactccatctcaaaagaaaaaagaaaaaaatgatgacatttgtttttttttttctgggacctatatcagagtgcatgcaataaagaaatatcagtcactggcmgggcatggtggctcacgcctataatcccagcactttgggaggccaaggtgggcagtcacaaggtcaggagttcgagaccagcctggccaatatggtgaaaccccgtctctactaaaaatacaaaaattagcatggcgtggtggtgggcacctgtagcgccagctactcgggaggctgaggcaagagaatagcttgaaaccgggaggcagaggttgcagtgagccgagatcatgccactgcactccagcctgggtgacagagcaagactccatctcaaaaaatataaataaataaaaacaa

SEQ ID NO: 33934 - DNA, 601 bp, Human
tcattcctgtaatcccagcactttgggaagccgaggcgggtggatcatctgaggtcaggagttcaagaccagcctggccaacatggtgaaaccctgtctctactaaaaatatggaaattagccaggcgtggtggcaggcacctgtaagtccagctactcaggaggctgaggaaggagaatcacttgaacctaggaggcactttgcagtgagctgagatcacaccactgcactccagcctgggtgatgagaatgaaactccatctcaaaagaaaaaagaaaaaaatgatgacatttgttttkttttttctgggacctatatcagagtgcatgcaataaagaaatatcagtcactggcagggcatggtggctcacgcctataatcccagcactttgggaggccaaggtgggcagtcacaaggtcaggagttcgagaccagcctggccaatatggtgaaaccccgtctctactaaaaatacaaaaattagcatggcgtggtggtgggcacctgtagcgccagctactcgggaggctgaggcaagagaatagcttgaaaccgggaggcagaggttgcagtgagccgagatcatgccactgcactc

SEQ ID NO: 33935 - DNA, 601 bp, Human
gaaaatctatcctaaaaggggcaaaaatctgctacgaatgagcatattcattggaaggggcctctctttctgagctcagttaccaaagagttcagaccattctcagcgaggaacacactgctagaataaatgtagatctgttttccatatttgaaggtgttcactacttttctggaagcatatgttttgttttgtttatttagaaataaggtcttgctctgttgcccaggctgcggtacagtggcatgctcacagctcactgcggcctcaaactcctggctcaagggatcctcctgcctcrgcctcccgagtagctaggactacaggcatgcaccacaacatctagctgatttttaaaatttttttgtagagatagggtcttgctatattacccaggctggtcttgaactgctggcctcaagtgatcctcccaccttggcctcccagagtgctgggattacaggtgtgagccaccatatgcccggcctctactttaaataattataccatcttgtaagatcagtgacatataggcttggttcatatatggagtcatccttgtcacaaaaaaacaactgggaagcgctcaccttaaaacaac

SEQ ID NO: 33936 - DNA, 601 bp, Human
ctgtaatcccggcgctttgggaggttgaggtaggaggatcgcttgagcccaggagttttgagaccagcctggacaatatggtgaaaccatgtctctaccagaaacaaaaaaattagccaggtgtgatggcacatgcctgcagtcccaactacttgggaggctgaggggggaggattgcttgagcctgggaggtgaaggcttcagcagccatgagtgtgccactgcaccctagccttggtgacagaatgaaaccatgtccccaaatcaatcaaacaaccaaccaactaaccagatgcaactmcttgatcttgaacttcccagcctttagaaccatgagccaaataaatatctgttcattataattgcctggtctgtgagattctgttagagcagcattacatgcacgaagacactgtacaaggactgctgaatgaggaactctgtacagagccgttgttacagagggtttatgtgctcagacagtctcctctttgaaaaaagagcccatttgaagtgtagcttaaaaccatttttctatttcacaaatgtcttggaacacagacacctaaaggagcgctggctgtttgaaaaggtctggact

SEQ ID NO: 33937 - DNA, 601 bp, Human
tgcttgagctcaggagttcaagaccagcctggacaacatagtgatacctcatctctactaaaaataaaaaatattagccgggcatggtggtgtgctcctgtagtctcagctactccgggggctgagatggtaggattgcttaagctgtaatcatgccactgtactcaaacttgggcaacaaagtgatacccccccatctcaaaataaataaatataaaaataaaaatggcttgaggctgcacatttgctcttttgctctcccttgccctctctttgcccttccactatgggatgacacagyaaaaagaccctcattaggcatggtgggtggcccatgcctgtaatcccggcgctttgggaggttgaggtaggaggatcgcttgagcccaggagttttgagaccagcctggacaatatggtgaaaccatgtctctaccagaaacaaaaaaattagccaggtgtgatggcacatgcctgcagtcccaactacttgggaggctgaggggggaggattgcttgagcctgggaggtgaaggcttcagcagccatgagtgtgccactgcaccctagccttggtgacagaatgaaaccatgtccccaa

SEQ ID NO: 33938 - DNA, 601 bp, Human
ggggcctaatgggagctggattaatgccaattataaaagagcttaaggctgggttccatggctcacgcctgtaatcccagcactttgggaagctggggagggaggactgcttgagctcaggagttcaagaccagcctggacaacatagtgatacctcatctctactaaaaataaaaaatattagccgggcatggtggtgtgctcctgtagtctcagctactccgggggctgagatggtaggattgcttaagctgtaatcatgccactgtactcaaacttgggcaacaaagtgatacccccycatctcaaaataaataaatataaaaataaaaatggcttgaggctgcacatttgctcttttgctctcccttgccctctctttgcccttccactatgggatgacacagtaaaaagaccctcattaggcatggtgggtggcccatgcctgtaatcccggcgctttgggaggttgaggtaggaggatcgcttgagcccaggagttttgagaccagcctggacaatatggtgaaaccatgtctctaccagaaacaaaaaaattagccaggtgtgatggcacatgcctgcagtcccaactacttgg

SEQ ID NO: 33939 - DNA, 601 bp, Human
cctatcagagaaaagaaagaaaagctgatgaattatttaagttagaaagcatggaaataaaatgagaaacatctgtttgctagttcaaatgcataaaatctatcatttcccatgcctttgaattcatggccgagctaccatatttgctttgctttagaaccacattttctaagggaaccaaattacgaagtggtcgctgaaagaccaacaaacatgaaatgctactttctaaacaccattcttcatgaagtcaccaagaaaaaatgacgtgtttgtttaaggcattctttgcattagacacaaagtcagaatttccttcatgaccctcaccatataaaaaaatcagaatcagaacataccttaagtcaactctgcacatgtaggtgagtttggattttcctggcccacagggttcaatcaaatacctggacaagagcacattaaccctcacacccaccacaggtgcgcgatcgtgatccacagaggttagtaaaagggcacaggctcctttgggtaaattagtcctccaggttctgtagagacaaaaccagaggcagaaatgatggaatttcatagaagccaagtttaaaatcgtgcttca

SEQ ID NO: 33940 - DNA, 601 bp, Human
agaacctgggacctgcatgaaccaaagttgaaatacggtcggcggagaagcaggcatgcaggatgtggttagtgcatggtaattatcacttttaaaagcatttagttggctttagactaacttcacttttggaccaaagcttccacatttttaaaaagacatatcagaggcagttatgaggctaagtgagaattgggatgtaaacatgctttgaagctacggtgtcaactgtgcaaatgtaaaggttcattcatcttcagaacaatcagcccaggctgggccctgccagcccagcctatagacaggggcttctgtttccaacaggaagagctctgttgacagaagaggtttgcccaaaaagataataatagcaagtgaaaaagtgactatgcattgcccatctcctctatggcaaagttctaactgttccctatgaattaggtcactccatcctcacttggccccatgaggtaagtcctaatgtcaccattttacagatgaagaactagaatatgaagatactgagaggttagcaagtggacaccaagctgcaaagtgtcacagctgggatttaagcccagacagtgcggccccagagtat

SEQ ID NO: 33941 - DNA, 601 bp, Human
tatgtaatgacacacatgaaagatacaagggtgcaaatttcttgcagtgctgtctgtaatagcaaaaggctggaaagacacatgtgttcatatactgggcactgggcaaatacatgtagtggaatactatgtacctaaaaagagaaaagcaagtggattatggactgatgttgaaaagatctcccagaaatgtcaagtgaataaagcaaagtgtgggatactattttcacagggttttttaaaagggagaaataagaatatggtgatatgtatttgttctatctagaagtttctgtttgaytatttcagaagactatgtcacagacccagagtttagaggacacagatttagaaattgcatagtatacagtaggggttggcacactgcaatccgcctcaccacattttaaatttttgttggaacacattaagtacattcacttgtatactgtctatggttgctttcttgctataatggcaaagttgagcagttgcaacagaggtcatgtggccttcaatgcctaagatatttactatttgaccctttgcagaaaaggtttgcagaccttagtgtggaatgataagcaagcatctgtagcct

SEQ ID NO: 33942 - DNA, 601 bp, Human
ggtgggaaagaatggggaaagccattctgtacagcaaacaccaaccttcaaaacgtcatcagagtatagtggcaatctagattgaggacagacacaaggaagaacttcccaatagtcaagcctaactctaaatactttgctgagtcaatctaaggaattgaaagaaatttatttccgtctaaaccttgaaagaaagggtaaatattcactgagagatgcactggcatgtaaccctgaatgggcaagctcttagacatgtgtttcatacataaaatgttctaaggattccagtaggctgccygaaataaataaaaaatgttgttttaaatgcatttacccttggacccagcgatgccacttctgagaacttttttctagggctgtacctgcacatgtatgtaatgacacacatgaaagatacaagggtgcaaatttcttgcagtgctgtctgtaatagcaaaaggctggaaagacacatgtgttcatatactgggcactgggcaaatacatgtagtggaatactatgtacctaaaaagagaaaagcaagtggattatggactgatgttgaaaagatctcccagaaatgtcaagtgaataaag

SEQ ID NO: 33943 - DNA, 601 bp, Human
ggaaacaaacgtggctggcacctataccattgccctgtgtgtgtatatgtgcatgtgagtgtgtactggtgggaaagaatggggaaagccattctgtacagcaaacaccaaccttcaaaacgtcatcagagtatagtggcaatctagattgaggacagacacaaggaagaacttcccaatagtcaagcctaactctaaatactttgctgagtcaatctaaggaattgaaagaaatttatttccgtctaaaccttgaaagaaagggtaaatattcactgagagatgcactggcatgtaaccstgaatgggcaagctcttagacatgtgtttcatacataaaatgttctaaggattccagtaggctgcccgaaataaataaaaaatgttgttttaaatgcatttacccttggacccagcgatgccacttctgagaacttttttctagggctgtacctgcacatgtatgtaatgacacacatgaaagatacaagggtgcaaatttcttgcagtgctgtctgtaatagcaaaaggctggaaagacacatgtgttcatatactgggcactgggcaaatacatgtagtggaatactatgtacctaaa

SEQ ID NO: 33944 - DNA, 601 bp, Human
gaaatgcaaaagcgatgaggggaacaggatgatggaatggagctcccattagatggcagggattggaagactagatgacaacacaggccctcgtgctggggattcaaatagccccacatcccctgagctgtgggcaagaacatcagggactttgggtaaattcaagtggaaacaaacgtggctggcacctataccattgccctgtgtgtgtatatgtgcatgtgagtgtgtactggtgggaaagaatggggaaagccattctgtacagcaaacaccaaccttcaaaacgtcatcagagtayagtggcaatctagattgaggacagacacaaggaagaacttcccaatagtcaagcctaactctaaatactttgctgagtcaatctaaggaattgaaagaaatttatttccgtctaaaccttgaaagaaagggtaaatattcactgagagatgcactggcatgtaaccctgaatgggcaagctcttagacatgtgtttcatacataaaatgttctaaggattccagtaggctgcccgaaataaataaaaaatgttgttttaaatgcatttacccttggacccagcgatgccacttctgagaa

SEQ ID NO: 33945 - DNA, 601 bp, Human
acaagcttgagagatacagaaatgtgatatctgactattaactggtctccccggctccacccatgtgctatacttttaaaactcaaacctgaccacatcatggtcctccttacattttttccatggctgctgtcatctggacctggattaaatttcagtctcttgtgagtagaagaggcagtggagacctctaagcatttccctcaatctaaaaattctgagtttcaggctgggtgctgtggctcacgcctgtaatctcagcactttgggaggctgaggcaggcgggatcacctgaggtcrggagttcaagaccagcttgaccagcatggagaaaccccgtctctactaaaaatacaaaattagccaggcatgatggcgcatgcctgtaatcccagctactcgggaggctaaggcaggagaattccttgaacccaggagacagaggttgcagtgagcctagatcacaccatggcactccagcctgggcaacaagagtgaaactccgtctcaaaaaaaaaaaaaaaaaatctgagtttcagcccaaattctatcttttaccagagctgtccatggcaggacaggcccaggaagacagagaaa

SEQ ID NO: 33946 - DNA, 601 bp, Human
tttttttgagacggagtcttgctctgtcgcccaggttagagtacagtggtgtgatcgcagctcactgcaagctccgcctcccagggtcacgccattctcctgcctcagcctcctgagtagctgggactacaggtgcccgccaccacgcccagttatttttatttttattttttgtatttttagtagagacgggatttcaccatgttagccaggatggtctcgatttcctgacctcatgatccacctgcctcggcctcccaaagtgctggggattacaggtgtgagccactgtgcccagccsagactttccttttcatctcaaaatagaagtccagcagaaaagcagacacattaactggactcctttctgacaatagccttgatagataaaaagctgaaggtctaagctgatcacaagcttgagagatacagaaatgtgatatctgactattaactggtctccccggctccacccatgtgctatacttttaaaactcaaacctgaccacatcatggtcctccttacattttttccatggctgctgtcatctggacctggattaaatttcagtctcttgtgagtagaagaggcagtggagac

SEQ ID NO: 33947 - DNA, 601 bp, Human
cttgcccgcaatgtttgcacaatgatctacttaaaccaatggaaagaaaaaggaaaaagagaagacgggatgaggaaggggaaggaaagccacatcctctacttgcctggacatcaaactcttgcaggaggccggtgatggtctgtgaaaagacaaaaaaaattgtcaatttcatctgttttctctgtaagagaaataatattgggacatatgggcctttctatgacctgaatctgtacctacacttcctcctttgtggggtctccttaattcctcacaaaggcaggctttccttttctcttttttttttttttttgagacggagtcttgctctgtcgcccaggttagagtacagtggtgtgatcgcagctcactgcaagctccgcctcccagggtcacgccattctcctgcctcagcctcctgagtagctgggactacaggtgcccgccaccacgcccagttatttttatttttattttttgtatttttagtagagacgggatttcaccatgttagccaggatggtctcgatttcctgacctcatgatccacctgcctcggcctcccaaagtgctggggattacaggtgtgagccactgt

SEQ ID NO: 33948 - DNA, 601 bp, Human
gccagctctttgggactgaaacaggcggtgtctctgtcctgctttcgtgggaagtgactggttcctgattctctggccagcactcaagtcagcttctgtctgggagcagcagctgagggtgaggacctagctgagaccactgccttctctccccttgcccgcaatgtttgcacaatgatctacttaaaccaatggaaagaaaaaggaaaaagagaagacgggatgaggaaggggaaggaaagccacatcctctacttgcctggacatcaaactcttgcaggaggccggtgatggtctgtgraaagacaaaaaaaattgtcaatttcatctgttttctctgtaagagaaataatattgggacatatgggcctttctatgacctgaatctgtacctacacttcctcctttgtggggtctccttaattcctcacaaaggcaggctttccttttctcttttttttttttttttgagacggagtcttgctctgtcgcccaggttagagtacagtggtgtgatcgcagctcactgcaagctccgcctcccagggtcacgccattctcctgcctcagcctcctgagtagctgggactacaggtgcccg

SEQ ID NO: 33949 - DNA, 601 bp, Human
ggtggtgggtgcccgtaatcccaggtacttgggaggctgaggcaaaagaattgcttgaacccagtaggtggagattgcagtgagccacgatcgcaccactgcactccagcctgggcaacagagcgagattctgtctcagaaaaaaaaaaaaaaagaaagaaagaaaaagaaaaaagaacgaataaagtgtggtaaatccatacaatggaatattattattcaataaaggaataaaggaaatacaaatattaatgcatggcctggataaaccttgaaagcactaagaaagaagccagttacmaaaaaaaaatcacatattatttgattcaatgtatacaaaattccagaacaggcaaattcacagaaaaggaaagtcaatgaagggtcagtcatctgagggtggggtgacagataaaaggtacaggattttttggaaggatgaaaatgttccaaaattgtgctgatcgttgcacaattctgtgaaaagactgaaaaccatatgcgtgcattaatatagaagtcactgccacagatagcaaacagcttcctgtgttcccagcgcctccgggcacacagacaactccgtgcccacatgcagcgc

SEQ ID NO: 33950 - DNA, 601 bp, Human
tgtaatcccagcactttgggaggtggaggtgggtggatcacctgaggtcaggagttcgaggtcagcctggccaacacagtgaaaccccgtctctactaaaaatacaaaaattagtcaggcgtggtggtgggtgcccgtaatcccaggtacttgggaggctgaggcaaaagaattgcttgaacccagtaggtggagattgcagtgagccacgatcgcaccactgcactccagcctgggcaacagagcgagattctgtctcagaaaaaaaaaaaaaaagaaagaaagaaaaagaaaaaagaamgaataaagtgtggtaaatccatacaatggaatattattattcaataaaggaataaaggaaatacaaatattaatgcatggcctggataaaccttgaaagcactaagaaagaagccagttaccaaaaaaaaatcacatattatttgattcaatgtatacaaaattccagaacaggcaaattcacagaaaaggaaagtcaatgaagggtcagtcatctgagggtggggtgacagataaaaggtacaggattttttggaaggatgaaaatgttccaaaattgtgctgatcgttgcacaattct

SEQ ID NO: 33951 - DNA, 601 bp, Human
tcctcaccatacctgccacccagattctctaagatcctctaagtttctctcttctctcatctacctgccagaagcacagtttccagcagaaggctctgcagccccaggggatggcaaacccacaagctagaaggagcctgggtccttgaattgccaaatagaacatgtcccactaaacacccactaaactgttacatgagcgagaaataaaacatatactgtgttaagccacagagggcttggcatcttttgttacagtggtaagcctattataaaccaacaatgagcctctccgaatggrgagagacgctgccatatgcaattccagttccttgtcagagtcaataaaatgagatagtgtaaatcaaaatacctagcatggacctggtacaaaatggatataagggaaacagacaggggaagaagtgagataaaagaaggtgagaatgaagtgaaaaagtgttttcagtggatttcagtgacaccatccccagcctcaaggtattaataaggtattaataagctttatagaaacaaatgaaaatcaggcagtccatcgtcaaaaatcaagcaagcttgcaatactcaagttcataaaaat

SEQ ID NO: 33952 - DNA, 601 bp, Human
gatggccctggcatgagatggctttgccctcctgatcctctctttccatctgggtccactataccctcccatctggggtactggtccaggacacacataattttcaaacgaggaggagcatgggaggtgaggcgtgcctcctcctttcatgtggcctggatgagtctcctcactgctgaagcctaaggaagtcgggctgctcaccctacctcctgtcccttttcctcctgggcactcagctagacggtatatcccaagctcccttgcaatgagaggcagccatgtgatctgtttctggccratagcctgtgaccgtcaccatttcctcaccatacctgccacccagattctctaagatcctctaagtttctctcttctctcatctacctgccagaagcacagtttccagcagaaggctctgcagccccaggggatggcaaacccacaagctagaaggagcctgggtccttgaattgccaaatagaacatgtcccactaaacacccactaaactgttacatgagcgagaaataaaacatatactgtgttaagccacagagggcttggcatcttttgttacagtggtaagcctattataaacc

SEQ ID NO: 33953 - DNA, 601 bp, Human
tcctcgtagttgaagagggggttgtagcaggttttgtctgaagaacagcagtgagggagagaagagaaaaaagtaagatgagaaaaaaattaggtgtctcggtggcaaagcacattcattttgtttcattcctattcagaagtaggaagtgaacttagaagaacacagatgttggcgttttttgttttttggttttgtccccatgcccactttcctctgctgataaaaagcaagagtaagtttcatggggcaagggagtggtagctggcagatgagtcttgcagttggtgctggaaggggytcccaggctggctcctgtagctcctccagtcagccagggtcaggatggccctggcatgagatggctttgccctcctgatcctctctttccatctgggtccactataccctcccatctggggtactggtccaggacacacataattttcaaacgaggaggagcatgggaggtgaggcgtgcctcctcctttcatgtggcctggatgagtctcctcactgctgaagcctaaggaagtcgggctgctcaccctacctcctgtcccttttcctcctgggcactcagctagacggtatatcccaa

SEQ ID NO: 33954 - DNA, 601 bp, Human
ctgtccaggctgagcacacctatcgtaacgccagccttgcaggaaggctgggggaatggggagatagtatctgataagtatgttgtttcagtttgggaagatgaaaaagtcctggagatggatggtggtgacggctgcacaacaatgtctgcatgtccttaatgccactgaactatatacttaaaaatagtgaaagtgctaacttttatgttatgtatcttttcccacaatttaaaaagtgcttaagatgatacgttttatattttaccacagttaaaaagtatttaaaagagcaaagcasctgaacccctccccgacacccagtttccaccctgtagagctcatagggcaagaggcctctcaccctgcggggaaggaggctgcgccgtcctgctggccaggggcgtccacgtggcagacggcaaagtgctgggtgatctcctgcatgtcctcgtagttgaagagggggttgtagcaggttttgtctgaagaacagcagtgagggagagaagagaaaaaagtaagatgagaaaaaaattaggtgtctcggtggcaaagcacattcattttgtttcattcctattcagaagtaggaagtgaa

SEQ ID NO: 33955 - DNA, 601 bp, Human
tttcaccatgttggccaggctggtctcaaactcccaacctcggtggtccgcccaccttggcctcccaaagtgctgagattacaggcatgaaccaccatgcccggcctcagctgtgcaaccttcagcaaggtagttaatgcctccatgcctcaatatgtttgtctggaaaatggagctaacaacagcagccacacagagctagctgtaaggattaagcccagtgttagatacaaatgatgaagcctagcccacaggaagggctccatcaatgttacttctctccctctctgtttctccccaracttctaggtttttcttcacactatttggtggtgtcaagtcctcctccactgaagtcctgtccaggctgagcacacctatcgtaacgccagccttgcaggaaggctgggggaatggggagatagtatctgataagtatgttgtttcagtttgggaagatgaaaaagtcctggagatggatggtggtgacggctgcacaacaatgtctgcatgtccttaatgccactgaactatatacttaaaaatagtgaaagtgctaacttttatgttatgtatcttttcccacaatttaaaaagtgct

SEQ ID NO: 33956 - DNA, 601 bp, Human
ccgccaccacgcccagctcatttttgtatttttagtggagacagggtttcatcacgttggccggagacagggtttcaccatgttggccaggctggtctcaaactcccaacctcggtggtccgcccaccttggcctcccaaagtgctgagattacaggcatgaaccaccatgcccggcctcagctgtgcaaccttcagcaaggtagttaatgcctccatgcctcaatatgtttgtctggaaaatggagctaacaacagcagccacacagagctagctgtaaggattaagcccagtgttagayacaaatgatgaagcctagcccacaggaagggctccatcaatgttacttctctccctctctgtttctccccaaacttctaggtttttcttcacactatttggtggtgtcaagtcctcctccactgaagtcctgtccaggctgagcacacctatcgtaacgccagccttgcaggaaggctgggggaatggggagatagtatctgataagtatgttgtttcagtttgggaagatgaaaaagtcctggagatggatggtggtgacggctgcacaacaatgtctgcatgtccttaatgccactga

SEQ ID NO: 33957 - DNA, 601 bp, Human
aactaaggcagcctgatgttccaaagaggatacacgtctcagtagataggatcaaagccaactccccagtcatcagctgtgcaacctttttttcttttttggagacagagtcttgctctgtcacccaggctggagtgcagtggtgcgatcttggctcactgtaacctctgcctcccaggttcaagggattatctggcctaagcctcccgagtagcagggattatagccacccgccaccacgcccagctcatttttgtatttttagtggagacagggtttcatcacgttggccggagacagkgtttcaccatgttggccaggctggtctcaaactcccaacctcggtggtccgcccaccttggcctcccaaagtgctgagattacaggcatgaaccaccatgcccggcctcagctgtgcaaccttcagcaaggtagttaatgcctccatgcctcaatatgtttgtctggaaaatggagctaacaacagcagccacacagagctagctgtaaggattaagcccagtgttagatacaaatgatgaagcctagcccacaggaagggctccatcaatgttacttctctccctctctgtttctcccc

SEQ ID NO: 33958 - DNA, 601 bp, Human
ttaaacacaggtcaggtgcagggacaagaggggttatctctgaggtctgccacccccacatgatgctgattgggggatccaacaagcttgaccataattgcacaaggggaaattgaaaggccatgcccatacagatcacgagctgacaagggccaggcagtgcaaatactctcaactaaggcagcctgatgttccaaagaggatacacgtctcagtagataggatcaaagccaactccccagtcatcagctgtgcaacctttttttcttttttggagacagagtcttgctctgtcacccasgctggagtgcagtggtgcgatcttggctcactgtaacctctgcctcccaggttcaagggattatctggcctaagcctcccgagtagcagggattatagccacccgccaccacgcccagctcatttttgtatttttagtggagacagggtttcatcacgttggccggagacagggtttcaccatgttggccaggctggtctcaaactcccaacctcggtggtccgcccaccttggcctcccaaagtgctgagattacaggcatgaaccaccatgcccggcctcagctgtgcaaccttcagc

SEQ ID NO: 33959 - DNA, 601 bp, Human
tggacaccggggccaggaggagcccagccagggatcccctaccctgctctgctgtctcggcttcagaatacagggggctcacccttaaagggcctgggagatgctccctcacccctcccaagccccacactctcctctgccctactccaggaggaagaaacaagtcaggtcccactctgacagtgggtcccaccagatgcacacgaaaaccacatagtaaactagggggaaaatgcgctgtaatacccagaccaacggaataaaaattcctgggggtggggctcaggcctcagaatatttstaaaacttcaccagggggaactaagagtctctgctttcccccaagtctttcacacaactggtccaaccaaagatttacggacacacctctggctttatctgctggttaacaattaaccacgtcccactgttttaatacacttttaatttttggtcctggccccatacggttggctgtcccttcccttcctctctgataaaggttaattattaaggataattctgaacactaataaaaaaggatatctatttataaatgccaagaaggccccttctggaagactttaagcccaagaacctg

SEQ ID NO: 33960 - DNA, 601 bp, Human
tccacatcaacagagccactgagctgagaagccgcagggcagaagtgcggcaaagacatgaagctcctctgaaatggccatggctcaatttggagccagcagctcctaaggtgtgacactggagaagccacttaattgcagggccctctgtttcttccctgttccccagggctggtgtgaggcgaggaagcagcagaattctacttccaaggtccctcctgtgtaggtggtggacaccggggccaggaggagcccagccagggatcccctaccctgctctgctgtctcggcttcagaatayagggggctcacccttaaagggcctgggagatgctccctcacccctcccaagccccacactctcctctgccctactccaggaggaagaaacaagtcaggtcccactctgacagtgggtcccaccagatgcacacgaaaaccacatagtaaactagggggaaaatgcgctgtaatacccagaccaacggaataaaaattcctgggggtggggctcaggcctcagaatatttgtaaaacttcaccagggggaactaagagtctctgctttcccccaagtctttcacacaactggtccaaccaa

SEQ ID NO: 33961 - DNA, 601 bp, Human
caggaagatgctagaaaccaggcttctctgcagacagagaaggagctgatccttcgctcttacccaaactgttgaaggactccaggaagcatttcagccagctgatccatggaggggtacatgtacctggggatgacacagagaagccattagtgagcgcccggacagaaacgggtaatccaaacagggacacgcttgaagggtggggaccatgcagcagcctgccccatgcacccagacccccccacccccaagtctagtcccttcgcatcctccttccaagacccctgcagcacactcyatcaattgcttcctacgctccaggtcccatggacacattctgggaattagctcattcaattttcacaataactctaggaggctgctaggatttcccctcatagcaagattataaacatcactgaggctgagagatgagacacttggcctcacaagagcagtagatggttagccagaaacatgtcctcactgtgtttgtctggttttgggtctagggtgttgcagaaactgactagaaggcatttcacaattccaatgtcagggagaaggaattaaaacaggcatgaatgagttccatccg

SEQ ID NO: 33962 - DNA, 601 bp, Human
gaggagacagactagagctcagagactgtgtgaagaacagtgttcacagagtgacgagctaatttcttgcctcatctctaaattgcaaccttaattttagtggtcagtccagatcaaagccaaggggcaggaagatgctagaaaccaggcttctctgcagacagagaaggagctgatccttcgctcttacccaaactgttgaaggactccaggaagcatttcagccagctgatccatggaggggtacatgtacctggggatgacacagagaagccattagtgagcgcccggacagaaacgsgtaatccaaacagggacacgcttgaagggtggggaccatgcagcagcctgccccatgcacccagacccccccacccccaagtctagtcccttcgcatcctccttccaagacccctgcagcacactctatcaattgcttcctacgctccaggtcccatggacacattctgggaattagctcattcaattttcacaataactctaggaggctgctaggatttcccctcatagcaagattataaacatcactgaggctgagagatgagacacttggcctcacaagagcagtagatggttagcc

SEQ ID NO: 33963 - DNA, 601 bp, Human
gctattaaagacaatcctcaggcttcacattagccagtggtcgacatccccagaccttcgagtctcactcaggacagctatcatgaagcccagcgggttgactggaatgtcacttcctttgctggaaaatcaaataaaaaacagggagtgtgttccactccagaacgtcatacaggctggacggaagggctcctgcattctggaggaatgttcaaagaacaaatgcaaaatcacagtggctggtacagggcaggggatggggcaagaggcagggccccttcaaaccatcggtccctggcasccacccaaaattgggcaaaaatgcacttgcagaatgagaagctgcgatcacctcagcttgaaagactctgtcctatttcaactggaatgacctccccctctccttggccaacactgaggcctttacagggaaaaaaacaaaaacaaaaacaccacaatgataatttttaaaagataaacaaggaaccttaggacaccagccaggacagagcttcccaagacagcacaggtcccttctcctccaggcagcctaccctgcttgccaggcctgcctgtctcccaccctggacaggagccccag

SEQ ID NO: 33964 - DNA, 601 bp, Human
aggtcaagggaaggactgcaagaagtaactgcacacatcacagtatctaataccaatgcctggtaatcgaaaggctggagttgaaaaagaagggaatagtacagctattaaagctgtactgaagggaatagtacagctattaaagacaatcctcaggcttcacattagccagtggtcgacatccccagaccttcgagtctcactcaggacagctatcatgaagcccagcgggttgactggaatgtcacttcctttgctggaaaatcaaataaaaaacagggagtgtgttccactccagaaygtcatacaggctggacggaagggctcctgcattctggaggaatgttcaaagaacaaatgcaaaatcacagtggctggtacagggcaggggatggggcaagaggcagggccccttcaaaccatcggtccctggcagccacccaaaattgggcaaaaatgcacttgcagaatgagaagctgcgatcacctcagcttgaaagactctgtcctatttcaactggaatgacctccccctctccttggccaacactgaggcctttacagggaaaaaaacaaaaacaaaaacaccacaatgataatt

SEQ ID NO: 33965 - DNA, 601 bp, Human
cccccagttgattgtgtcttgttctctccacccccacatggggccctgtgctgagcaccacacaatgccttgctcagcaggaacaacagatttgccagaccacgcaactcaccttcccaaaaaggtgggacaccaccatgtccggcagagcttgggtccatcctgagatctggaaaggagtaaagtgggtggatgagaaaccaggagctaacagtagttaacaaggtcagcaaaaccccacttccctgggtgcagggtggcattgctggactcccccctacatgcaggcctcaaggacatsccccttgatagaaactcagttcctgtctccagttccctcctggacctgatcccccaaatgcagggcctgggactatatccagttccttattttcagaggcccatgcacaagatgcacagcaaataagtgctgaataaagacccagctactgctagcttaccctgctccaaacattcaccaagtcctcagcaaagagggccatccattcacctcttctaaaaacacactgagctccccagtctataccccaagatatgcttggctcccaactatccctcctctctcatctccaagccagtt

SEQ ID NO: 33966 - DNA, 601 bp, Human
tcaaaatggttatgctgagggaaagaagccagaccaaaataaaaaaaaaaagagtacctactatataatgccatttatataaaattctaggaattgcaaagcaatctatagaggccaatgctgatcagaagttgcctgaggaggagggagaggaggactatcaaggggcacaaggaaactcttggagtgatggagacgttattctcctgattacagggatggttttacaaatgtatatgcatgtcaattgtacactttaaatatgtgcagttaattgtacttcaatcagctgtttttaaargacacataaaaaagagagagaatgaatgacttgttgcttatgaatgaataatgtcacattatctcatgagcaccagctcggtggcccccagttgattgtgtcttgttctctccacccccacatggggccctgtgctgagcaccacacaatgccttgctcagcaggaacaacagatttgccagaccacgcaactcaccttcccaaaaaggtgggacaccaccatgtccggcagagcttgggtccatcctgagatctggaaaggagtaaagtgggtggatgagaaaccaggagctaacagta

SEQ ID NO: 33967 - DNA, 601 bp, Human
ctcaaactcctgggctcaagcaatcctcctgcctcagcctcccaagtagctaggactataggcatgcagaaccaccatgcctggccaatttttaatttttctgtagagacaaggtgtcactatgttgcccaggctggtcttgaactcctgggctcaagcaatcctcctgccatggcctcccaaagtgctgggattataggaatgagcactgcaccccgactaggaataaactattgatccactcattaacatggacaaatctcaaaatggttatgctgagggaaagaagccagaccaaaawaaaaaaaaaaagagtacctactatataatgccatttatataaaattctaggaattgcaaagcaatctatagaggccaatgctgatcagaagttgcctgaggaggagggagaggaggactatcaaggggcacaaggaaactcttggagtgatggagacgttattctcctgattacagggatggttttacaaatgtatatgcatgtcaattgtacactttaaatatgtgcagttaattgtacttcaatcagctgtttttaaaagacacataaaaaagagagagaatgaatgacttgttgctt

SEQ ID NO: 33968 - DNA, 601 bp, Human
tagcctcaaactcctgggctcaagcaatcctcctgcctcagcctcccaagtagctaggactataggcatgcagaaccaccatgcctggccaatttttaatttttctgtagagacaaggtgtcactatgttgcccaggctggtcttgaactcctgggctcaagcaatcctcctgccatggcctcccaaagtgctgggattataggaatgagcactgcaccccgactaggaataaactattgatccactcattaacatggacaaatctcaaaatggttatgctgagggaaagaagccagaccaaaataaaaaaaaaaagagtacctactatataatgccatttatataaaattctaggaattgcaaagcaatctatagaggccaatgctgatcagaagttgcctgaggaggagggagaggaggactatcaaggggcacaaggaaactcttggagtgatggagacgttattctcctgattacagggatggttttacaaatgtatatgcatgtcaattgtacactttaaatatgtgcagttaattgtacttcaatcagctgtttttaaaagacacataaaaaagagagagaatgaatgacttgtt

SEQ ID NO: 33969 - DNA, 601 bp, Human
gtgagcagccactagccaaggaatgccgacagcgacctggagcagtaagaagcaaggacgaatttcccctggagcctgtggcggaggggcggccctgccagcgcttgacatcggagttctagactcagagctgtgagagaatacacttttgttttcctttttctctgtttttgagacagagtctccctctgtctcacccaggctgcagtgcatggcgcgatctcggctcactgcagcctctgcctcccaggttcaagtgattctcctgtctcagcctcccgagtagctgggattacaggcrcgtgccaccacatccggttaattttgtattttcagtagagacggggtttcaccatgttggccaggctcgtctcgaactcctgacctcaggtgatccactcgcctaagcctcccaaagtgctgggattataggtgtgagccaccctgctcatcccactttcgctgttctaagccatcctgtttgtggtaatttgttacagaagccacaggaaaccaacacaacaggcaaacctagcagttgtactcgccaactccagagtggagcctctgttcccctggtacactcgccaactccagagtg

SEQ ID NO: 33970 - DNA, 601 bp, Human
tccaaataacttggggtataatcagatcagatgctcaacgctatgtctgacatccctcctccagtgaaacagagacagtggctgtgaatttttcccaattcctatcagtttcagattacacactcaggacagggaaaatgtgtcacacgctgtggaatgaatcgtaaaaggggaaagaggactctagtgggctaaactgtggccctcaaaagatatgtccatgtcaaatctcttgaacttgggaatgcaaacttgctgggaaaaagggtttttgcaggtgtaattaattaaggatcttgakatgagataatcctggattacatgagccgggatgaaatccaatggaaagtatccttaaaagaggaaggagagggagaaataaaacagacacagaggagaagaccatgtgaagacagaggcagagagtggtgtgagcagccactagccaaggaatgccgacagcgacctggagcagtaagaagcaaggacgaatttcccctggagcctgtggcggaggggcggccctgccagcgcttgacatcggagttctagactcagagctgtgagagaatacacttttgttttcctttttctctgtttt

SEQ ID NO: 33971 - DNA, 601 bp, Human
cccacatttcggatctacagaagacacctcataaatagcaatgatgtggctgaactacatcccaatacctgttgtaggcattgatgaacaggtgcaggttgccggggttcatgtcattcacaatgtgctggcggtaggtgtggaccacttccacgttactctgcatttcttcctgcatttagagaggtgagaagatggtcctcatcgcactgtggccctgagctggtcactactctctccattctccaggttatttggagacaaagtaaagataataatgcctaatccacaagacagcgayggacctaaaaaaaaaacctttgggaaagcaacacgcccaaccaggtgcagacaggggtttcactatccgctgggagcagaaaagacccccatcctggaaaggccacaccccacccttccaaactcattactttgggagtttcaatttgaagtcagacatcctggatctagagcttagcttcatcactgtccctttcgtaggcaaatctttcaacctctctgagcctcagatctcttaaaaaaaaaaaaaaaaaaaagggaagagagagaatgttgcctacttcactaggttgtaggactt

SEQ ID NO: 33972 - DNA, 601 bp, Human
ggccacgccttaggcaaaggccatgttcaggtcctccttatccttggaatgacaaactcccagaagcctgcctggattatccccggcctccaggagtgctttgctgctctctcacttagctcttcttacatttggcctttcgtgaaggtcagcagcgggcacacatatttactctcaaccctctgagtgtgcgactgcgtccctctcacgtctgcacccccagtggtctggagtgtttgttcagatccctgcaaggcgagctgaatgccaggaaccagcttacaggccaggtgtccttccyggggacacctgtcctattaatctatttgctcaaactcagagcctgcctcttccgctcattttatactctccctctcatctgtcccacatttcggatctacagaagacacctcataaatagcaatgatgtggctgaactacatcccaatacctgttgtaggcattgatgaacaggtgcaggttgccggggttcatgtcattcacaatgtgctggcggtaggtgtggaccacttccacgttactctgcatttcttcctgcatttagagaggtgagaagatggtcctcatcgcactgtggccc

SEQ ID NO: 33973 - DNA, 601 bp, Human
cctagaaacggatgccaccggcacagggagaagtccaagtcaggctgggtaatgctcagtctctgggtggaatatatccaggtctcactgacacaatgtcctgccacactcagaaagaaggccctgccagcaaggccacctttatagtgggcagccccgactgcaagtgctgggggagagaaaagccactcactgcagggtgactgtgtgggttcccggcattggtcgctcaatctccaggtcgcgccggctgcaggaaacaaatgcatcattagcatgaggacccctcccctggagaaakctcccactcccatccagccaagcccaggaggtcctgccagtggccattctggtaagctacccacatccccaacttgagagaggccctgtggctttcaggactccacaccctcttggtgtccacagacctggttagagggacagcacaacacatgcatttcaagcagagccccctcattttgtcacaaatatttgtggggcttttttttccaggagtagaagtcagattctccaccatagagggtccccgccttccctgtccccctagtcagagcccccacctgacagaggggccacctcc

SEQ ID NO: 33974 - DNA, 601 bp, Human
agatcactgcacaaagcatggcagtactgcaggactctgatccatagcccctaagtcttccatctccccagctgtggggttgtttgaaaggcagattcctctctttgctgccacaaagttgcaggtgggagttaaggggtgaaaggagtcaggaagctttgctaagccctgcctcccagtgcctctctcccctgccagctcatcaggcaccagtcagtttggaaagatccagctgcttcccaaataagaggtgagtctcttggccaggaagccaagtggcaaacatgcccatataaacaarccgatgggacacagactggcgggtgaggggacctgggagaggagacactgccaagcaaccagggctggcagccaccagggaaagagactgagtggctgggccctctgcccaaaggccaatatggcatttcaaaaaacatcacctgccctgatggggcagaggagaggaggggcaggcagggccacttcaacaaagtcaaccagactttgcctgttgaattaaacacagaaatcagctgtgatttctacataccacggcatccactgcaggcgagctgtccccaaccaccaacagagcagg

SEQ ID NO: 33975 - DNA, 601 bp, Human
agtgatttaacttctttgggcctcagtttcctcatcaataaaatggagctaatatcttttttcaaaaggttattatgaagattagccgaaatgtaaacagtactgtagaaatacctgctaaataaatatccttgtttaaccagcagctgccagagattctacaggtttaatattcccagatctaacaactattcttcatgtaaaatcacactggtttctctcttcattttgtcagtgaacctcttgaaaggggcatctggaattgggcagaatacccatatgtaacccaggatgttcaaartgcttaaagtaaaactatcacctcccttgatttgaacagtgtatctctattgatgtatcccatgattatctccagtcagtcagcccgtaagaaactcatggttcactaaggcatgccaggtatttactacatgaacatttgcaaatgtcactctgcagatcactgcacaaagcatggcagtactgcaggactctgatccatagcccctaagtcttccatctccccagctgtggggttgtttgaaaggcagattcctctctttgctgccacaaagttgcaggtgggagttaaggggtgaaa

SEQ ID NO: 33976 - DNA, 601 bp, Human
gcggaggttgctacagaccctcaaatccagctgcgagtgagctggctcaccatgtgctcagatgaacttgctggacaaagtcctgaccttccccggctgtgggacacgtctcttcttattgtgacaagcagagagcccctcttggaggaatgtcctggccccagcctatggagggcccttgccaagccatccctggtccctctatccccaaagcccccagaccagcagcctattgattcctgcagtcccagagaaggatccctcatctttgcagcctcagatcaccagtcagcacccaatrtatgttcataaacagatagattaaatcattaattctatagtttctgatcgtgtgccttgcctttttcaagcctaactcaatgttgcagaaaacgtctgagagtttctaagaaataacaaacacgaacccccactgttttccctgtaccttgaggagagtggtctttgttgggtccaattttgagttgcactccacctgcacaagagggaggaaatctgttaattttctacgtgaagccaaagccaaaacatctcccccttctccgccactctgccaccgtcaccagaaactccagtattt

SEQ ID NO: 33977 - DNA, 601 bp, Human
aggcaaggctgctggtgtctccgtggcaaccatcacttgcagcttgctacgtgccaggcactatgctaggccctacagataatttcactccattccccaagaaccatggaaggtacagctgtcccattttacaggcagaaactgggccaggaagagcttgagggactcgcaaggttccaggccaggatctctctgacccgaaagggtttgataaacaagaccctcttcatatattcccttgaaagtttccctcaaaaggaagtggttgaatttgggtcttcaggccggattcagctgaccrgtacccttcctaaatggtggacgttcaaagtccctgtgaaatcaccgaaccgcaagaggccattgcaggctgtgagactgtgcagccagcctggaaatgggcagcgctgacggcaagggagcagggggaggctgcggggagggtggcctggggtgaaacggggctggaggagttcatgggagtggtgaggctgtgggcatcctacagcccagggcgcctcaagtctggacccccaacactagccacaaagcgacactgacctggggcagccctcagctcaaccagcacgcagggagcagg

SEQ ID NO: 33978 - DNA, 601 bp, Human
tgttctcattttaagtagagaaagaaaaaaaggaggaagaaaggaggcagggcaggttttggataaaaaagatgacaaaaaactctatttcattttaagatggaacacaaaactgtcaggatataaaattataagacaacaaattaaaagtttacttgttaggttggtgagattctttataggaggggaaattgaagggatcagttacgtagcaaacacattacgttgatcaatgtgtttatttgtacatgtgcacacacatttacacatgcacacagacatgtgtacacatgcacacacrcagacgtgtacacatgcacacacagaaacatgcatgcacacacacacaatttggcttaatctcctccatgtccctctgctctgggctggagctccttgcggcccttcactccagcagaagcccgtggtctttggggcagacatacccagattctgacccatgatgaccaaggtgtgtctacttggcaaatcccccaacctctgtgaaccgcagtatcacctactccacaggggttggttcctagggaatcagagtcctcctatatagcaccttttcccaacagtccacaaactgtcatcc

SEQ ID NO: 33979 - DNA, 601 bp, Human
gaagagaaggaaggaaggaaggaaagatggattaaaaaaagaattgatggacaaaaggaagaaaaaagagaaatatgaacaaaagaaggacaaataaaaggaagaaaggatatgaagaagaatgaatggatgatggttggatggttcgttggatgggtaaacaaaccaattaattaacaactaactgggctactttaagtgaaatgcgtatggaatgctgagaccacatccagttctaccagttctctcagttcatttaatgtaaacttggaggtgaatgctcaaatatcaagggcatacrtgcaaggcgtatctgttcttcagttaatcccaactgttctatccagtgccctgggtcctattctcctgaggcagtgagagggcactggtagaggctgggctgacccccctccctgctctccactaactcctgccaggattccacaaagagccaaatgacatttaaaagagcggctatgctcaaattgccctctggaatttgtgtgacagtggaagaaagagacaagagaagcaggtcagggctgcagggaacagggacgcctgtgttcgagatggtggagagaaccaagaatacaggctt

SEQ ID NO: 33980 - DNA, 601 bp, Human
tggaagagggcacctggggatgtggatcctgcctgagcctgaggcatggaaatcaaacctgccagcctcgccttgctagagctaatcatggctaaggccaatgctaggactgcagtcagcttaccaagcatactcttactatacatgggcaaacagtttaaggaaatgataaaagggatcagaagttcaataacttcctagtaagggaggacacacgaattatagttccaagcagtagggtcagaagagccactagtcatgtcagggccggaccatggctgacaggcccacagcactgagygtggctgctgttcagccgagttacaactcgccagggtctgtcctagtcctgggacagcacttctggaaaaaaggctgtatgtgtctaacaaactataactgcaaaataagaacgagtgagttcctgaatgatgcttccaatgtatcctccacttcccaaagctcatgacttgactatggcatgctccaccttgaatgtaagcaactttgttagccacttccacagagcttcacagtcttcaaagaatttccacagatccgccctctgctccctgcttacaaccccgaagcctcagcttca

SEQ ID NO: 33981 - DNA, 601 bp, Human
tttgcctgcaacttccgtcggggaaagcaggctagaaaggcaggagccccactagcagatagcttctgttggaagagggcacctggggatgtggatcctgcctgagcctgaggcatggaaatcaaacctgccagcctcgccttgctagagctaatcatggctaaggccaatgctaggactgcagtcagcttaccaagcatactcttactatacatgggcaaacagtttaaggaaatgataaaagggatcagaagttcaataacttcctagtaagggaggacacacgaattatagttccaarcagtagggtcagaagagccactagtcatgtcagggccggaccatggctgacaggcccacagcactgagtgtggctgctgttcagccgagttacaactcgccagggtctgtcctagtcctgggacagcacttctggaaaaaaggctgtatgtgtctaacaaactataactgcaaaataagaacgagtgagttcctgaatgatgcttccaatgtatcctccacttcccaaagctcatgacttgactatggcatgctccaccttgaatgtaagcaactttgttagccacttccacagagcttc

SEQ ID NO: 33982 - DNA, 601 bp, Human
tccttgctgaattgtcttaaagagctagttttgaattcagaaagaattggggtcaatgccacatccgcagctcacatatttctctgagcccctagttctcacccacaaatctgggatgtctactgagcaggatgagaagcgtacagtgagcactgatgccaggtgtgcaaagggttcatcaagccagcaccccgtggtgtgcagaaggccagtgaccggttcctttccttctctttggctgatgcctttgagaccatagctcttcctgttattttccccccaagacctgcaggaggcttcrgctttctggtaatagaagccgatttggggagaaagatgaggtctagcattcacttcctttctctccagaacacactctcaaagcagaaatccaaaccctggcgggaccaagacaaatgggagccacaattcacaccgtgcagggtaaagcaggactgccccgcggctgtctccatggctgtctccaatgacaacctttgcctgcaacttccgtcggggaaagcaggctagaaaggcaggagccccactagcagatagcttctgttggaagagggcacctggggatgtggatcctgcctga

SEQ ID NO: 33983 - DNA, 601 bp, Human
acaaggaatcccttacatcgagtaaccccaattccgcccccaccccagtgctcctactccggcccctgcaaggacactcatcacagccagggcagctgtggaatgttgccctccattctaaggaatgcaaaacaaatctaaatgatcttctccctgaacaagaataatcactggctcatgtatcaggggtgggaggttggggctgtggaggagaggcagaaagcagaactaaagccttcaaaaaccatgatgcccaacgtttgctgaaatatttttgtctgtaaagccaggagattttgtygcctgcttttgctgcacattaagaggatgctagaaaaatcaagcttgtttgcttctgcattcaaagctttctagatgcaccaactttaaaaatcggtttcttcaagttaactacgtagatttgttgttccaaatgcctctagcctcgacatgaatcccaccttttcccccttcctgttttgcctgtttaaaagaggtgcctgcatgtcactattacccccctccccaaatgagaaaaggattttgtttccggaaactggatcagcttctcctcagttaaagaggaaacgggaagtgggcg

SEQ ID NO: 33984 - DNA, 601 bp, Human
ctccctttgcaaaatactttgacatcggtgcagtcctttgtttttccccagcacccctcctaggcatggagagcagagaccttttgctcctgtttgtggctgagggaagtgaggcccagagatgggaggtggcttgcctgagactacacaactcatttagtagttatagcagagctgggtttacgggaacttagttctcttcggcccacgcctcctcccctccccaggttcctcattaaaccagcaagaagccctatgcttcaaggggcggggagaatctggtggctgcctgggagcctcytgcccttcaaagctggggatcttggggaggcaggacagcagccccagcccctcttcctccaccttaccccatctcttttctctgccagcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaag

SEQ ID NO: 33985 - DNA, 601 bp, Human
ctctaccagtttctcctcctgatgaaaggccagcttgtcccaaagctcttgctgctgctgtcccagtggcccctgggcactgcttcttggtccataaaatggcacgttaagagtcaatgagcaaaagtaggcttgatgggcttttccctaaggacatgggctagcctcgtggggaggatttattttcctccctgtaagagcttgcagctgcctcttcttctttttttttttttttttttgtcctttcctgagggcttcaaagagacagactgtcttcctacccatctctctctctttccccctctctctctctctctcacacacatacacacacactggcacacccacttgcatgcactttcaaatacactggccctcctgtcacctccctgtccccttgcctatctcatggctgtatcccaggcagcctgggtgccccaggaagggttaaagctcctggaagctgcagcagctgctggacccagcattggctgaacctcccccaggagcagagcttcagccctcgtgtggctggcaggggctgggacaaggtggagcctgaagcagcttggctgccctggtgtcccctggctgccaggct

SEQ ID NO: 33986 - DNA, 601 bp, Human
cagaaccagttggccacggcctggagcggatggagcttcctctgtccctcctttccttacccctcccccaaggcagcccaccagggcctggaatggggggcagaggttggcaccagagccggggacagggcgcctgagcggagtggccctcaccagtccttttgccggaggcataaacactcttgtcatttcctctaccagtttctcctcctgatgaaaggccagcttgtcccaaagctcttgctgctgctgtcccagtggcccctgggcactgcttcttggtccataaaatggcacgttmagagtcaatgagcaaaagtaggcttgatgggcttttccctaaggacatgggctagcctcgtggggaggatttattttcctccctgtaagagcttgcagctgcctcttcttctttttttttttttttttttgtcctttcctgagggcttcaaagagacagactgtcttcctacccatctctctctctttccctctctctctctctctctcacacacatacacacacactggcacacccacttgcatgcactttcaaatacactggccctcctgtcacctccctgtccccttgcctatctca

SEQ ID NO: 33987 - DNA, 601 bp, Human
gaaactctgtctctactaaaaatacaaaaattagccaggcatagtggctcacgcctgtaatcccagcactttgggaggccaaggtgggtagatctcctgaggtcgggagtttgagactagcctggccaacatggcgaaaccccgtctctactaaaaatacaaaaattagccagagatggtggcgcacgtctgtaatccaagatactgaggaggctaaggcaggagaatcacttaaacctgggaggtggaggttgcagtgagccgagatcacaccactgcactccagcctgggcaacagagygagactccatctcaaaaaaaaaaaaaagaaagaaagaaaagaaaaatggagaggcacaggtgatatgacccctgtggcccaacacctacaaaggtctgggggttgtccagggagcctgcgatggctgcttcatgagtgctgccatgtgaggcctcactcaaggcttttgtaggaatcgggcagctagattttccccagacgcagtaacctcatgaaaaagaaacgatgcctgcctgccatccagttcataagtgggacaagagatggaagaaaggagggggggcaggagggaagggcctt

SEQ ID NO: 33988 - DNA, 601 bp, Human
gaaaaaaattacccaggtggcatgcctgtagtcccagctacttgggaggctgaggcgggaggatcaattgagcctaggagctcaaggctatggtgagctatgatcgcactactgtactccagcctgggtagcaaagtgaggacccatttttgtttttgttttttaattttaataaagccaaatgaccatgatcaggaaggtgaggtcctgagcaccccgaaggaacaggaggtggccacagaggggtgatgtgtttgtgatgtgaagaaacagtggatgatgacaaagccctcaaggaacygagaggccgtcttgggtggaccgttatatgtctgttgacttcacctgggagggtagcaggagtgggggtggggagaactgagtcaggtgtcaaagtcccctgtgactgtccaggctgctggagatcagtggatgacagcttcaaggaggggcacaggtcagccgggtgcagtggctcacgcctgtaatcccagcactttggaaggcctaggcaggtggatcacttggggccaggagttcgagaccagcctggccaacatggtgaaactctgtctctactaaaaatacaaaaattagccag

SEQ ID NO: 33989 - DNA, 601 bp, Human
ttcatggtggaaggccctggctttgtcaggaggtaggagagaggtggtctgccactgggagctgacacagtggcttgaggagggggctggatgtttgcagcagttactaaggaggtgagagatggagctggtaaaggccaatccaaagagtatcaagtggtctgggggcccaggtgaggctggagccacaggtggagttttctaagatagtgctgtgcagagccggggatgcagggccacgcagggtgcagaggagcaggctgggtggtcagccctgcagtcagttaagtcaatcgaggargaaatagtgggagagaatagaaagatcaagaccctggaggtctctctaaaattaagaggccagccaggcacagtggctcatgcctgtgaccctagcactttgggaagctgaggcaggaggatcgcttgaatccaggagtttgacatcagcctgggcaacatagtgagaccccatctctacaacaagcaaaaatgaaaaaaattacccaggtggcatgcctgtagtcccagctacttgggaggctgaggcgggaggatcaattgagcctaggagctcaaggctatggtgagctatgatcgc

SEQ ID NO: 33990 - DNA, 601 bp, Human
agaatcgcttgaacctgggaggcagaggttgcagtgagccaggatcgcgccacttcactccagcctgggcaacagagcaagaccctgtccccccccaccccgcccgcccccgcaaaaagaaattgagttggggaagccatgcttttcagaggcagaagtcagattgccgtggattgaggagacctgccgtgagagtgtggccatagcgagtgttctcgaaggctagctggaaacaaaaggagagcgatgggctgtagctggaggggcctgggagagctctttcaggatgtgtgaaggttcygaggctgcagagctgagtgagagcgtgaggctggatcatttgtggtgtgagggttcccacgcgtgggcagcaatgagctgcacctcccagaagggcagtccatcctgacggggaggagggacacttgctctgaggcttcagggcagcagggtagcagggtaggtgggtttgcaggtcggagtccagaggttgaagccattcatggtggaaggccctggctttgtcaggaggtaggagagaggtggtctgccactgggagctgacacagtggcttgaggagggggctggatgtttgcagca

SEQ ID NO: 33991 - DNA, 601 bp, Human
tgggcgtgcaaggaacacagggggcgtggaaggccagagcgcaaagagggagggcagggggctgtgtgaacccaccgatgggtaatggtgacagctcacggttcaagtgtgggtagacgggagcttcacctgcctctaccagggacttgagagggccctgttttccgggccctcgtgctgtatcttgcccatccttctccccaccagtcatagtgcctggccgcctgtttcccccagtgaaagctgtccaataatgtcatcatgaataatgatcatcagcttgtaaatctgagtcggggcmgggcgtggtggctcatgcctgtaatcccagcactttgggaagctgatgggggcagattgcctgagctcaggagctcaagaccagcctgggcaacatggcaacacccgtctccactaaaaatacaaaaaattagccaggcgtggtggcgcaagcctatagtcccaactgcttgggaggctgaggcacaagaatcgcttgaacctgggaggcagaggttgcagtgagccaggatcgcgccacttcactccagcctgggcaacagagcaagaccctgtccccccccaccccgcccgcccccgc

SEQ ID NO: 33992 - DNA, 601 bp, Human
agtttcctcatccatgaaacgataaaaaatgataggccaggtgcagtggctcacgcctgtaatcccagtactttgggaggccaaggcgatcggatcacttgaggtcaggaattcaagaccagcctggccagcgtgatgaaaacccgtctctactagaaatacaaaaaattagccaggcgtggtgggacgcacctgtaatcccagctactcaggaggttgaggcaggagaattgcttgaacctggaaggcggaggttgcagtgagccgagatcatgccattgcactccagcctgggcaacasagcaagactccgtttcaaaaaataaaaaataataaaaatgatacctaccttgcagggtactaagctttatagacatggctctgagccattagcaccatgcttggcaagtgactcttcccaccctggttaggttgacaacccaggtttaaacagatgagctgctcacaagcagaaacagaaccgaagccctcaacagtgaaccagtggacagtcgagggcttccaaccctgtgacctcaggcttcccaaatacacagttcctgagtcatggaactagctagaggggaccttatactgatat

SEQ ID NO: 33993 - DNA, 601 bp, Human
ccagcagcacaacacagacttgcctctaccattgaacatctgtgtgactttgggtgagtcactcaacctctctgtgtttcagtttcctcatccatgaaacgataaaaaatgataggccaggtgcagtggctcacgcctgtaatcccagtactttgggaggccaaggcgatcggatcacttgaggtcaggaattcaagaccagcctggccagcgtgatgaaaacccgtctctactagaaatacaaaaaattagccaggcgtggtgggacgcacctgtaatcccagctactcaggaggttgargcaggagaattgcttgaacctggaaggcggaggttgcagtgagccgagatcatgccattgcactccagcctgggcaacacagcaagactccgtttcaaaaaataaaaaataataaaaatgatacctaccttgcagggtactaagctttatagacatggctctgagccattagcaccatgcttggcaagtgactcttcccaccctggttaggttgacaacccaggtttaaacagatgagctgctcacaagcagaaacagaaccgaagccctcaacagtgaaccagtggacagtcgagggct

SEQ ID NO: 33994 - DNA, 601 bp, Human
ccactgtactccagcctgggtgacagagtgggaaaaaacaaataaaaatataaataaataaataaagcaaaataaaaacagctctcatggcatcaccagtatcccctaatacctcctgggacttgatacctcacaggcccgctctaagtcagggattccactgtggcccttgcctgctgggtgtgtccaatcccagcagcacaacacagacttgcctctaccattgaacatctgtgtgactttgggtgagtcactcaacctctctgtgtttcagtttcctcatccatgaaacgataaaaartgataggccaggtgcagtggctcacgcctgtaatcccagtactttgggaggccaaggcgatcggatcacttgaggtcaggaattcaagaccagcctggccagcgtgatgaaaacccgtctctactagaaatacaaaaaattagccaggcgtggtgggacgcacctgtaatcccagctactcaggaggttgaggcaggagaattgcttgaacctggaaggcggaggttgcagtgagccgagatcatgccattgcactccagcctgggcaacacagcaagactccgtttcaaaaaataaaaa

SEQ ID NO: 33995 - DNA, 601 bp, Human
tcccctgcagacaaggacgagtgctccaaggataacggcggctgccagcaggactgcgtcaacacgttcggcagttatgagtgccaatgccgcagtggcttcgtcctccatgacaacaagcacgactgcaaagaaggtacgggctgcatgccaggggcatctgggcttgaaggacctgctgctgggagtggaagcccagaggatcatctccatcagcctccgtttagattctggggcctgtatgatctctaaggccccctcattcccccacccacctggtacatagatcctcctcccgcartgtcggagccacacgctcacttctgttgcccacattaggagaggaggagctcacggctgctctgaggcttcattttcagacttttctagtttgtgcttcttaaaaccatgtccaagtctctttgtgacttcctaccggcacagaggcgagaaaggatagtgggtaagagcacagcctccagagccaggtggcctggcccagccctgccgcttcactagctgtgtgcctttgagtgactccttgaccctctctgtgccttggtttgctcctgggtaaaatgtagataataataatagtacc

SEQ ID NO: 33996 - DNA, 601 bp, Human
tgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcrtcaacacgttcggcagttatgagtgccaatgccgcagtggcttcgtcctccatgacaacaagcacgactgcaaagaaggtacgggctgcatgccaggggcatctgggcttgaaggacctgctgctgggagtggaagcccagaggatcatctccatcagcctccgtttagattctggggcctgtatgatctctaaggccccctcattcccccacccacctggtacatagatcctcctcccgcaatgtcggagccacacgctcacttctgttgcccacattaggagaggaggagctcacggc

SEQ ID NO: 33997 - DNA, 601 bp, Human
acatctctgcctttacgcgtgactttgtatccatgtccaggtgtccatgcgcctgtgtgtgcagatgtgtcctgtccctgggtgtgtctgtgcctgtgtgtgcgttgatatctgtgcctgcctcttcacacataggtgggaatgcagagtgtgtattctttgtatgcacctgtacacaggctgggcgggcaagtgaggatgcgtatgtggttggctgtgtctgtatctgcatttgcatggtgtattggagattggagctgtgtgtctgtgcgtgtgtgggtagtgtgtaccgtgtgcacakgtatgtgtgtgcctgtggaccagcacctgtgttgccacatttgggtgacggtacatccatgcactgggtctgcaggtgtatttgcgagtgcgtgtgtctgtctaacacactctgtagatgtcgccgcctgaatgagagccagagcagagctctccccagcccttcccaagtactgttcccctctaccgacgactccccagttctctccttccctgatgcaatgcacgcctagtgggctacgtgtgccaaccctccaggccttctcctgccacaggctctgtctctgtcccgtcgctgtgc

SEQ ID NO: 33998 - DNA, 601 bp, Human
gaggaaggggtggagcgaaggctttgctcagtccgtaagctgggccccccaaagcttctagcacagtcactggagatgttgtccttagtgaaccccaggatggctcatagggtgcccttcacccccacattttctgcagggctgattcaaaggcagctcatggagggctctcgatcaggccccctctgatgtgttaactgagcaagaaaccttgggaaggacttggggactccacctcttggcctggttcccatggcccctaggggtctaacctacctgatcctgggttggagaagcaggrccttctggaagcccatgttccagcgcttgggccccagtcctgatggggatcaggaataggcccccttgcacagacccccacctggccagctcagtgccagcagacatctttctacctcatggttcatctatggaattctgggggtccactggatccctcatcttccctggctatgcctgcttctatgccaggcacaccatcctccaagtgaccacagacagacctgagtgtatgtggctgcggcacacacacccctgtgaccaagtgcacttctgtgcattggggcacagattgtgtgtt

SEQ ID NO: 33999 - DNA, 601 bp, Human
cacgccaaataggttcacactggggccttcagaaagatgagtcgtggccgggcgcggtggctcacgcctgtaatcccagcactcaggaaggccgaggcaggaggatcacttgagcccaggagttcaagaccagcctagacaacatagcgagaccccatctctataaaaaagtttaaaattagcagggtgtagtcgtgtgtgcctgtagtctcaactacttaggaggctgaggtaggaggattgcttgagcccaggagtttgaggctgtagtgaacgatgatctcgtcactcactccagacsctgtttctaaaaatttttttaaaaaggagaaagatgagtcacctgcttccttcaataccaaagccttggggctcccctgaaccggtgggcgggaactcagatccaattagcacatgctgattgacagctgccccacctaaggcctgggctccagtcccttggcctcatttgagcctttgatggccccatcttcaggtggtctcaatggtgatcagcagcccctggcccagcctctctcagctgatcctccgggtccaggagatctccccttctttgtgaatcactcagcccttcaccctg

SEQ ID NO: 34000 - DNA, 601 bp, Human
agtctgccccctgctccccaccacttcactctcccatcaagccagcccttccagtatccaaatctcattattcctgagccctcaggactgtaatgactggggcctgaggatgggcagaacataagcattcagaaatcagcacccagaagtgaagaaggggatattccaggtgtcaggagctatgcaagccaaggcctgggagagggcaggtcctaggaacaggcagttcaagaacgtgggtggatggaggagagacaggtgtttgccttggactgtgtggagcagagtctctggcagtggyggacttctaatcagaccctgcacacgccaaataggttcacactggggccttcagaaagatgagtcgtggccgggcgcggtggctcacgcctgtaatcccagcactcaggaaggccgaggcaggaggatcacttgagcccaggagttcaagaccagcctagacaacatagcgagaccccatctctataaaaaagtttaaaattagcagggtgtagtcgtgtgtgcctgtagtctcaactacttaggaggctgaggtaggaggattgcttgagcccaggagtttgaggctgtagtgaacgat

SEQ ID NO: 34001 - DNA, 601 bp, Human
caccaagctcaacggctccatcaccagcccgggctggcccaaggagtacccccccaacaagaactgcatctggcagctggtggcccccacccagtaccgcatctccctgcagtttgacttctttgagacagagggcaatgatgtaagtgcccaccaggggctgaggtggggcaggaagctgtgaggcgtgggcattcagctcagtgcctgcttcctgtcctctgagagggggcccggcagaaacactctgcaaatatcgaggagagactgctcccagctcacgaagcacaggaggcccagmagggagggccccaaagggggcggggggacatgtagcaagtgggaggaaggacatggagttagggaggcgtgtggagcaagggaaggcttagggctggcttggcgagtacaggaggatccagtgagggggcgtagctaagtcaaggctaaaggatgtgcagaacagagagcttcccgagggcaggagtagtcaagagaggcttcctggaggaggcgggcctggagctgggcttccctgcaggtgtgcaagtacgacttcgtggaggtgcgcagtggactcacagctgactccaagctgcat

SEQ ID NO: 34002 - DNA, 601 bp, Human
cttattcccgctcactccctcttggaggaccttggcctgttcatttgcagagaagatagaaatggccacacttatgaccccttagctcccccactcctccctacaggcccacccctgaggacacccaggccaccctgcctcctcccgtccgccccagagggaccagacacaggtccctgagccttggggagtccacaggctccccatcttctccttactgcatcccagcccacatctcagcccttccccatggcaggggctccccgcagacgatgccaccttccttgtccccgcagctgcytgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtaagtgcccaccaggggctgaggtggggcaggaagctgtgaggcgtgggcattcagctcagtgcctgcttcctgtcctctgagagggggcccggcagaaacactctgcaaatatcgaggagagactgctcccagctcacgaag

SEQ ID NO: 34003 - DNA, 601 bp, Human
gggggctgtgagcagcggtgcctcaacaccctgggcagctacaagtgcagctgtgaccccgggtacgagctggccccagacaagcgccgctgtgagggtgagtgcccccagactgcctctgaccctgttctttccctggcaccagcccacctgcccagaattttttttttttttagacaggcttttgctctgtcacccaggctggaagtacagtggctcaatcttagctcaccatagcctcccattcctgggctcaagcaatcctcccacctcagcctcccaagtagctgggactacaggygcacatcaccttgcctggctaattttaaaattttttttgtagcaatgaggtcttactttgttgccgaggcttgtctcaaactcctggcctcaagtactcctcctgcctcggcctcccaaagtgctgggatcacaggcttgagtcactgccaagatttcttatgcccttggacagaccccttcttggaaaagctagatggataccccaacactcttttcatagctcatggataagaaacacatgtcacattgcaaccccgagaacacactgtccccccgtaggccgcattctggctttggg

SEQ ID NO: 34004 - DNA, 601 bp, Human
gcccagtccatgtgctctgaaggaaggctctgtggggttccagccatcggggagctgggtgggtcttggggctgagtggacaagtgaggctcacagccagcttcttcccttgaatgcctggagtctgtgacaccctttccttcccaccacagaggtggacgagtgctctcggcccaaccgcgggggctgtgagcagcggtgcctcaacaccctgggcagctacaagtgcagctgtgaccccgggtacgagctggccccagacaagcgccgctgtgagggtgagtgcccccagactgcctcygaccctgttctttccctggcaccagcccacctgcccagaattttttttttttttagacaggcttttgctctgtcacccaggctggaagtacagtggctcaatcttagctcaccatagcctcccattcctgggctcaagcaatcctcccacctcagcctcccaagtagctgggactacaggtgcacatcaccttgcctggctaattttaaaattttttttgtagcaatgaggtcttactttgttgccgaggcttgtctcaaactcctggcctcaagtactcctcctgcctcggcctcccaa

SEQ ID NO: 34005 - DNA, 601 bp, Human
gagaagaggtcccccaatgtggattagaggcaggacctgctgtatgattcagggaggaaaaaaggcagttggaggttttttttacctgtgtgaccttgggcaggatattctccctgaacctcagtttctcatctgtaaaatgggcacagtaacagtccctccgccacaggcttcacatgaggattgaaggagaaatgaaagaggggtccttagtcagggaacagcacgtgagagacaccagcccagtccatgtgctctgaaggaaggctctgtggggttccagccatcggggagctgggtrggtcttggggctgagtggacaagtgaggctcacagccagcttcttcccttgaatgcctggagtctgtgacaccctttccttcccaccacagaggtggacgagtgctctcggcccaaccgcgggggctgtgagcagcggtgcctcaacaccctgggcagctacaagtgcagctgtgaccccgggtacgagctggccccagacaagcgccgctgtgagggtgagtgcccccagactgcctctgaccctgttctttccctggcaccagcccacctgcccagaattttttttttttttagacag

SEQ ID NO: 34006 - DNA, 601 bp, Human
tttcaaagtggacattttgtgagctagtccccagattctgtgatttatttagggtcctggggcatcccttgcatttgaccaaataaaaacatgtctgtgagggcagtttgtaatgtgtaaagaaagccatgtttatttctgattatatttctgattttatttcttatttggtctcttctttgcatagagaccaaataagaaaaggtaaataatgatggtaatatgctctttagaaaggtaaatagaacacatatatagttggacattataaagatctaccttggccaggcacggtggctcmcacctgaaatcccagaactctgggaggccaaggtgggtggatcacctgaggtcaggagttcgacaccagcctggccaacatggcaaaacctcatctctactaaaaatacgaaaattagctgggtgtggtggcagatgcctgtagccccggctacttgggaggctgaggcaggagaattgcttgaacccaggaggcagaggttgcagtgagccaagagcgtgccactgcactccagcctgggtgacagagcgagactccatctcaaaaaaataaaataagataaaatgaaaaataaagatc

SEQ ID NO: 34007 - DNA, 601 bp, Human
taccgcagccgcctgtgctggtacgactatgtggaggtccgagatggcttctggaggaaggcgcccctccgaggtaacggcaccagccaccccctgccccctccatgctgattccctctctgagccaccctcatcacactcttcatccccctccagggcccaacactggccagggatgacaacctggtatgggagccaggagtcctggcatcattagtcccagatagctgcattactcacttgctgcgagacttcaggcaagtcctgtcctcaatctggacttcagagtacccagtccagrcttctgggcctccctgtgaagttggctgtcaccctacgggtgcaaggagtcatcagaattgactgagagagacagacaggctgttctgcgcatccccatggccccaggctctcttcctcatctgggcactttcagaggatccactatttttttctatctgcccttctggtttttgagtgcccacagtgcagcctggctcaaaagagagtcatcataacctgccagcccatctcctaactcactgccgagggctgcacactgggcgccgtggcccgaccttgtctgcataggatactttgt

SEQ ID NO: 34008 - DNA, 601 bp, Human
tcttcctcccctgttgccctagatcatcctgaacttcacgtccctggacctgtaccgcagccgcctgtgctggtacgactatgtggaggtccgagatggcttctggaggaaggcgcccctccgaggtaacggcaccagccaccccctgccccctccatgctgattccctctctgagccaccctcatcacactcttcatccccctccagggcccaacactggccagggatgacaacctggtatgggagccaggagtcctggcatcattagtcccagatagctgcattactcacttgctgcgwgacttcaggcaagtcctgtcctcaatctggacttcagagtacccagtccagacttctgggcctccctgtgaagttggctgtcaccctacgggtgcaaggagtcatcagaattgactgagagagacagacaggctgttctgcgcatccccatggccccaggctctcttcctcatctgggcactttcagaggatccactatttttttctatctgcccttctggtttttgagtgcccacagtgcagcctggctcaaaagagagtcatcataacctgccagcccatctcctaactcactgccga

SEQ ID NO: 34009 - DNA, 601 bp, Human
gggcggtggtcatcatggggctggcagagggctggtgcaatgttcgggacagcttaaccctcttcctcccctgttgccctagatcatcctgaacttcacgtccctggacctgtaccgcagccgcctgtgctggtacgactatgtggaggtccgagatggcttctggaggaaggcgcccctccgaggtaacggcaccagccaccccctgccccctccatgctgattccctctctgagccaccctcatcacactcttcatccccctccagggcccaacactggccagggatgacaacctggtrtgggagccaggagtcctggcatcattagtcccagatagctgcattactcacttgctgcgagacttcaggcaagtcctgtcctcaatctggacttcagagtacccagtccagacttctgggcctccctgtgaagttggctgtcaccctacgggtgcaaggagtcatcagaattgactgagagagacagacaggctgttctgcgcatccccatggccccaggctctcttcctcatctgggcactttcagaggatccactatttttttctatctgcccttctggtttttgagtgcccacagtg

SEQ ID NO: 34010 - DNA, 601 bp, Human
taatatggagctgattcattaacattgaactcatgaccaacagcactctaactcatgcctcgaagaagcttacctagcacacgtatgttctctgtgaggcatatcacagccttcttgcccttgggaacaccagagagcacttcagcattatgctcaggggctgttttaaacagcgaaaccctcaacaaagcgcacaaaaacacaaaaaacagggcactttaactagacctcaaaaaggacacttggttacacaatgagagccgaaagcagaaagcggagcgttgccttattccacctcagmtgggaacatgcatgttgggtgactgaaatttttcactgctctgcaaatgtccacaaatgaccgtgaaagccctgagagtattgattttggggactacgaataaattttagccagtagacaaatttgcaagcacagaatccatgaaaaatgaggtttgactatgcttttgctttcctcctctttctctccactcactagtcaccatgacttcctctctcagttccaggaaacacttctacccccagctgccagagcaccaacgggcagcctcagaggggagcctgtgggagatggagaggt

SEQ ID NO: 34011 - DNA, 601 bp, Human
tgtggtccaaactcctaaaaacccatgtggtacttgtgcatggatacaggaatgggagggatgagggcctgggctgtgtctgttctttccagtcccttactgctctgtagaagggtgaaagctcctcactgccagtgctgatgtttgagacatggtcctgagagcacacaaatagccctccccttcccaaagggcaggggcagggattctttcttctttttttctgtctttttttttttttttttttttttgagacagggtctcagtctgttacctaggctagaatgcagtggcaccattkcggctcactgcaacctctacctcctgagttcaagcaattctcgtgcctcagcctcccaagtagctgggaccacaggcatgcaacaccacgcctggccaattttttatatttttagtagacacgggatgtcacggtgttggccaggctggtctcgaactcctggcctcaagcgaactatcctccctggcctcccaaagtgctggaattacaggcgtgagccactgtaccaaagggcagggattcttattgagggtctgctctgggaacactgtggtgtgcctgaagttgtcctgtccagct

SEQ ID NO: 34012 - DNA, 601 bp, Human
agctatattggaagaacctgctcaagtacggttcttgatgtctggggaatcctttcggggaagatcacttcaaactcaataatgaggtccccacgtttctcgggtgttttggggagggggaggccttctccaggaacttttcgccgcatgccaggcctgataacatctttgaatacgacgggtatcgtcctgccgtccagagtggggacgttcactgtgcagccacacagagccttgaaaagcaaaaggacagcattagatggaagctggctcaagaggctcagctcttgcccagaggccrtctgccatagataagacccatcaggcctctgcagctaagacctggcccccaaatctacacgtccccaccacgaaagctccacaacagcgccctggtcagtcctgttcactgttgtgccccaagcctggcacgcaccacacaccccaacacattggttcagcaaatactaaactgcttcaaaaagcagccatcgccctctacagacaccgccccacctggcaccttacctcccggaggctgatcctggcaggataaatgacatcagagccatctctcttaaagatattgtggggcttgtcc

SEQ ID NO: 34013 - DNA, 601 bp, Human
tggtcctgctggaacgagaggtattgcttgtggacgccaaccaggcagttctgcaggaatagtttaggttctcaatttgagatggccaaagagaagacagaattctccaggagaagagcaagacatgggagacaaatacagaataaagcacaaactgatcacacaacagaaaaggaggagtgtacagggtctgggaatcaagactgcaggttgacattatctaccagccagaagcaaaaagacacagagggatcaagtccatctgctggtctgcctctcacccctggccagggactggagktggatgtgggcccatcccgggagggctgccagacccagtggggcagactggaatgccttttcctgctgttcccaccacctgatgccctatagctcgaaaaaccactgaagtctagtgtgcgactttgaaagattgtaatatatgctctggaaaacattcagcagtacgaaagccctccctgggccctcccaccctctcatggtccacaactggtagaaaggtccagaaatccttgagctctggaaaggtccctggtcagtccttggggagctcagatagctatattggaagaacctgctc

SEQ ID NO: 34014 - DNA, 601 bp, Human
ctgcacttgctggagtcactcactggaggctggctcccttggtcctgctggaacgagaggtattgcttgtggacgccaaccaggcagttctgcaggaatagtttaggttctcaatttgagatggccaaagagaagacagaattctccaggagaagagcaagacatgggagacaaatacagaataaagcacaaactgatcacacaacagaaaaggaggagtgtacagggtctgggaatcaagactgcaggttgacattatctaccagccagaagcaaaaagacacagagggatcaagtccakctgctggtctgcctctcacccctggccagggactggaggtggatgtgggcccatcccgggagggctgccagacccagtggggcagactggaatgccttttcctgctgttcccaccacctgatgccctatagctcgaaaaaccactgaagtctagtgtgcgactttgaaagattgtaatatatgctctggaaaacattcagcagtacgaaagccctccctgggccctcccaccctctcatggtccacaactggtagaaaggtccagaaatccttgagctctggaaaggtccctggtcagtc

SEQ ID NO: 34015 - DNA, 601 bp, Human
gggattgtatctagggctgtgcaaaattcaaaaggatcagatccctttgaaagagtccatagtccatgaaacaaaaaattacctgggccactggtaagccccacgtgtgccaagattgccttacagaaatgtaaagagtgtgacccacaaagtgaggacattcagcttcactggagccagaggtcaggaaggccccttgctgaggccaggctcccagaccatcaagggagaggtggctgcacttgctggagtcactcactggaggctggctcccttggtcctgctggaacgagaggtattrcttgtggacgccaaccaggcagttctgcaggaatagtttaggttctcaatttgagatggccaaagagaagacagaattctccaggagaagagcaagacatgggagacaaatacagaataaagcacaaactgatcacacaacagaaaaggaggagtgtacagggtctgggaatcaagactgcaggttgacattatctaccagccagaagcaaaaagacacagagggatcaagtccatctgctggtctgcctctcacccctggccagggactggaggtggatgtgggcccatcccgggaggg

SEQ ID NO: 34016 - DNA, 601 bp, Human
tcaccttgattgaatttggaaggatgcccagctccccactccacccccaaaaccagcagaaccctcaaacagagtcacaggaccgctcccctgaggtttagcatcagtctttaatgctgtcgcacttcattgactagtcacacactttggtctcatgttggcagtggcaacttacaatgagtctaaaggtctgagcactggactggcctccagggaacagacatttgttccaactccccttccctccccaagatttcttcagaattccattatggccctatacagagagcactggctgccrgggacaggttttgagtgtacaccaactatacatggaattataaaaacatatttacagacgttccacagtgctcctgtaatcagaagcaaagacccttttatcaaaagggattgtatctagggctgtgcaaaattcaaaaggatcagatccctttgaaagagtccatagtccatgaaacaaaaaattacctgggccactggtaagccccacgtgtgccaagattgccttacagaaatgtaaagagtgtgacccacaaagtgaggacattcagcttcactggagccagaggtcaggaaggcc

SEQ ID NO: 34017 - DNA, 601 bp, Human
gtccaagtattctgtcctttccatctgaactgggagggctgggaggactggatggaagagaggtgcaagggtgggaacactagatgaaagaggggtatagagccctggggccaagttcattactgacctggagccaggttttgttcaggagaggatagtttattggacaccttatctctcccctcccccttggtgtgtgagcttcctcagtgacctttggcctctgagtcagcgtgaggaggtggggttggaggttctgaaagatatttgaacttgctcttggggagtgtgggcatatggcgccgctgctgtgtcactgttcctcctggtcctgggcttgactgggcaggaggagaggagggggtatattgtgggcacgaggaaagttgttgatctccccatgaccatgccagccgctgttgggcaggacttgagcttagagctatcagataatgaagtctccccttgagaatgtacctgtccttgcacactggggtttcgcccgcccctcgtggcagagattttggcctctgcatcttgagttccctgtggtccccttcttctccacagtcatgaattgggaagaggcagtgggcacttg

SEQ ID NO: 34018 - DNA, 601 bp, Human
gctctgttcagctccacaccactccccttggaaagaccttcagtgccgtgtacccgaggggaggggagcagggatgggcagggtgccctccccagttctcttaccctagctggaagaggacgttcaagtgggggttgcccagggaagtgggagttggtgattccttcctctttttagaactctccctataggaagtggccctggagagacctcgccccctgtactgagcaggagacctgaaatatccaggtatcagacctattcctctccacctgctccaggcagtaaggataggaccagraatggggagccagtgcctggaggatgctgggctgtgaccagggaggaggggaaaccttcagtcccataggcagcttcagtcccatagttgctaaccaacttcccaaggcctcccatttacagcaaaagagtcaaattagactcacccgtttctctacaatcccccatggtactcagcccactacgtggcccaaagcacagggtgtgtccttggtttcagccttttctcctccctgagccttatctcccaaaggcataggtgggtaaaaaccttgtcacctctgaaggccaccctgccccc

SEQ ID NO: 34019 - DNA, 601 bp, Human
aggcataggtgggtaaaaaccttgtcacctctgaaggccaccctgcccccaacctgcagtacccagcatgctttgcaagctggataaatatgtattgctgatgacagtgtttgaggaaggaggtcgagatttgcttctccagaggacttctgggattagagctgggggagaaacagggtgacctcatttgctcattcaacaaatatttattgagcacctactttgtgcacctgctttgtatctagggagctgtgttgtcaagaacctcgccacgtccctctttcctggcttgcttccccakgtttctgaaaacaggtggaggtagaggattggtctgctgccagttcccctggaatcccctgttagggtgggctctctgcctctgcttgtctcagcgctccctccccactcgagggggttgaagtcctcacagctgtggtgccccgttttgctagctgaagcttagagtaccccaccatcatcttgtgaccatcccttcataatagctactagttatcacgatatgctgggctcagtcttcacagcagcctcacaaagtaggtgtattcgctcttgtaaacgatgcactccataaacggag

SEQ ID NO: 34020 - DNA, 601 bp, Human
tcttagagctgaaattcacatccacagttctttctgctcagctcttctgccagtgtgtttgcagaaagtacttttatttatacatatttatattttatttacatctcatttgtgccaaaagtaggtcccatcccttcctgaccctatctggaggaatgctctgggcctggggtcttgtatgggggcgtggggccactgggaataatcctgtcctcctcggaatttgtggaggtgcagcaaagatctatgcctttaagccagcgggtcaggtggccaaccaagctaggctggtgccccggcsagggtggggctggcattgcctctgcaggagggagaaactgtaaccctgggcaacaggaagggaagagatggtctcataatccatccctgagtcatggccaccccaggtagcctgggttcagaggccaaggtgccaggctgcaggcacagtgacacgaagcttgccacatcccccccaacccagagccacagagggacaggctgtcccaagtgaggggtatccttgcaggcttctgcccctaccagcctgtttacctttctttagagtgggttgcaggtaggcaagggaagatcaagatga

SEQ ID NO: 34021 - DNA, 601 bp, Human
gggcgtggggccactgggaataatcctgtcctcctcggaatttgtggaggtgcagcaaagatctatgcctttaagccagcgggtcaggtggccaaccaagctaggctggtgccccggcgagggtggggctggcattgcctctgcaggagggagaaactgtaaccctgggcaacaggaagggaagagatggtctcataatccatccctgagtcatggccaccccaggtagcctgggttcagaggccaaggtgccaggctgcaggcacagtgacacgaagcttgccacatcccccccaacccrgagccacagagggacaggctgtcccaagtgaggggtatccttgcaggcttctgcccctaccagcctgtttacctttctttagagtgggttgcaggtaggcaagggaagatcaagatgaccctgccttggagcctcggatccaggctgagaggcctctaacaggcagcagaggtagggtctgtctggtttctgtgaacagggaagccatggactttgcaggcagcaggaaggggcagaggtgcatgcctcgaggtgcagtttccttgagtcctgaggcccaggaatgcttcgctgaaatca

SEQ ID NO: 34022 - DNA, 601 bp, Human
cctgtcctcctcggaatttgtggaggtgcagcaaagatctatgcctttaagccagcgggtcaggtggccaaccaagctaggctggtgccccggcgagggtggggctggcattgcctctgcaggagggagaaactgtaaccctgggcaacaggaagggaagagatggtctcataatccatccctgagtcatggccaccccaggtagcctgggttcagaggccaaggtgccaggctgcaggcacagtgacacgaagcttgccacatcccccccaacccagagccacagagggacaggctgtcscaagtgaggggtatccttgcaggcttctgcccctaccagcctgtttacctttctttagagtgggttgcaggtaggcaagggaagatcaagatgaccctgccttggagcctcggatccaggctgagaggcctctaacaggcagcagaggtagggtctgtctggtttctgtgaacagggaagccatggactttgcaggcagcaggaaggggcagaggtgcatgcctcgaggtgcagtttccttgagtcctgaggcccaggaatgcttcgctgaaatcatcttgcctggggcctttaaaagag

SEQ ID NO: 34023 - DNA, 601 bp, Human
gcccaggaatgcttcgctgaaatcatcttgcctggggcctttaaaagaggggggctcttgctctgggacagagcccatggggcagggcagaggcagacggggtcactgtggggtcctctggacatatttccctgacagtgtccttccccagaccccattgagacaaggcaggggttctttcatcttagggtccaggcttggctcacagcggttgtggagggactggccattttctgcctcccctccccacaattttcctaccccaaaaaggacacagtggaaggagctggtgggttttctygaaccttggggccttcctccagagagggtaggggagtcgcctgaagctgctggaggtgccaagcattaggggtggaacggcctcctctcctgaccttccagcactctgggagacagtggctgcagctccacttgacacttgtgcttcatagtaactggtttccatgtttctgctcagagccccctgcagggggacaggcgaccaccctcctctgccccacccttgggtgtctggatgagagtgtggggcctgtgagggaggtgggaaggagctactgatagaaataggtgccatccccta

SEQ ID NO: 34024 - DNA, 601 bp, Human
cattgagacaaggcaggggttctttcatcttagggtccaggcttggctcacagcggttgtggagggactggccattttctgcctcccctccccacaattttcctaccccaaaaaggacacagtggaaggagctggtgggttttcttgaaccttggggccttcctccagagagggtaggggagtcgcctgaagctgctggaggtgccaagcattaggggtggaacggcctcctctcctgaccttccagcactctgggagacagtggctgcagctccacttgacacttgtgcttcatagtaaytggtttccatgtttctgctcagagccccctgcagggggacaggcgaccaccctcctctgccccacccttgggtgtctggatgagagtgtggggcctgtgagggaggtgggaaggagctactgatagaaataggtgccatcccctagaagaggggctctgcttcctccgcgtggcagcctggaggggtctttggaaccactgggtccagtgttggccctgtgccccctgcctgctcagtacaccccaccctccttctccaaggggcttggctccgggtgcaggcctggccatctggagtag

SEQ ID NO: 34025 - DNA, 601 bp, Human
cttccagcactctgggagacagtggctgcagctccacttgacacttgtgcttcatagtaactggtttccatgtttctgctcagagccccctgcagggggacaggcgaccaccctcctctgccccacccttgggtgtctggatgagagtgtggggcctgtgagggaggtgggaaggagctactgatagaaataggtgccatcccctagaagaggggctctgcttcctccgcgtggcagcctggaggggtctttggaaccactgggtccagtgttggccctgtgccccctgcctgctcagtayaccccaccctccttctccaaggggcttggctccgggtgcaggcctggccatctggagtaggggtctctctccctttgtctccccaacgtcaatcaggaggcagccttggaggtccgtggtcctaggacagtgtgtagcccttcgtgtgtgtgtgtgtgtgtgtgtgtgtgtgtgtgaaagtgggtcatggtctggattctggagaatgtttttcctggcaggcccctgtgggggtagggggaggcaggggcccaggcaggggcctaggcaggggcctgtgcagctaagtaggcagaggcc

SEQ ID NO: 34026 - DNA, 601 bp, Human
agctactgatagaaataggtgccatcccctagaagaggggctctgcttcctccgcgtggcagcctggaggggtctttggaaccactgggtccagtgttggccctgtgccccctgcctgctcagtacaccccaccctccttctccaaggggcttggctccgggtgcaggcctggccatctggagtaggggtctctctccctttgtctccccaacgtcaatcaggaggcagccttggaggtccgtggtcctaggacagtgtgtagcccttcgtgtgtgtgtgtgtgtgtgtgtgtgtgtgtgwgaaagtgggtcatggtctggattctggagaatgtttttcctggcaggcccctgtgggggtagggggaggcaggggcccaggcaggggcctaggcaggggcctgtgcagctaagtaggcagaggccagcagactgggtggtgaccaggctggggcaccctgccaatgcctcccagttactcggggagggagtggggctgtcacttcaggggcctgtgggggcagggaccagcctgtcttagtgtccctggtgggttctgtgtgttggggtatgcaccacttcaggggcctgtgggggcagg

SEQ ID NO: 34027 - DNA, 601 bp, Human
ctttctgctatcccctcctcccagtgtctcagaagcacctctccctccgggggtttggagacaacattttgaaaagcatcgccttgggggaattccttgacaaatggccaagaaccagctctgtggctgggctccttcaaaagtccccctgggcctgcctcctggcctccttcttttggaatggggaatgtctcccttgactactgggaaatggggcagggacaggccagccaggtcactcaggtggcctggattattctggggtcctggcagtggacccctgtttggtggtgatccagcrcatcatcctgggcttctgggggtgaatttagatcctgttgtcatgggtttgcctaagcatcaatacttctcaggggttccacaaagacccctccaggctgccacgtggagcctgttagatcgtttctcttttttttttttttttttttgagacagagtcttgctctgtcacccaggctggagtgcagtggcacaatcttggctcactgcaacctccacctcctgggtttaagtgattcttttgcctcagcctcccaagtagctggaattacaggcatgcgccaccatacccggcctattt

SEQ ID NO: 34028 - DNA, 601 bp, Human
aatttagatcctgttgtcatgggtttgcctaagcatcaatacttctcaggggttccacaaagacccctccaggctgccacgtggagcctgttagatcgtttctcttttttttttttttttttttgagacagagtcttgctctgtcacccaggctggagtgcagtggcacaatcttggctcactgcaacctccacctcctgggtttaagtgattcttttgcctcagcctcccaagtagctggaattacaggcatgcgccaccatacccggcctatttatttatttatttatttatttatttatttttgagattaagtctcgctctataccccaggctggagtgcagtggcatgatctcagctcaccgcaatctctgcctcctgggttcaagcgattctcctgcctcagcctcccgagtagctgggattacaggcacgccgtcactgcacccggctaatttttttgtatttttagtagatacggggtttcaccatgttggccaggctggtcttgaactcccaacctccagtaatccgcctgccacagcctcccgaagtgctcggattataggcgtgagccaccgctcccggctagatctgttc

SEQ ID NO: 34029 - DNA, 601 bp, Human
tcggctaaggttcacacctgctgtgcccagcacctgacatctgagtgctcagaggtgccaagtgctgtgctgagggctttgaaggtgatttctcctcagtcctggacaatcccaggagggccaggtgttattacatccattgtacacaccaggaagtgggctcctctgaggtgcagggccccgcccaaggccatacagttagtggggtagagctttgatgtccactataggggtgtccaccttcaaggctttgaagtagagcccttcagtgcctcagtgggagacccgctgccgggtgctytcctgccctcctcctggggtgggagaggatgagggaagggtagaaaggatgtgttgtgttgacagagcctgggacacccagcccactcctctggccaggcatcccacaggaagtgggaggtatcggagctgtagcaccacctggggctcatgtggggctggtgggtgtgctgggccctggtacaggagctaggagcacctgggttctgggcctgggtgtgtgggggctgggccttcctcttctgaggccttggtgccaccagaggagctgctccttcatgttcagcggctgctccctagc

SEQ ID NO: 34030 - DNA, 601 bp, Human
ttcacacctgctgtgcccagcacctgacatctgagtgctcagaggtgccaagtgctgtgctgagggctttgaaggtgatttctcctcagtcctggacaatcccaggagggccaggtgttattacatccattgtacacaccaggaagtgggctcctctgaggtgcagggccccgcccaaggccatacagttagtggggtagagctttgatgtccactataggggtgtccaccttcaaggctttgaagtagagcccttcagtgcctcagtgggagacccgctgccgggtgctctcctgccctyctcctggggtgggagaggatgagggaagggtagaaaggatgtgttgtgttgacagagcctgggacacccagcccactcctctggccaggcatcccacaggaagtgggaggtatcggagctgtagcaccacctggggctcatgtggggctggtgggtgtgctgggccctggtacaggagctaggagcacctgggttctgggcctgggtgtgtgggggctgggccttcctcttctgaggccttggtgccaccagaggagctgctccttcatgttcagcggctgctccctagcaacccagcgc

SEQ ID NO: 34031 - DNA, 601 bp, Human
ctatttgagcccgctctggggctccctaaagcctacctcctccaggaagccactctcccctccctcttccccattcacactcacccacaaaggaggggtttggggaggaccagggaatttgcccctccaggtcatgccagtctgaggctgggcaaccaaccctctatagccgcgtcccaaacctccacccactgaagggcaaggtgtgaagggggccctgccatgggggcacaggatagggggctgttccgcctctgtctcctttggcttgactttccagaacactgctgagtgggaggtrtgtgcccctgtaggaggggaggacgggttccaggcctagggagaacttggtctttaggggacacggaggaataagcaaagggtctggagtcctgagaacagaacagctgacccaccctgcctgggggtgcgagggctcctgggacaaacctggccagtgatgaggtggggtggggtggggcggggcttcagccgatgaaggattaggcgcgagaatacatgtaggggaatttaccacgtgggcagcgcgcccaggacccactcaggatcgggagaagactgcagaggttccacccgggcc

SEQ ID NO: 34032 - DNA, 601 bp, Human
gaatacatgtaggggaatttaccacgtgggcagcgcgcccaggacccactcaggatcgggagaagactgcagaggttccacccgggccacagaggggatctctcccagttcctccagaggggactcctgctgcctgatcttgatgtgactgcccgggtccatcagggagaaccgaccctgccttttgtcaggctttccatgcaccctctctcagcatcctcccagcagccctgtgaggaaggtgctatcttccccattgttacagatgaggcgactgaggcccagcgactttgagggactrgctgaggtcctgcgggtaggagaggcaataataatattcacagctgacgatggagggctcagtgctcccggcgtgtgagctcgtttaatcctcacccagccctgtgcagctgtagcatcacttcacttcagagaagaggaaatagacactggcagctttgaatgtaggtttgtctaacccagggactatccactccccaagaaacagtctctaccttaataataaacatgatagttccttatgctgttgagaagttttgtagtttagggctgggagccatggctcacgcctgtaatccct

SEQ ID NO: 34033 - DNA, 601 bp, Human
gaagactgcagaggttccacccgggccacagaggggatctctcccagttcctccagaggggactcctgctgcctgatcttgatgtgactgcccgggtccatcagggagaaccgaccctgccttttgtcaggctttccatgcaccctctctcagcatcctcccagcagccctgtgaggaaggtgctatcttccccattgttacagatgaggcgactgaggcccagcgactttgagggactagctgaggtcctgcgggtaggagaggcaataataatattcacagctgacgatggagggctcrgtgctcccggcgtgtgagctcgtttaatcctcacccagccctgtgcagctgtagcatcacttcacttcagagaagaggaaatagacactggcagctttgaatgtaggtttgtctaacccagggactatccactccccaagaaacagtctctaccttaataataaacatgatagttccttatgctgttgagaagttttgtagtttagggctgggagccatggctcacgcctgtaatccctgtgctctgggaggccaaggtaagaggatcacttgagcccaggagttcgagaccagctgggg

SEQ ID NO: 34034 - DNA, 601 bp, Human
gctttgaatgtaggtttgtctaacccagggactatccactccccaagaaacagtctctaccttaataataaacatgatagttccttatgctgttgagaagttttgtagtttagggctgggagccatggctcacgcctgtaatccctgtgctctgggaggccaaggtaagaggatcacttgagcccaggagttcgagaccagctggggcaacatagcaatacctggtccctaaaaaaaaaaacgagcagagatggtggtgtgcacctgtggtcgtagctacttgggagtttgaggcgggagkatcacttgagctgaggagttggaggctgcagtgagccatgatcgcaccactacactccagcctgggtgatggggtgagaccctgtctctaaaaaaaggaaaagcaagaaattgtgtagttcagcaagtgcctttagttagttcccctgtttatccttgactgggttctgggggaaggtaaaagacccagcgtctctgtcttacagataggggaaccgagtgagtgaatgcggatccaggatttgggccctggtcttgtcactcccaagtctggggcccttgatgctgcacagccctggta

SEQ ID NO: 34035 - DNA, 601 bp, Human
ttgtcagttccacaaaagcgtggctgcagctctttttgccccggcaccctatccccgaggggtggggtttgaggaggaagcacctccacgttgttccccctgcccaggatgggcagcaagtgggcagggcatgctgttggcaggggctgcttctgccccccacaggggaagccagcaccacgctctgggtttgggggctcctgtccctggcctgtgccccctgcttcccagggtcatagcctgctgggttcccgggggggcctcttgggagatgaaaatggcggtcactcttcattagggyctcactgagggccagagcgtgtccgtgtgtgtatgtgtgtgtgtgtgcgtgtgcacgcatgcacgcgtgtatgtgtgtgtgtgtgtgtgcaagcatgcacgcatgtatgcgtgtatgcctgactttgtttaatccttacagccacctgatgaaagaggggctcttattatccccatcatacagatagggaaactgaggtttacagaggctgccctgcttgtgcagagcccagggacaggggcagacatcaagtcccatgacctggccctggagcccgttgctctgaacagtgctgatggc

SEQ ID NO: 34036 - DNA, 601 bp, Human
gggggtcctcgggggttgggggctgagggcaggataggcaggggaggaaagggtactgccctttttgcaggcctgttctgtctcccttcccaccgcccaccagctgtgtggtctgagactggcctcagactgtctttcctctcatagctttgcttcctcaccagtaaaatgaggacagcaaacccagttgcctcaagctgggggctgggcctgatgctttgaggcttggaagggctgagccggccaggctggagcagtgacgggttctggttcctgtggctgccgtgggggcagagctggmgagagctgcctgcggctagcaggaagggaagggggagcctcttctgctcacccagcttcaccccacggggtcagctggcttctctccatgccccttctgggcctgccttgcccttccctgtctctgggaagctgcccaggctatttcagctttatttattttcccatctctatattggtctccaaaatggcactttgggtgtctgggacacctggagcctcccctgtggaggaggtaaccacagaactgtccagaaatgaccctctcggtggtcctgcccaggcctggctgaggcagggg

SEQ ID NO: 34037 - DNA, 601 bp, Human
agcctcccctgtggaggaggtaaccacagaactgtccagaaatgaccctctcggtggtcctgcccaggcctggctgaggcagggggctggcagctggacccccagccccccttctcacttgctgctcctatcccacccccaggctgagcagaggcagtggctttggggtgggactgagctggaggtgtctgtatggccctgagcccaggcagaagtgccaagtgccagtagactgttcttccattttttccttcatcaactcaccttgatggggtcgtgggaaattacaggggggtttctrtcctcctcggatcttgtaagcagcacgggtggtagagtatcactcttacccgaactagctggcctgagattgaatctcgcatctgctgccaccagctgtgtgaccttgggcaagttgcttaacctctgtgcacagtgccttcgtctgaataatgtggattacctctctccagagggtggtgtgagataggaggatatgttaagcatttaaagattcctgacgtggagtcagcattcagtgtttgctactactgttctcccggaaaggagaggaaatggaacttggacatgaagaagctgg

SEQ ID NO: 34038 - DNA, 601 bp, Human
agctgtgtgaccttgggcaagttgcttaacctctgtgcacagtgccttcgtctgaataatgtggattacctctctccagagggtggtgtgagataggaggatatgttaagcatttaaagattcctgacgtggagtcagcattcagtgtttgctactactgttctcccggaaaggagaggaaatggaacttggacatgaagaagctgggaaatacacacagcaaccttttgaccatgacttccagccccggccctttccatcagctctcctctccatctgtgtgtgtctaattttttttttwaatttgtatttttttgagacagggtctctctctgtctcccaggctggaatgcagtggcgtgatcttggctcattgcagccttgacttcccagactcaagcgattttctcgcctccacctcctgaatagctgggactacaggcgtgcatcaccatgcccggctaatttttgtatttttagtagagacagggtttcgtcatgttgcccaggcttgtttcaaactcctgacctcaagtgatctgcccacctcagcctcccaaagtgctgggattacaggtgtcagccaccgcgccctgcctaa

SEQ ID NO: 34039 - DNA, 601 bp, Human
tttattaattttttttttttttaaatagagatggggtactatgttcccaggctggtctcgaactcctgggctcgagtgatccacctgtcttggcctcctagactgctgggattacagacatgagccattttgttttttaagtccagcctaatttttgtgttttttttttagacggagttttactctgtcgcccagcctggagtacagtgtcaccatctcagctcactgcaacctccggctcccaggttcaaggaattctcctgcctcagcctcccaagtagctgggattacgcccaccacrcccggctaactttttttgtattttttttagtagagatggggtttcagcatgttaggctggtcatgaactcctgacctcaggtgatccacccacctctgcctcccaaagtggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatg

SEQ ID NO: 34040 - DNA, 601 bp, Human
caggctggtctcgaactcctgggctcgagtgatccacctgtcttggcctcctagactgctgggattacagacatgagccattttgttttttaagtccagcctaatttttgtgttttttttttagacggagttttactctgtcgcccagcctggagtacagtgtcaccatctcagctcactgcaacctccggctcccaggttcaaggaattctcctgcctcagcctcccaagtagctgggattacgcccaccacgcccggctaactttttttgtattttttttagtagagatggggtttcascatgttaggctggtcatgaactcctgacctcaggtgatccacccacctctgcctcccaaagtggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatgagaagcaagatagatccagggagaacaactaagaactgacagaaaaa

SEQ ID NO: 34041 - DNA, 601 bp, Human
agtggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatgagaagcaagatagatccagggagaacaactaagaactgacagaaaaattagagtttcacggatggtggttgtttgggtgtcaggagcctcagatgtcagtcagtccygggcctgacagcagagtttccaaaatgggagcccaggtatctcccaggagtggggtcctctgggagcccaggcatctcccagaagtggggtcctctgaccgaagcgctgagttgcatcctggcctgagcgacaactgggttgtgaccttgggcaggtcccttcctccacagggacccccacagcaccctggtgagccatcctagacaacaggggcaagcactcctgccagggcaagaagggagccctgaagaggggctctgggctgggccctccctacacccctggccccccacccttca

SEQ ID NO: 34042 - DNA, 601 bp, Human
ggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatgagaagcaagatagatccagggagaacaactaagaactgacagaaaaattagagtttcacggatggtggttgtttgggtgtcaggagcctcagatgtcagtcagtcctggkcctgacagcagagtttccaaaatgggagcccaggtatctcccaggagtggggtcctctgggagcccaggcatctcccagaagtggggtcctctgaccgaagcgctgagttgcatcctggcctgagcgacaactgggttgtgaccttgggcaggtcccttcctccacagggacccccacagcaccctggtgagccatcctagacaacaggggcaagcactcctgccagggcaagaagggagccctgaagaggggctctgggctgggccctccctacacccctggccccccacccttcactt

SEQ ID NO: 34043 - DNA, 601 bp, Human
ctgacagaaaaattagagtttcacggatggtggttgtttgggtgtcaggagcctcagatgtcagtcagtcctgggcctgacagcagagtttccaaaatgggagcccaggtatctcccaggagtggggtcctctgggagcccaggcatctcccagaagtggggtcctctgaccgaagcgctgagttgcatcctggcctgagcgacaactgggttgtgaccttgggcaggtcccttcctccacagggacccccacagcaccctggtgagccatcctagacaacaggggcaagcactcctgccrgggcaagaagggagccctgaagaggggctctgggctgggccctccctacacccctggccccccacccttcacttctgccaccccttccatacccaaagacctttcaaagagcctccctgtcttgattatccatagtcagggtctgaaggtgctttaaaatggtcacagactccaaatgggagggattttagagatcagctagccagctcccttcaggggacccagagaggggaactgacttgcttagaaacacacagcaaggtggtgctgatcccaggctccctcccttctcagccccta

SEQ ID NO: 34044 - DNA, 601 bp, Human
ctcgttcagcacttcattgctgacagagcactttcacactggccctccacagtgcgctgctgctttagagccactgtctgtatcgtgggttggagtgactggcgttatggtccccattttacagatgtgggaactgagtcttgagatgtgaagtcgttggcccaagatcactcagaagtgggagactgagcctgcgttagtgctagctccgcctggctttgtgcccagacttggtgataagaagccccctccccatattatacctgatttctgtcacaactcttttacagatgaagaaacygaggccaggggcttgagatgcagggcttctgtatctggagctacatttctctgcctctgagtgccctaccttccccgatgcccgcttcccaaagggcctcccactaagagtcaccgtgctggcccagggcttccaggactgaggaagagctggtgctaggcaggttctggactcttggggtgggttggtgcctctatccactgcattcacttctgaactaatggggaacagcacatccaagcccttcttgtctggatcagaacagagaaggagagggaaccacatggatgagtgactggg

SEQ ID NO: 34045 - DNA, 601 bp, Human
ctggaacagatggctgatgaggtggacagtgaagtctctggaagccaaggaatagtttcctgttccatgagttttctcagcctcattctgttcttcaaaaccctcaggggaggacaagctgttcctcatatttcaattcctttcgtgccagggaagtcctttctgatgtctgacttgagtccctctagtactgtggtggggtggaagggttcttccctggagcttggagacctgctgagatgctgtctgacccccgctgctttcctcccctcctatggcggtggcctctgaagccatcccrgcaggctcccagaatccgcggggcctgtcaaaggcgcactgatggagccttccctggggctgtctcaccaccctcctttctgggcaccaactctgtcctttggcacagccctcactcagctggttgctgaaaagctcccccaggcgtagtgggcagggccacatcctggctaacatgagggctggggccaccctgggagccctggaaagaacctttttcctataagcttccagacaggatgggcagggagtgaagggtcaggagtcaggcagatgagggtttgcactctggtagtgccgg

SEQ ID NO: 34046 - DNA, 601 bp, Human
ctggctaacatgagggctggggccaccctgggagccctggaaagaacctttttcctataagcttccagacaggatgggcagggagtgaagggtcaggagtcaggcagatgagggtttgcactctggtagtgccggacattgactgctaagctctgtgaccttgggcaggggactttgcctttctgtggctccgtttcctgatccgtaaattggagctgttaattgcgtggctatatgtatggtgggatctaaatgagatggttcatgtaaggccctggactctgtgcctgccattcactgygcaccaaagacttggtagtggcttattattacgagtctaacaccttttggctgaggcctctgctttgagttggggacttctgatcagggtctttctgctgactccctgtccctgtctcctgactggttgctgcctcagaggggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccagg

SEQ ID NO: 34047 - DNA, 601 bp, Human
gagggagactggtgtctcattttgcagaggtgaaaactgaggcttggcaagattaggtagcttgtccaaggacacacagctggtgcttccagagcgagacctggctttctgtacccaaagctcttgggtagtctctcccatcctgggatcttgagggtcacgggaaggaactgggtggtttgcagtgggacccttcacctagtgccttctgaccttgcagataaaataccatgaggagtttgagaagagccgcatgggccctagcgggggcgagggcatggagccagagcgtcgggattcrcaggacggcagcagctaccggcggcccctggagcagcagcagcctcaccacatcccgaccagtgccccgggtgagtgcgggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacac

SEQ ID NO: 34048 - DNA, 601 bp, Human
ctggtgcttccagagcgagacctggctttctgtacccaaagctcttgggtagtctctcccatcctgggatcttgagggtcacgggaaggaactgggtggtttgcagtgggacccttcacctagtgccttctgaccttgcagataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccgggtgagtgcrggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacatgcacgcacgcatgcaggcgtggaaaggactgcttcccaagaccccaagttccattctcatccagaatgaggac

SEQ ID NO: 34049 - DNA, 601 bp, Human
acggcagcagctaccggcggcccctggagcagcagcagcctcaccacatcccgaccagtgccccgggtgagtgcgggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacatgcacgcacgcatgcaggcgtggaaaggactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagctaggttgggggcggggtggaagtgcatggtatggacttctcgggagctctgggaggggctgggtttggcaggacagttt

SEQ ID NO: 34050 - DNA, 601 bp, Human
ccctggagcagcagcagcctcaccacatcccgaccagtgccccgggtgagtgcgggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacatgcacgcacgcatgcaggcgwggaaaggactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagctaggttgggggcggggtggaagtgcatggtatggacttctcgggagctctgggaggggctgggtttggcaggacagtttccaagccctgtctcctcccat

SEQ ID NO: 34051 - DNA, 601 bp, Human
agcagcagcagcctcaccacatcccgaccagtgccccgggtgagtgcgggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacatgcacgcacgcatgcaggcgtggaaargactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagctaggttgggggcggggtggaagtgcatggtatggacttctcgggagctctgggaggggctgggtttggcaggacagtttccaagccctgtctcctcccatcttcca

SEQ ID NO: 34052 - DNA, 601 bp, Human
ctgaggccgggccagctggggtggggaggaagtcggcgagagacagacacacacacacacacacacacacacacacacatgcacgcacgcatgcaggcgtggaaaggactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagcyaggttgggggcggggtggaagtgcatggtatggacttctcgggagctctgggaggggctgggtttggcaggacagtttccaagccctgtctcctcccatcttccagtttaccagcagccccagcagcagccggtggcccagtcctatggtggctacaaggagcctgcagccccagtctccatacagcgcagcgccccaggtggtggcggggtgagtaaccctggccggaggggagaggccagaggcagggggtccttcgggaaggcttggacacagctcatggattctcctgacctttgc

SEQ ID NO: 34053 - DNA, 601 bp, Human
ccttccagcactgggcgctgctctcctcgcttcatgaggatggcccccacatccttcagctctcaggctgcccctgcctctgaggggcctccccagccatgtcgtgtaaagcgcatcaccctgatgctttgcatcactcgactccgctggctgccttcagagcactttttccaactaaaaagagctcttcgtgttggtcaccttctctgtgtcccctgctgggctggggaccctggcagcgtccgtctggttcacctactctgagccaggcctagagcaagtgaataagcccagcaggaayggggtgagatcaggcttcctgagccctcagagctgaagtcccggctctgtaagtcctgccactcactccacccatgggtgccgctgagccacccttaccaagctcctggcaggctcagcgcctccaggctgggtgcctgggaattcaaagtagctcacgtaggagcagaacagatacttagagagataaaatcgcctgagataatggctggctggagtctgatgctctgggcacacaaacaaagggatgttaggactgcccagggcactgtgggcgcaagagttagtctgaagtataagg

SEQ ID NO: 34054 - DNA, 601 bp, Human
ctcaatgggtctgtcctggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggcsaacatggtgaaaccccctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctgg

SEQ ID NO: 34055 - DNA, 601 bp, Human
tggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggccaacatggtgaaacccyctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctggccaacatggtgaaacc

SEQ ID NO: 34056 - DNA, 601 bp, Human
aagtgggcagatcacctgaggtcaggagttcgaaaccagcctggccaacatggtgaaaccctgtctctactaaaaatataaaattagctcggcatggtggtgcatgttcataatcccagctactcgggaggctgaggcaggagaattgcttgaacctgggaggtggaggttgcagtgagccgagatcacgccatttgcactccagcctgggcagcaagagcaaaactccagctagaaaaaaaaaaagaaaaaaaagacgtgacatttgagcaaagtcctcaataaaggaaggagtgagccrtgcaacgaggacaggaagtgcaaaggctctgaggcaggaatattctaggaaagttcagggagcagcaggaagcccgaattgactagagtgggagagggtgggaggtccgattatgcagggacttgtgggccccaggaaggcctctgtgacctgtgatctgtgcagagcgacataggtttttggaagaccaccctggcagctgtgttgagaagaggcagtggtttgagggtagaagcagggagaccgtcaggaggctgttgcaggatataggcatggatgggagtggctcagcccaagata

SEQ ID NO: 34057 - DNA, 601 bp, Human
aaagttcagggagcagcaggaagcccgaattgactagagtgggagagggtgggaggtccgattatgcagggacttgtgggccccaggaaggcctctgtgacctgtgatctgtgcagagcgacataggtttttggaagaccaccctggcagctgtgttgagaagaggcagtggtttgagggtagaagcagggagaccgtcaggaggctgttgcaggatataggcatggatgggagtggctcagcccaagatagaggcagaattggtgatgagagagactgaggttacttcatgggaggtgtracttcttatcccatagacctgttggtttcaaactgtcctgtggagcctcagagaccagtcaagggcagtgaaggtcaggggaggtagaatgttgtctatagctataggatttatttttcttttttttttcctctttctttttttaaactccatcctggtagtaggtggcgctgtaggtttttgtgtgccttactgaacattacctagatctagggcttaagcggcagattttggctgaggcttggaaggtggaacctgatagactcgtcttctgtcctctgaagatttttctcccaagga

SEQ ID NO: 34058 - DNA, 601 bp, Human
ctctgctgcccaggctggagtgcagcagtggtgcaatcacagctagctcactgcagccttaacctcctgggttgaagccatcctcccacctcagcctcctgagtagctgagactacaggcatgtaccactaagcctaactaattttttattttttgttgagatgggctcacgctagtactttgggaggccgaggcgagcggatcacttgagaccaggagtttgagaccatcgtagccaacatgatgaaaccctgtctctacaaaaaagtacaaaaattagccgggcatggtggtacacgcytatagtcccagctacttgggaggctgaggcaggagaatcgcttgaacccgggaggcggatgttgcagtgagccaagatcacaccattgcactccagcttgggtgacaaagcaagactccatctcaaaaaaaaaaaaaaaaagagggagttggggggtcttactgtgtttcccaggctgatttcaaacttctgggctcaagcagttctcctgccttggcctcccacagtgctgggattacaggcgtgagccactgcacctggcctgcatgtcgtatttttagacattactctgtcatcatg

SEQ ID NO: 34059 - DNA, 601 bp, Human
ccacttcttggttcctgggatggcgatggggactctgccgctgtgtagagaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagrgacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccacta

SEQ ID NO: 34060 - DNA, 601 bp, Human
aaggttagaggtctcaagtaggcatattttgtttagccttcacagtgttttttaaacatttaaattcattgccgatatttaaatattaggatatttattataaaaattcagactttagaccatttaaaattggaagaactaccaacattgagacctggttcctgcaaggcaacaatcacagctgagaagtcaccacttgtttagattggtgatacactgtcatttcctctgcccatctacctttccactctgacacttatttacattattcttttggctcttgtaggcatttgagtttgtrgcctctccttaaagtttagattaattctcatttgtgtattcttcatttttgggaattcagcatgttatctctaagacagctactgttagctacacattgaaaaggggttgggtgggtatcttagactttctcatgtgtttctctgactggagagaagatagctcttgttcttcaaatatttaactaaaggatttgctgtgggtgtctgctgttggagccgtgggtgttaagagacttttgattatgcaggtttgaatcctggctctgttgttaactagatggatgatattggccaagtta

SEQ ID NO: 34061 - DNA, 601 bp, Human
atgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatcyatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatg

SEQ ID NO: 34062 - DNA, 601 bp, Human
ggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccktgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgccc

SEQ ID NO: 34063 - DNA, 601 bp, Human
gcgttccggtgactcccggcggtctgtgctctgggtgctgagcaggtgttttctgttctctcgccagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtgtaagccgcgggggacctccggcctctggcrgggggcggtaggagggggcgtgcctccctcccagtcccggggggtctggccagccccccgcacttccaggctgcgtggccaggacacttttggtttaacagccaataagtaaacttcactcttgcttttgacaatggatttgcttctctctagggtttcagccctgtgtatattgccacttaaaatgtcagatatgcagctataaatacctccctctgcatttagcttctaaacaggacccctatttctttccgaatacagcagtgtaatgagaggatggttaaaacgtgagcatcaaaa

SEQ ID NO: 34064 - DNA, 601 bp, Human
ccgcatcacagggaagaccgtgtccaccaccagccacgaggccatcctctccaacaccaaagtcctggagatcccactcctgccggagaacagcatgcgagccgtgtaagccgcgggggacctccggcctctggcagggggcggtaggagggggcgtgcctccctcccagtcccggggggtctggccagccccccgcacttccaggctgcgtggccaggacacttttggtttaacagccaataagtaaacttcactcttgcttttgacaatggatttgcttctctctagggtttcagcccygtgtatattgccacttaaaatgtcagatatgcagctataaatacctccctctgcatttagcttctaaacaggacccctatttctttccgaatacagcagtgtaatgagaggatggttaaaacgtgagcatcaaaaaattaaagcagtcagcacatctggatcacgttgacctttaggaggttccgacaacacggataggcctgtgctgatgttctgagtctaatttgacactgtaatttgtttaaaagtgaattttttagtaaggtgaggacgaaacatgtaacttccaaataaggcctt

SEQ ID NO: 34065 - DNA, 601 bp, Human
cgaatacagcagtgtaatgagaggatggttaaaacgtgagcatcaaaaaattaaagcagtcagcacatctggatcacgttgacctttaggaggttccgacaacacggataggcctgtgctgatgttctgagtctaatttgacactgtaatttgtttaaaagtgaattttttagtaaggtgaggacgaaacatgtaacttccaaataaggccttactcacttaatcctagcttgtgctgggcacgctggccctaacctgtgaaggcagccgaggaggaggactgctggttcccgagagattsatgtggtactgtggggggaaccgaaaacagacacatctgtgggtgaatgagtgcaggttgagctgggacggctggaacgtgcagaccagcaggatggagccaggccggagggcagggacggcgtcctgcgagggtgacccgcaggctgggagcccgtgtgatggggaagctgtgtgtggggtgccccatccaggtggagccccgggggtgggtgcagaggtcctggggctgcaggagtggggaggagtcccgcacggtgagggagagcgtgtaggagatggcggcggggggccacgttgg

SEQ ID NO: 34066 - DNA, 601 bp, Human
cagagggtctggggggccaggcctttatgctcccgcgtcagccattgaaagaaaagctgtgggcttttgttttgggcagcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctgtaagtggacgtccacgcgcccacaggggaggaaaccgtcccgtcacaygcgcttcactgtctcaccctctctcagcttttcgttcgtgtagacttgggactgaacggttcccaccaaacccaccacagtgtgtggccacgaggggtctgagttgatcatggctgagttattgcctgtggcctcccgggggcccctggcgctggctcctctgatggctgagcatggccagggaaagcggtgtgggccggggcttcccctcacgctgcgctgacctttgcgtatttgtgcgatgactgtgatttgagtgaaattggctgagtcttaggaagatattttgatgacttcttc

SEQ ID NO: 34067 - DNA, 601 bp, Human
caggactccaaggtcattttcgtggagaaagccccaggtatgctcttcaccaggggccatctgcggcctgggcttcggcgctggtgggaaccggttcccagtcggtggagcaggacccacctgtgcacggtcaccgggacggggcttatggggtgtggcacggagcagaggctctgcgtggcccgtgtctgcatccggctgtgggtttttgtgtgagccgacagctgtgctgctgaagggaagaggtggatgtttatttctggggccgccggggccactgcactcacatcgctgctgatastcagggagcccacgggctggggacgcagaggagggcaagacgcatttgctggctttgctggggtcctccatctgcagagagtggacgcttcgggggtcagttagcagcagggcaggagggagctcccctccggggccttcccctcccgccagcattcctggggtcggaggcagggatggggtgggtgccgcagacggcgggagctggggtggtctttaatgccacagccgtggtgtgtgtgaggctctcgtgccccaagggcacaggtcacccctgcctccaggtgttgcgctggcccag

SEQ ID NO: 34068 - DNA, 601 bp, Human
gactccaaggtcattttcgtggagaaagccccaggtatgctcttcaccaggggccatctgcggcctgggcttcggcgctggtgggaaccggttcccagtcggtggagcaggacccacctgtgcacggtcaccgggacggggcttatggggtgtggcacggagcagaggctctgcgtggcccgtgtctgcatccggctgtgggtttttgtgtgagccgacagctgtgctgctgaagggaagaggtggatgtttatttctggggccgccggggccactgcactcacatcgctgctgatactcrgggagcccacgggctggggacgcagaggagggcaagacgcatttgctggctttgctggggtcctccatctgcagagagtggacgcttcgggggtcagttagcagcagggcaggagggagctcccctccggggccttcccctcccgccagcattcctggggtcggaggcagggatggggtgggtgccgcagacggcgggagctggggtggtctttaatgccacagccgtggtgtgtgtgaggctctcgtgccccaagggcacaggtcacccctgcctccaggtgttgcgctggcccagcct

SEQ ID NO: 34069 - DNA, 601 bp, Human
tggatgtttatttctggggccgccggggccactgcactcacatcgctgctgatactcagggagcccacgggctggggacgcagaggagggcaagacgcatttgctggctttgctggggtcctccatctgcagagagtggacgcttcgggggtcagttagcagcagggcaggagggagctcccctccggggccttcccctcccgccagcattcctggggtcggaggcagggatggggtgggtgccgcagacggcgggagctggggtggtctttaatgccacagccgtggtgtgtgtgaggcyctcgtgccccaagggcacaggtcacccctgcctccaggtgttgcgctggcccagcctggaggctccggggctgaacttggaagggcagcaggggtgtcctcggagtgatgttcctcctggggccgtcacgcctgtggttctgtgctgcccacgggagactgtcctgcggggattgggctcacagagtggctcccagcccaggtcagttccatgcagacgccgggccccagcactctcatcccagaggggtggcctcgccggctccgagcagagtgtgtgaagacagtgggctgcactgat

SEQ ID NO: 34070 - DNA, 601 bp, Human
gggcagccaccagcctgcgagggccaggagccaaggggatgcaggaccagccctggcctcatgcggccgcccctacaggcagcccctcctgccttcatcatcactgtgagctgtggggtcagcaggccggaggggtacctgttctgcccttaagctcggctgccacagccacacttctgggcaatgccagtttgtctgcccatgtcctcctcttgtcccatgaggtcagggtgggtctctgaccctctgccagcaccagccggcgtctggtatacagcaggtgagccataaatgaataggygctgtgctcgagagcacgtgaagctgtgaatactgcagggatgaagccagaccacgttgataattttattctttatagttgaataagataatttgcatattcatacacacacaagcacattccatgttttcaaaagtggagaacaaatgtccacataattttcttcctccacttccggcttctcaggcgggagccgttgcttacaacacgtgctgatgtgcagtgacaggttggtgcagcagaaagccccacatcctcatcctggcaacgagagaaaccactaaactgaatttaaattaa

SEQ ID NO: 34071 - DNA, 601 bp, Human
tctccaggaagggcccctgcgtctctcgactgtcctgctcattccgagggtgcagatggttgtagctgttgggaatgttggctctggacacaggccagggtcggctccaccctgtccttctctggagtacgtaggaagctcattgtccaggccagctcagcctctgcgtatcagccaggccaccttcagctgctatgggttcacagcatctctgagctttgggaagttttagatggagcggctccactgccctggaaggctgggagaagctggtgttggcctcatgaggaagggagtcccygcagcagggctgcattgcggggagccggccgggcaagggcatggctcgccgtagcctgggtgccgggtccctctgggatgctccagcagggcaggaggagggtgggtgtttgagtctcagcctgcgctccacggagcttcctcccaggtgtctcagggcggcgcaaaaggccgggagcggagtcagcctttctctgaggacttagtttacagcttcctcggaaaacgacattttccgatgatgaaaatctgtgaggaatgttcttccaggaggcaggttggctgtggggagccgagggcc

SEQ ID NO: 34072 - DNA, 601 bp, Human
gacattttccgatgatgaaaatctgtgaggaatgttcttccaggaggcaggttggctgtggggagccgagggccgggtgttggtttagaagcccctggtagcatcacaagaacccccagtttccaaggctgcaggggttcagctgcaggaagtgggaaccacacccctctcccacccacacccctccccaccttcacacctgcacccctcccgcctgttaaagatcactgtgtctgtgttccgatgtgaggcacctctctgtacacgcgtgaacgttgaagctgctgagggacacactaaygttcaacataaacgaaacgcccgaagaacgcccgcgtgaaacgtgagctcgggctgtgtctagagcctggctgagatgagacagaaggcgcaaggttctgagatgtggatgcatcaaacatgagccagttctcgatgctggagctgaacaacctccttttcttaagtcacgcgtctgttctggtgccgttttttaaaaacatcagcgaagcctgttttggtgtcgctgcgcggaagccacactacgacgccgggggtgaagactcccactccgtttgccagcgatcgcgcagcgggcagg

SEQ ID NO: 34073 - DNA, 601 bp, Human
cctggcatctcacaggcggccggggctcccgggaagcagagacgggctgtgccagggctcctaggcccaggcctggacccagtgccgtgccagccaccaccccaggggccctgccctggttcgcagggagacacacagaaatgtgggaggccgggtggcctgcacggtgggagcgagtagacagagcccctcccggaggcccccagcccagcacatccagagccctcccctgagaaaccccagacagccaggttcgccccaaacccaacatggtgggaccccagctcgccccccatctcayggccgccccatcccacggccgccccatcctctggccctggatgttaccacgtggagaagacaggcctgtgggcaggcactagccacactgcaggagacgcaggctaggtttccagatttctccacacagcagcaggcggagggcctgcctcccacctcactgggagggccaggactccaaatctgggccaaatgtatgttgttatttttcaaataaagggaccaaaggcccgggcctttccaaggctgccctgccatgggaccgtgaccggtgtggttcccaggacttccacaagctctg

SEQ ID NO: 34074 - DNA, 601 bp, Human
ccccaggcagaggccatgtcatccaggtgcaggaagcgccaggcaaggaccctcctgtccgcccagagagccgggtcagaggagtccccaggcctgaagccactccctccgggctcaccttcaggttccttcaaggccagggggaggttcacccaccccagggtgtcgcggaagccccgaggcccctgcaggccccgatttccccagtgaggcatcagtgcccgctggccaccctgcccctctcctcctccagctgcccctgctccttgttttcctagggtctggttctttctcgcgggcrgggaggaggtgagggtcagggcccctgtaaggcagactagtggcactgcccctttcggcccttgctgtccctcctctgtcccttgtggaaggtctcggcctggggcagaggagcgggccgaggaggaaggtggagtccaggtgggtggtggggtctgtgttctgttttagtcgtgcgggatgtaggccgagggagatggacccgggggatggctgcctctgtggcatctccgtggtgtgccctctgacggggctgggtgagcaaggaggacacagctgggaattcccagctccagcgtcc

SEQ ID NO: 34075 - DNA, 601 bp, Human
tttctcgcgggcggggaggaggtgagggtcagggcccctgtaaggcagactagtggcactgcccctttcggcccttgctgtccctcctctgtcccttgtggaaggtctcggcctggggcagaggagcgggccgaggaggaaggtggagtccaggtgggtggtggggtctgtgttctgttttagtcgtgcgggatgtaggccgagggagatggacccgggggatggctgcctctgtggcatctccgtggtgtgccctctgacggggctgggtgagcaaggaggacacagctgggaattcccmgctccagcgtccgcggcacgggcagcctccctgtgtggagcagctcagctgtcacctcctgaagatgttggatgctggccccgaaggcagcatcgcaatgacaacaccttcagaggtgtccatcccaacagtttaaaggccaaatgcagatctttcagatttgtgttttcagggagaaggtgacattgctgggcgcctgtgagtgtggacagacatcactgtcgccgtgtgctccgagagaggagagttggggctgctttgtcaccacatggcgtctttgggagcaggacaggtggccgg

SEQ ID NO: 34076 - DNA, 601 bp, Human
acagttctcatcaagccgcattctggatagcgctaggggcgactctcagactccccctgcctgggccccgctggtgtggggaggccacgcgtcacgtcagtccccactgcaggaggaggggccgggcttctggctcccctccctcctctcccttctcaggccttttgggatcatacacgacaaagtcacccatggtcatgttggctagtttcttttttatatcagctttatcgaaatatgatctatacaccatttaattcactcaaagtgtataattcggtgggttttggtggcttcacakaattatgcggccaccaccaatttcagaacattttcttgtccccagaaagaaacccttgcccatgagtggccacccctgctctcccttcccccaccccggctccgacaaccccaatgccccctcgccgtggcctcgcctggtctggctgctccctgctggcctgctggggaaccccatcctgccggctgtggtgcctggcagcttctgtggagcgtggcatcctccatgttccctcgttggtgtgggtcagggcgtagggtcctcaggtcccctcgttggcacaggtcgggacgtggggtc

SEQ ID NO: 34077 - DNA, 601 bp, Human
cccagaaagaaacccttgcccatgagtggccacccctgctctcccttcccccaccccggctccgacaaccccaatgccccctcgccgtggcctcgcctggtctggctgctccctgctggcctgctggggaaccccatcctgccggctgtggtgcctggcagcttctgtggagcgtggcatcctccatgttccctcgttggtgtgggtcagggcgtagggtcctcaggtcccctcgttggcacaggtcgggacgtggggtctttctgtggctgagggaagcccaccgtgtggctgcccacayctgtctgtcgatggcactaggccacgtccaccctgtggagatgatcgtggaaaagccgccatgaacctcagtgcgtgagtcctgtgtggacgcctgcctgtctcctgagcacatgcctcggtgtgaaagggctgtgggtcacagggtggctccgtgtgaggccctgcaggcagatgtgcagcagggctgggtggctgtttcccctccagaatctcctctgggagccaggctgggacagactcctgggggagagccggggatggatgagacgccccagggacgctcgcttctgggcatgag

SEQ ID NO: 34078 - DNA, 601 bp, Human
gcccatgagtggccacccctgctctcccttcccccaccccggctccgacaaccccaatgccccctcgccgtggcctcgcctggtctggctgctccctgctggcctgctggggaaccccatcctgccggctgtggtgcctggcagcttctgtggagcgtggcatcctccatgttccctcgttggtgtgggtcagggcgtagggtcctcaggtcccctcgttggcacaggtcgggacgtggggtctttctgtggctgagggaagcccaccgtgtggctgcccacacctgtctgtcgatggcamtaggccacgtccaccctgtggagatgatcgtggaaaagccgccatgaacctcagtgcgtgagtcctgtgtggacgcctgcctgtctcctgagcacatgcctcggtgtgaaagggctgtgggtcacagggtggctccgtgtgaggccctgcaggcagatgtgcagcagggctgggtggctgtttcccctccagaatctcctctgggagccaggctgggacagactcctgggggagagccggggatggatgagacgccccagggacgctcgcttctgggcatgaggatgctgtggggtgcac

SEQ ID NO: 34079 - DNA, 601 bp, Human
gcagggaagcctcccgatgactcagactgcagggaattccctaatgatctggaatatttttactcctgcactcgggcagtttcctactaaggactcggagctctgataaggctgaacacaaaggccctttcaggaccggctgccttccttcctgccaggggctgagttttgaacagcacgggggccggcgctgcccgtccgggcctccacggagctgggagccgccatggcgatgctcttgccggcgggacgcggccctgcgtctcctttcctgagatgcgaggttatttccatctttcarcagtctcggcgctttgtcttgttctggaagcaattgctagatagacatttctggccgtgaatactattgcttttgaaagacaattactttatgatccttaagcagaaacagaaagcctgccctcaccctcaccctggtcgacctgaaacggccacagacgtcggacaccacggggagaggccccacctccaagagggaaggccacaggcgctggctcagccggggtctttgaggaaggcagggatgtttgtcggttccccgcacttttaggggaagtctaagcgtatctgctcccacctg

SEQ ID NO: 34080 - DNA, 601 bp, Human
gaatatttttactcctgcactcgggcagtttcctactaaggactcggagctctgataaggctgaacacaaaggccctttcaggaccggctgccttccttcctgccaggggctgagttttgaacagcacgggggccggcgctgcccgtccgggcctccacggagctgggagccgccatggcgatgctcttgccggcgggacgcggccctgcgtctcctttcctgagatgcgaggttatttccatctttcagcagtctcggcgctttgtcttgttctggaagcaattgctagatagacatttstggccgtgaatactattgcttttgaaagacaattactttatgatccttaagcagaaacagaaagcctgccctcaccctcaccctggtcgacctgaaacggccacagacgtcggacaccacggggagaggccccacctccaagagggaaggccacaggcgctggctcagccggggtctttgaggaaggcagggatgtttgtcggttccccgcacttttaggggaagtctaagcgtatctgctcccacctgcgcaggaattgcagggtgcgggtgctcccaggtgtgcggtggaggctgctc

SEQ ID NO: 34081 - DNA, 601 bp, Human
tcgggcagtttcctactaaggactcggagctctgataaggctgaacacaaaggccctttcaggaccggctgccttccttcctgccaggggctgagttttgaacagcacgggggccggcgctgcccgtccgggcctccacggagctgggagccgccatggcgatgctcttgccggcgggacgcggccctgcgtctcctttcctgagatgcgaggttatttccatctttcagcagtctcggcgctttgtcttgttctggaagcaattgctagatagacatttctggccgtgaatactattgcytttgaaagacaattactttatgatccttaagcagaaacagaaagcctgccctcaccctcaccctggtcgacctgaaacggccacagacgtcggacaccacggggagaggccccacctccaagagggaaggccacaggcgctggctcagccggggtctttgaggaaggcagggatgtttgtcggttccccgcacttttaggggaagtctaagcgtatctgctcccacctgcgcaggaattgcagggtgcgggtgctcccaggtgtgcggtggaggctgctccatggcagctgctgagctgg

SEQ ID NO: 34082 - DNA, 601 bp, Human
cccaacctcaggtgatccgcccgcctcggcctcccaaagtgctgggattacaggcatgagccaccgtgcccggcctgatgttcacttattattgatacagttggattgatccctacgttggattttttgagtgttctgtttagtcctataaaagcagtagaaatctctaggccaacataagatgccacatggctcacaagggagttttgaagacatgaacatgcttctgagctcagcagtgtgtgtccctgcgggtcagggaagtcttgtgcacccactcagtgtgtgtccctgcgggtcggggagtcttgtgcacccactcagtgtgtgcagttggaagctggtcccttcagaaacctcagggaagagcccatctcgggcggctggaggcaggtggacaggacaccggggaggagtcttgaggtcgtctcctgttggtgggacgatcggtggcctccatggagagcggtgctggcaccttcactccctgtcccaagaggtggctctgtcagaaagcagcgtcttccaccctgcgacttcagcgcccttcccccaaggacccatccccttcccagaaccttttccaagtggttatcagatg

SEQ ID NO: 34083 - DNA, 601 bp, Human
ccaaagtgctgggattacaggcatgagccaccgtgcccggcctgatgttcacttattattgatacagttggattgatccctacgttggattttttgagtgttctgtttagtcctataaaagcagtagaaatctctaggccaacataagatgccacatggctcacaagggagttttgaagacatgaacatgcttctgagctcagcagtgtgtgtccctgcgggtcagggaagtcttgtgcacccactcagtgtgtgtccctgcgggtcggggagtcttgtgcacccactcagtgtgtgcagktggaagctggtcccttcagaaacctcagggaagagcccatctcgggcggctggaggcaggtggacaggacaccggggaggagtcttgaggtcgtctcctgttggtgggacgatcggtggcctccatggagagcggtgctggcaccttcactccctgtcccaagaggtggctctgtcagaaagcagcgtcttccaccctgcgacttcagcgcccttcccccaaggacccatccccttcccagaaccttttccaagtggttatcagatggaaaaggttcctccctggccctgggtgaagtga

SEQ ID NO: 34084 - DNA, 601 bp, Human
aatctcttaaatggagtttgctttaatatatatattttctcatcataaaggaacttcatactcatcgtggacatttggacaatataaaaaaggaaataaaacctagtgtagtctcaccaactgagacataaccactgctggcattgggcatgcgtcctgctccatttgctgctgtgtgtggatgttcacgcagacacacacacacacacagagtacattatattgtggatatatgtgtttgtgtgtgtgtgtgtgtgtgtgtatatgtatgtgtatatatatatatttatttatttatttwtttttttttttttgagacagggtcttgctgtgtcatccaggctggagtccagtggcttgatcatggctcactgcagccttgacctcccaggctgaagcagttctcatgcctcagcctcgccagtagctggggacacaagtgtgccctattctgcccagctaatttttaaatttttgtagagatggggcctcgcggtgttgcccaggctggtcctgaactcctgggctcaagcaatcctcccacctgggcctcccaaagtgctgggatgacaggtgtgagccaccgtgcccgcctgtgcat

SEQ ID NO: 34085 - DNA, 601 bp, Human
ccctattctgcccagctaatttttaaatttttgtagagatggggcctcgcggtgttgcccaggctggtcctgaactcctgggctcaagcaatcctcccacctgggcctcccaaagtgctgggatgacaggtgtgagccaccgtgcccgcctgtgcatattttgtgaacaaaatgggatgtgctgtgtctacggtttttgtactttctataagtaagtgtatgagcttcatctcaacagtggagtttaaagcaggttgcgtaggtgctggtgccatttggaacccgtattttttccggtacrgacgagtttccctctcccttcctgttcttccgtgtttcttctttatcgcttccttctgtgtgtatttaagtggcagtgctcccacggagatagtatttttgtcatataatttgtctatttagagagttgaagtgggttggcctgtgcccacatcaacataggcccttccagtcaggtaggacttaggaaaactggcatgcaccgtccagcatgccccacagggtcccacctccacccatccagcctgcctcacggggtccccgcctccacccagtctggcccacaaggtcccgcctccgc

SEQ ID NO: 34086 - DNA, 601 bp, Human
agtgcctcccggcccgttactatttcagtctcggcttccatgagacgtttccttcttgtctcttccctcagctgcttctgctctaaagacccacctggtgtagctgctgactccatcgcagctgccctgagcactgctgaattcagaaaacagccttggaggaagcgtctctttatcccccgtacaaatgccgagacaggctccgggtggccagagcttcccgggtcagcccaggagatggcccagacccacagtgctctgggggcagcccaggccccgcccactgacagcactcatggcycctccggcggcagcttcagctcccctggggcagctctgatgcggggcaaaggcaggaagacgcccatgtgccatggcttctgcttcttcccaatgaactgcagttaattaaacaacacagacctgctgccaggagaaagtgtggcccctgggcacagggcccagtggggtggggagcaggggtgcggggagggcatggcccctctgcatgggtgtctgggcctcagctgtttcattatttgtaaatgaaagagcctggacctcaagttgtcttcagttttctgtctttaacactcttaag

SEQ ID NO: 34087 - DNA, 601 bp, Human
gccctctgctgtctgtgcctccgtgcccttggctgttcccaccccggggtctgcgggggtcagggcctgcctcctcttcctcagttggagtgaatttggggtctgactgagggcctcggccatcgtcaaatgtgacaaacacaggccctccccagagaccgcgtctccaggaagcacctgctcctctgggtttcgctgcagtcacctgagcaggtgctgggccaccgagcacttccatcacacagtggctggcggcggagccttgggtcgttttctgaaggtcaccaaccctttggcatcrgagcaggcagagccttttgcatccccgccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggacc

SEQ ID NO: 34088 - DNA, 601 bp, Human
ccttggctgttcccaccccggggtctgcgggggtcagggcctgcctcctcttcctcagttggagtgaatttggggtctgactgagggcctcggccatcgtcaaatgtgacaaacacaggccctccccagagaccgcgtctccaggaagcacctgctcctctgggtttcgctgcagtcacctgagcaggtgctgggccaccgagcacttccatcacacagtggctggcggcggagccttgggtcgttttctgaaggtcaccaaccctttggcatcagagcaggcagagccttttgcatcccygccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttac

SEQ ID NO: 34089 - DNA, 601 bp, Human
ttttctgaaggtcaccaaccctttggcatcagagcaggcagagccttttgcatccccgccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcrtccagggctgtcatcagctgcttctggaccgcccaggtggctgcttgggagtttaccgtcacggcagtcctgtgctgccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagttt

SEQ ID NO: 34090 - DNA, 601 bp, Human
tgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttaccgtcacggcagycctgtgctgccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagtttctacgtctgcaacgggaagagaaagcgaagccagtaccagcgtttcacctaccttcccgccaacggta

SEQ ID NO: 34091 - DNA, 601 bp, Human
tggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttaccgtcacggcagtcctgtgcygccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatc

SEQ ID NO: 34092 - DNA, 601 bp, Human
ctaatactttctcaatttttcttttcttacagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctyatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagt

SEQ ID NO: 34093 - DNA, 601 bp, Human
attcttttacccctcacccgactcccatccttccccccaagtccccagagtccattatcattcttatgcctttgtgtcctcaaagcttggctgccacttataagtgagaatgatgtttggttttccattcccaagttccttcacttagaataatgacctccaattccatccagtttgctgcaaatgccattatttcattcctttttatggctgagtagtattccatggttaaaatacacaaccatttttaatggatgaaaattatcttgttaaaaatagggcttaaatcatgttatcaagytattctggcatgttattaaacatgcagaacgtagcttgttttcttccttaatcggatattaaatagactctaaacttaaaaaaaagataagagatcaggctgcctgcaatgtagaaaatgaacaaaagggagcacaaaagactggaaatgtagagtggaaaaggtttcccacagctgttacaaggaagctgacagagaggaaaaggtcacaaccgtgttactactcacatcctccagaaggtcctcgggcagactaactctggtgcctcccaggaggcaatcctccatgatgcgcgtgcc

SEQ ID NO: 34094 - DNA, 601 bp, Human
tgggaaagtgtctgttaagagacatggacatgctgaagtgcttggcagtgaagtgtcatattttctgcagcaaaaagtgtgtgtgtacctaaacacacacacacacgaaccttgatacgtgcaataaagcaaatggcaagctctttttaaaattttttaaagaccagacatgaagggcacctctagtatgctggaaatgttttatttttttatgtagatgctggttacaagctgatgctggttacaagctgaattcatattatgtattttctatataagtcaatacatttttgttttttaraacacagcctagacagcaaagtgttacacaaaaccgctctttgctgcctcagtatctgtacatgaagataaaaagaagaaaaggaagaaaggaatacccacataaagtgaacgtgtgcccatccaccacccccctcaaagaaagaatactgagctacaaacctcggaaaagcttctgggcaatgtgcagagggtttccaaagcggaagttctccccactgaacaaggctaagatgagttcattctgctgctcagcactgtcttcaggaaactggggcagaaactgctggaggtgttcacg

SEQ ID NO: 34095 - DNA, 601 bp, Human
gtcaacaaatatattgaatgagtgcttaacatggtaaactctgtaccacaaaacttaagggaaaagtgaacatttaagagaatcaagaaggagaaccaaaagtaaaagcgtgctgagaagcaatgacagctcatttaaggctgatgatcatcacagccacagtaatgcaactgtcttcagcagcactagaactgacacatggcatgggtcagagtggaatatgcaggaagtcctgccttgacattcctcatctgtatccttaccagacgaccatactgtttcgggggaaacatgccagcamaagagacagtgctacctttatggaaggtcccttacagagcccctctaaagccaagtgggtccccaacttctgctctatcagaggagacagtgcaccctcagctgtagtgaaacagatctctgccaaccatagaggggaattcctttttacactagtaacccaccaaagaagggaatgttcattttacacccttaatataatgcgatttcaggtgaaaaggctactctctctggtcattagcagctgtcaagttgtcaagtttaacagaattccagatgtgctgcccattcagggccttgt

SEQ ID NO: 34096 - DNA, 601 bp, Human
gccgatggaaatactgctgctgggagttgaggtagcgcttgtactgtgacttgaagcataactgccggtacttgaccacctcggggttaaagtgtccgtcttaaaaaaataaaggtatatatatttacatcaatcaacaaatatacatcatcagtcaacaaatatattgaatgagtgcttaacatggtaaactctgtaccacaaaacttaagggaaaagtgaacatttaagagaatcaagaaggagaaccaaaagtaaaagcgtgctgagaagcaatgacagctcatttaaggctgatgaycatcacagccacagtaatgcaactgtcttcagcagcactagaactgacacatggcatgggtcagagtggaatatgcaggaagtcctgccttgacattcctcatctgtatccttaccagacgaccatactgtttcgggggaaacatgccagcaaaagagacagtgctacctttatggaaggtcccttacagagcccctctaaagccaagtgggtccccaacttctgctctatcagaggagacagtgcaccctcagctgtagtgaaacagatctctgccaaccatagaggggaattcctttt

SEQ ID NO: 34097 - DNA, 601 bp, Human
tccccatctgatggcaatgtctcagcaacccaaagaccaaggccttctgagtcccgctatgcaccccagaccagacaactcaagagggtttctttgctggggagataaatggctaccactggctccaaccggacaagtggccggtatccatccaataccccagctaccccaagtgcccgaggacactcaccctcttcatcagatgacagggctgtgtcaccacactcctctttcacttcccttaagaccttcaagtagcgctgctgggtccgccactcccgctcctcaggtgtgcgggatrgtgaagggcgtttctgccggaagggaagggcggggccactccgccgggccatctccagcagatcctaggtagagatcaggtgggggtacaagtcatcatccaagacctgttctggaacaatgaacactctacaagtctacattttcttctcttcagtgttaagcccaactccctccctccagatcacaaagaaagatgcacatatatattaatatatccgaagaatctatattgattacatgaaaaatcccaaatctgactgttgaagtgctctactaggaatgaatacttttttatact

SEQ ID NO: 34098 - DNA, 601 bp, Human
ctccccatctgatggcaatgtctcagcaacccaaagaccaaggccttctgagtcccgctatgcaccccagaccagacaactcaagagggtttctttgctggggagataaatggctaccactggctccaaccggacaagtggccggtatccatccaataccccagctaccccaagtgcccgaggacactcaccctcttcatcagatgacagggctgtgtcaccacactcctctttcacttcccttaagaccttcaagtagcgctgctgggtccgccactcccgctcctcaggtgtgcgggawggtgaagggcgtttctgccggaagggaagggcggggccactccgccgggccatctccagcagatcctaggtagagatcaggtgggggtacaagtcatcatccaagacctgttctggaacaatgaacactctacaagtctacattttcttctcttcagtgttaagcccaactccctccctccagatcacaaagaaagatgcacatatatattaatatatccgaagaatctatattgattacatgaaaaatcccaaatctgactgttgaagtgctctactaggaatgaatacttttttatac

SEQ ID NO: 34099 - DNA, 601 bp, Human
gtcactccccatctgatggcaatgtctcagcaacccaaagaccaaggccttctgagtcccgctatgcaccccagaccagacaactcaagagggtttctttgctggggagataaatggctaccactggctccaaccggacaagtggccggtatccatccaataccccagctaccccaagtgcccgaggacactcaccctcttcatcagatgacagggctgtgtcaccacactcctctttcacttcccttaagaccttcaagtagcgctgctgggtccgccactcccgctcctcaggtgtgckggatggtgaagggcgtttctgccggaagggaagggcggggccactccgccgggccatctccagcagatcctaggtagagatcaggtgggggtacaagtcatcatccaagacctgttctggaacaatgaacactctacaagtctacattttcttctcttcagtgttaagcccaactccctccctccagatcacaaagaaagatgcacatatatattaatatatccgaagaatctatattgattacatgaaaaatcccaaatctgactgttgaagtgctctactaggaatgaatactttttt

SEQ ID NO: 34100 - DNA, 601 bp, Human
aggccatggagtcactccccatctgatggcaatgtctcagcaacccaaagaccaaggccttctgagtcccgctatgcaccccagaccagacaactcaagagggtttctttgctggggagataaatggctaccactggctccaaccggacaagtggccggtatccatccaataccccagctaccccaagtgcccgaggacactcaccctcttcatcagatgacagggctgtgtcaccacactcctctttcacttcccttaagaccttcaagtagcgctgctgggtccgccactcccgctccycaggtgtgcgggatggtgaagggcgtttctgccggaagggaagggcggggccactccgccgggccatctccagcagatcctaggtagagatcaggtgggggtacaagtcatcatccaagacctgttctggaacaatgaacactctacaagtctacattttcttctcttcagtgttaagcccaactccctccctccagatcacaaagaaagatgcacatatatattaatatatccgaagaatctatattgattacatgaaaaatcccaaatctgactgttgaagtgctctactaggaatga

SEQ ID NO: 34101 - DNA, 601 bp, Human
cttggctctggttattcctttgtccgcttaccgcactgccccttcgtactactgtttcaagattttgctttctttagcccaaaatatcagcttctgagaaaaaattttaaaacaaaagaaaaaaggcaggcctatctccagatgtaaaaaaaagtaaaatggtacaaaaactttgccaaacaaatcacctagttctagggagttttgttttcctggtaggtaggaatctgcccccacccacctccctctaaaggagttttcaggtctccaccgcaatgtcccagaatggtgacagcggcakcttggttctcacctgcggttttcatatccgtggttgaaagtgtgggcaccacccgcaggggcaccgcaggactaggagaacgtgctggagagctcggaagccatgagctgagatcttcaaaagaaaattgttcttgtaaatccaacgtggctgtggactccaataggggagattgggtaagtggccatttgggttcaacaaggctaagccaacaacatggaggccagggttccacaatcctttctgaccctaccccagaggagctggagcacacttaggtcatctaacggctcttccagg

SEQ ID NO: 34102 - DNA, 601 bp, Human
agcgttgagaggaactcagagttccacttctcaagctatagaccattcaggatttgaacactttgaaaactctaatgtacctccaacttttccaaaacgcttaccataggaaggctagcctgactctccagcagcaagatctctaatagaagagagaagaagctggaagatatttcattgattccaaggcaaggcttgaggtcttcaaggggcctaatgagggaagaaaaatataagaaccaaaaagaccaagaacacatccctagattgattcaggcgcccaagcctcctagcagtcatraaagagttcaagaaaggagcaaacaatatattttcccagcagtatccctgggacttcaggtctacaagtccaacatacttacagctacgacaagccctaggggccagggcacagcctatggcttacccattcaccctgagaattacagaatctctgttgctcacttactcttccttgatagcaggaattgccagcggagagggggcctgtgagagaggtgcgaccccttcagtactgcttagcggctcggccaggtcctctgcctctgatttgatcgtttttattttcttcttcttcttt

SEQ ID NO: 34103 - DNA, 601 bp, Human
gacttcagatgcatgttatgacaacttacacactaagtgggctttataaacttaaaaataacaaccctgttctttagaaacaacttattcggggctgctgcacactctcctcaatagcaaagcccatttttaggaaagaaaaaatttatattacaaattaatccaaagtcatctgtatgattaatataaatgtcgatgctcttgcaaaatacccttgcagatttaaatttagccatcaccagactacatcatacagaaaggctattccttccatctcagctttggtccaaccagaggagtyagttaacccaccttgagagtacaaaaagggtgttgaaggactccttcacagagcaaaataaggtctgatattgctttttaaaaccaatctgcaggactatattgactggaaggcaaataaacttaggggaagaaatgggagaacgaaaacctgttggggtaggtaatacggatcacttaccaagcaacttccactgctgggttttctctttgaattcaacaaatggagagaaactggaaggaacagctgcaagaaatggaccacataaacaaaccatacaggtgcgtccctgagctccga

SEQ ID NO: 34104 - DNA, 601 bp, Human
tgcaaactacatcaattcctattatcataaacccccatcctctctggtacttttccttcacagaaaggatcattttgtcattaaatctaagtaagtatttcttccccaaacagaccttaggccctacgagaggagcacactgtctcagaagccattgtgtcccccagcacctaacagtgcctgacacccagaagctgaataaatgtaataaataacgaatgaatgagtctaccgttttcataacctgctctccatacgcttctccacagaccactcagcacagagaagtgcctgtgaattkcaagaagaaaccaacactggatttctctcttttcaccatcaccaggtaacagcctccaagtgacttcagatgcatgttatgacaacttacacactaagtgggctttataaacttaaaaataacaaccctgttctttagaaacaacttattcggggctgctgcacactctcctcaatagcaaagcccatttttaggaaagaaaaaatttatattacaaattaatccaaagtcatctgtatgattaatataaatgtcgatgctcttgcaaaatacccttgcagatttaaatttagccatcac

SEQ ID NO: 34105 - DNA, 601 bp, Human
tcctgcctctaccatcttgtcctacctatatgccaatgaaaagaataatggaattggggtagaaagtcagaacgtatccccagtctggtcggacagtgcccagaggcctcacacaccaaactcttcttcactccggtcacgatgcaggtagatccacagctttcgtccaatgtcgtatttcacacagggatctttttcgtaatgtagccgatccagtgcaccactcactactgtatttacctacaaatcagacaaagggaaataagaaacaagtcaagcttagataacagaagttatttgractctaggaaaaaaatgtcattgtatctaaatcacagctgatgcagattctatctcagcctagctgcgtattcccaatagttccccaaatcgtttgacgagacaataaatgctgttaagactactgaggtattgatctatttttactataaggatactgtgaagtaagtgaccagtctgccctttatcataagctaaaagaaagcctagagcaaaatttgtgtttcactaacagcaagcgttttgatcactatgcatttttcaaggtatgtttttcacttcattcagtttttaaaaattt

SEQ ID NO: 34106 - DNA, 601 bp, Human
tgagaagccaataaaatgtggccatgggaatttcactaaataaactcatgaacagtctattctaaatccagaaactcgactactgaatgctgaattaaacggaatgaaacagaagaaatctcttcagcatctatcaaagctgcactgcctttgcctttggtgggaactcacacctaagtatctataagctgagagtcgaagatgacaaatcttcttcccatgggcatgcagtctggccaagaacctccagctccagtggtccctgctccaggatgaaggattgagatccacgtggaaagarccccacctacctgcttgatgatgttctgtcctgtgacattttgaatgacggcagccgtggaggcactgggagcagaggtcccaggagaactcgtggctggcttactcacagggctggctgtggcagggagacttgtcaccgtgagccctgtctgcccgggtccaggccgctgcacagtggctgccgtagtctgcgctttgacgggcacagtggccattactgtctagttgagggcatgaggccgagagcttaattagactctaagatgcagaccagcactctaagcaagagtctccctca

SEQ ID NO: 34107 - DNA, 601 bp, Human
tgatccgtgtaggcaacttcccctagaaaaaaaaagcagtcaggttttgtaagacaggaggtaaggaaaaccagcaagtgtcacctccagggcatcaggaactgagaagcaagcactacagatgctgtcagtccccagtacccaccagggtctcaaggctcctgaggtttgggcccagaaaaccctaacgaactacttatataccatagtcaggtgaaatctgatcttttatcatcctctttcatgccaccagaagcagcagcaacccatctatctgctttcaacaggataaaacctgtayctaaatcacaaaggcaggtgtgtcctcactttagcacagtccaagattctgagttccttggaggacagaggcttatctctgtatccctcagtacatggcacagtgctgggcacacaatcactatttggtgaaataaatttgaggaaggacagaggagctcaagagttaatacctaaagcgcacaactactcattggagtgcagggccactggtgaggaacaaacagcagggcatgctagattagggagaggccatgctctccggtgctttccatttctcccggagataagagaggttagc

SEQ ID NO: 34108 - DNA, 601 bp, Human
attaaggccacaggtggccctcattccctgaactgcttaggttcagagctcaaatgtcaaagggaggcttccctcacacctagctgagccccatcctagcacttcccacacccttttctctccagtatgtatcaccacgcatgttgcttttttattatttctctactttacaatgtatgcttggagaacagcagggattttcatctgttttaatcactgcacctaaaacaatactggatgctcaataaatactgttgatgagcacaataaagcagaggtgtcaaagaagggccccagaaakaccagccactttgccactcggtgacaaggactggtaagccctgcctgccacctccacccccgaattggttcctttaccatgacatagtacttacttggctccaaggttgcctttgatgatgggggctgtgaccacgctcttgcccttcattggctggctgatcacagagaggggaactgtgatccgtgtaggcaacttcccctagaaaaaaaaagcagtcaggttttgtaagacaggaggtaaggaaaaccagcaagtgtcacctccagggcatcaggaactgagaagcaagcactacag

SEQ ID NO: 34109 - DNA, 601 bp, Human
ccagagaggtgtgcacttctgcaagaaacgctccccctaatagccacatctcacaagctgccctgagactgcagactcatttcatcgtgccctttatccctgtttaaattaaggccacaggtggccctcattccctgaactgcttaggttcagagctcaaatgtcaaagggaggcttccctcacacctagctgagccccatcctagcacttcccacacccttttctctccagtatgtatcaccacgcatgttgcttttttattatttctctactttacaatgtatgcttggagaacagcagggattttcatctgttttaatcactgcacctaaaacaatactggatgctcaataaatactgttgatgagcacaataaagcagaggtgtcaaagaagggccccagaaagaccagccactttgccactcggtgacaaggactggtaagccctgcctgccacctccacccccgaattggttcctttaccatgacatagtacttacttggctccaaggttgcctttgatgatgggggctgtgaccacgctcttgcccttcattggctggctgatcacagagaggggaactgtgatccgtgtaggc

SEQ ID NO: 34110 - DNA, 601 bp, Human
gattgaactttcttgaagtgacccaaatgtcagtattatctctcacttttgttattatagaaactgttgtggttgtcaactgggttgtcttcctaaaatatgagtctggtatatattgactgaagttgctaatggctacatttttactaattcatatgggggaacgaataaagcacccaggccaaaaacaaaaaacaaaacacacaaaaaaggaaggtatctttctttttaaaaaattaaattatatgtccttatgcctaacaccaaacttaagaaatagaaccttttttttttttatccrtccctgtagccccctgtgtgcccctcccttgtcacttcctctttgagaggtatctttacgggaatatgaaatattggccaggaaactggaggatttgtgactataggtagtgttttcattattttttcctgctctaggtagaacttcagggaggggacgatctgggaggtaaatggctgaatttctattggatttgtgtttctggaccatggctcctgataccacaaagaagggccttttctggggttggagtatttcttgagaggcctaggaagaatgtgattgccttgagctaactga

SEQ ID NO: 34111 - DNA, 601 bp, Human
tttctaaaagcttcttacgtagcttttttatgtgtgtgtttttgcttggggatatatcttatgattgaactttcttgaagtgacccaaatgtcagtattatctctcacttttgttattatagaaactgttgtggttgtcaactgggttgtcttcctaaaatatgagtctggtatatattgactgaagttgctaatggctacatttttactaattcatatgggggaacgaataaagcacccaggccaaaaacaaaaaacaaaacacacaaaaaaggaaggtatctttctttttaaaaaattraattatatgtccttatgcctaacaccaaacttaagaaatagaaccttttttttttttatccgtccctgtagccccctgtgtgcccctcccttgtcacttcctctttgagaggtatctttacgggaatatgaaatattggccaggaaactggaggatttgtgactataggtagtgttttcattattttttcctgctctaggtagaacttcagggaggggacgatctgggaggtaaatggctgaatttctattggatttgtgtttctggaccatggctcctgataccacaaagaagggcctt

SEQ ID NO: 34112 - DNA, 601 bp, Human
taatgatttttttttttttttgagacagaatcttgctctgttgcccaggctggagtgcagtggcccaggctggcgtgtggtggcgcaatcttggctcactgcaacctctgcctcccgggtttaagcagttctctgccccagccccccgagtagctgggattataggcatgtgccactatgtccgcataatttttgtatttttagtagagatggggtttcaccatcttggccaggctggttttgaactcctgacctcatggtacacttcccttggccttccaaagtgctgggattacaggcrtgatttaatatggatctggatgagatgtaatggtttaaaatctgtggatatatgagatattttgatggaaaaagcaatacttcctttgtacttacaaaaaaggtagtaattttctaaaagcttcttacgtagcttttttatgtgtgtgtttttgcttggggatatatcttatgattgaactttcttgaagtgacccaaatgtcagtattatctctcacttttgttattatagaaactgttgtggttgtcaactgggttgtcttcctaaaatatgagtctggtatatattgactgaagttg

SEQ ID NO: 34113 - DNA, 601 bp, Human
caaatttaaacgtcatcattttgaatatccatggcactgtaagtgagattccctaacatatatgatttacagacagatatatgggtttgaaactctggagatgaatacagatttaggaatccctagaacagagatcatgactaaagtaatgggagtaaaatattactcagagaaagcacagaatgagaagagaagaagtaggccaagggagaagagatcagaggagaccaaggcagggtgataagatcaaaacaagacagtaatcagatggaagttccattagattatcagttcccagagcacagggacatgccttgtcttttatactcaattatcacagagcctgacacagaagccaatttttcttaattgtgttctactattgacagtttcctgtacccaccaggaaagaaaaaagtataaacaagcatatagattttttttacattatatactaaaggggccaattatacacaatattttatgccttgctttttcatttaatatatcttagaaatctgcacatgctcttatggaaaaaatggctgcatttttttttttttttgcctacaacagaatattctattataaaactatacac

SEQ ID NO: 34114 - DNA, 601 bp, Human
aactcggtcaggaacagtttcctaggtggctctgaccaagaaaagagatgaagagaaagaagcaggtttacaaaggacaaagaaagaagacataggattagaatgggttaacgaagcaaagaataagctttcccaaagtggacaacggagcaaatgaaaatgaggaaggttgaacggtaaattacgatccaacaaaaatcttcatgcttaaacggaaaccaagctccagtgtggatttgatatccacccaatacactctattgcgtgctaagtgcataatgaagatgaggcagagcaatcyggacacagacctagacactctggcctctggcacggaaggggctccaggagtgctggggagagaggcagcagggtagtggagtcataccaagcaacaagaaagacagggtagtacattctccacgaatttcaattttcctcccttcccccacacaccaaaaaagcatttgagggatgggaggaagaaactgagatcacagggaaaatagtaagagacattcagaaggacaggtcttagaaaattactagtttgcggggggcgggggtcagagaacagtagtatataaaagaacgctaagac

SEQ ID NO: 34115 - DNA, 601 bp, Human
ataacccagacacacacaggcagtgttgttacagatggattacaaaattatatattccagtcatattcatttaaaaatacagaagcaaatatctagtagacagagcctggcaatctagatgaccttggatatcctatctaattccctgagtatgagtctacccatctgtaaaacaaagaaatgaaaactttcccagaatggtaaagattaaatgaaacctgtaacacttgatatttagtaggctcttaagtgtctgtataaaaaataacaataattcactaggaaaactgcaaagaataactgtaaatttccatgtttaagtccagattgttttctaagcatatttgctttcaacaagtaagcaaggtaaatcatgtgcacaagtatggtgttcattgtttaaaatgtttttcaatgtataacgtgactcaaatgggatctaataaggcaactcacttaactcggtcaggaacagtttcctaggtggctctgaccaagaaaagagatgaagagaaagaagcaggtttacaaaggacaaagaaagaagacataggattagaatgggttaacgaagcaaagaataagctttcccaaagtggac

SEQ ID NO: 34116 - DNA, 601 bp, Human
ctggtttcagtttttcagtgcagggacatctctaaagatgaaaacacatcaatatcttatcataagactaaatacaaacggaactattttttggtcacgtgaaattaaagattttaaacattgcactatactttgaaggggggaaaaaatcaagtttcctagctcatttcatatctacaaaatatgagaagtttttcctatctctaaaatatgaagcatacctatttcacacggtggctatgaagactaaatgtgaagatatgtgaagtataaagtacttggcatagtatccatcatgcaraagtgttcagtaacttatagttgttttgactataactcaaactggaatcgatcacaagacataaagtacagtcatcattaattcaaatgacaaactttgttttttaagtaatcaagatatgggggcttgactaaatttctttgctctactaaaaattataaattagattaatatataaattagactgaaggagggagagtaatctacctgttttcaacatttggcatctacttacctaacaattcattccctgttttggggaacctgtgcccaagacaaagtaactgctactcagatttc

SEQ ID NO: 34117 - DNA, 601 bp, Human
taattacagccatcaactgagaagattctttaatgagttgaaaaactgcttaccgtttagtctgactgaaaaaaagattatgcaaaatcatatgtacttaagacttttcttccatgaacacacatttctacaaagatggaatccttctacgtatgttgttttataatctctcttcaactttcagggacatctttccaagttagtatacataaacctattcacaatctttttaatgactctgtggtagtttattttatggatatgctttaacaaattccacccagtatctgtttttttttttctatataaacaatgctgaaacaaatgattatttaacatttaaaaataaaaccagtattcaaatgtttgtactttattaggtttctacagataaacttttagacttcttacacaaaaaaccgtaaggacacccacaattctaacaactcagaaacaagtttggcttatcctgcacactacaaagcaaggattttttccttgtttttattctttaagcaaattctaattaattttgatttgctcacgctaagaattcctgaatcggtcataatgctagaattgaatcggtcataaccctttt

SEQ ID NO: 34118 - DNA, 601 bp, Human
gagtgggtgagcattaaaaagccacttacttctgcagtttaacatgccagtcatataaactgtcatttatgagttccactgaataaatccctgttaagatatagagcatgttagctactcttcatttcatcatataactattactatggtataaatgtatacactaaatagccaacgaaagctagaaattttgctcttaaaacatggaacaactaagctatatagtaaatattacactactgcagctgagtatcttatgcccttaacagataattacagccatcaactgagaagattcttyaatgagttgaaaaactgcttaccgtttagtctgactgaaaaaaagattatgcaaaatcatatgtacttaagacttttcttccatgaacacacatttctacaaagatggaatccttctacgtatgttgttttataatctctcttcaactttcagggacatctttccaagttagtatacataaacctattcacaatctttttaatgactctgtggtagtttattttatggatatgctttaacaaattccacccagtatctgtttttttttttctatataaacaatgctgaaacaaatgatta

SEQ ID NO: 34119 - DNA, 601 bp, Human
gtacaaaataggttttggagtccagtctcttttacaactgtgttcaagatccacccatcttgtcccacatagctgtaaaccactttataaacaccacaattctccattttattggaatgaacacttgggttttctatttggtgctattataaacgatgctgctctgaacattcctgtgtctcctggtacgcctaagtactcacgtcttaacggagaatatgtctacgagattcctgaaccatagggtatgagtatcttctactttaccaaattgttttccaaagcacttgtacaaatataygcaccccactggaagtatatggggtcctgtaactattttcttaccttaaaagagaagttaagcaaaatatattctatgccttctttttcttttaagatctgaagatcactgtgcaaaggactatcagggtcaaccctaagaattacaaaacaaaaaacagttcaaataaaaagttagagatttttttttttaactaaactcaaaaatgaactagtatgacagctaaaatagagcacctagggcaagttccagaaagagaaggtctaaagctgctctgtatcaccaggaaaaatagaggtc

SEQ ID NO: 34120 - DNA, 601 bp, Human
agactaggtaacttagataaatcttctgactgagaactagaaaggtgaacaaaacataataatttcaaggctaagaaaagggaacaccagagagcaggatctttttttcccccttaggttttcttccaattacagaagagaaaaagaagaggttcacaagctgagctagaactcacagactcacagagctcacagggagataaatactggagctcagcgtccaccgaggacaggccctgctaagtctcccgctccttaggttgggaccctgaagaacaaactgcaaattgccctgacaggkaatgacagccagctttaatcatctcattttttaagcaaattctaattaattttgatttgcattttctaacttgcaatagaaatgtaagattatccacaagataccaacttaatgacacaagataccaacttaacaacagttattataatctactttcaaataaagtagctcacctttcatctatatttaacagacataatgaaaggtatagaggttgatgtaagcttggtaaagtacaatttcatttaacctcctattatttagatctttaaacatgtgaatccctaatgagtgactaca

SEQ ID NO: 34121 - DNA, 601 bp, Human
acagcattatggtaaactgatgaaacacatgaaggggttccacttcactagaactatataaaggaaccattccaataatgatagactaggtaacttagataaatcttctgactgagaactagaaaggtgaacaaaacataataatttcaaggctaagaaaagggaacaccagagagcaggatctttttttcccccttaggttttcttccaattacagaagagaaaaagaagaggttcacaagctgagctagaactcacagactcacagagctcacagggagataaatactggagctcagcrtccaccgaggacaggccctgctaagtctcccgctccttaggttgggaccctgaagaacaaactgcaaattgccctgacagggaatgacagccagctttaatcatctcattttttaagcaaattctaattaattttgatttgcattttctaacttgcaatagaaatgtaagattatccacaagataccaacttaatgacacaagataccaacttaacaacagttattataatctactttcaaataaagtagctcacctttcatctatatttaacagacataatgaaaggtatagaggttga

SEQ ID NO: 34122 - DNA, 601 bp, Human
ccagttccataggtccatgagattttcccatgattatccctaaaagtaccaattaggatcacaggcacgtggggaccattctctaatcgtaacattctctaaaccctcaatcacaatttacatttgaaaacattagcttttttatggtaaaaagtatgtgcgtatatatacgtgtgtgtgtgtatatgtataaatacatgtgtgtatgaatcattaaaaactttacctatcaacaacataatgctttacaactaatggttctaggtgtgggccccagaacaacagcatcaacttcacctggaaacttcttaaaaatgtaaatactcaggccccaccacagacctactgaatcagaaaccctgggactagctctccaaatgtttctggtgcacactatatttagaagaaaaaaaaaaaatgcaggccaggcacagtggcctcatgcctgtaatcccagcactttgggaggccaaggtgggaggatcacttgagcccaggaattcaagaccagccagggcaacatagtgagatctcgtctctataaaaaaaaattttttttaactgaaaaaaatttctttttaagtagtcacttaaacttacc

SEQ ID NO: 34123 - DNA, 601 bp, Human
cacaatagttggccaggcagtggctcatgccataatcctagcactttgggaggcccaggtgggtggatcacttcaggccaggagtttgagaccagcctggccaacatggtgaaaccctgtctctactaaaaatacaaaaattagctgggcatggtggcgcatgcctatagtcccagctactcaggaggctgaggcaggagaatggcttgaacccgggaggcataggttgcagtgagccaagattgcgccactgcactccagcctgggcaacagagtgagactctgtctcaaaaaaaaaaaactaaaacacaatagttatgtcatttctccccaatcagtaaaggcttcgttaaagatattttaacattaaactatgaaaaacgtaagaactatgacttggtggctagtaaaagaccggtggtgtcagcaagagaaaggttaaaaatttactatttttcagtcttgtgtttattttgtatatgtaaatatttggctgggttacctaacattccacttccaaaactgatcatgaggttttatgacaaaagaagtactttttatagcaattttactgcctgatccaaaaacagtctacggaagc

SEQ ID NO: 34124 - DNA, 601 bp, Human
cattccagttaaccaaaggcatctttgtgtcaactaaccaaattactttgcagacaaggcatctaaaaacttttactgtagaccactaacattaataattgttatagtgacaatatttaataataaaataagggaaagaagtccttttcatctcccccatcctggagaatccaagcaagtgtctctccccacttgctttgcccaaaccctgggacctttcaaagtgaaagattaatctaaaagtgaaagaaaatctaaaagaaaaactctccaaaaatttaaattcaggcgaaggttcatrggattaaatttttttttgtgtattctatttctgaaacatagaaatctatcttccactctttaactctcctactgggctaaaagagtattgtatataatgtgcactcactgatttaacagaattagaagatccaggtactcatttagattttggttccacaattgctgaaagcttaataatcggttgatgagttaacatcaaacacaatcttcaaattttggaaatgctgatggtagacaggaacttgtttcgggaaaaggaagtctacagtagacattttacctgttatccagtcacaac

SEQ ID NO: 34125 - DNA, 601 bp, Human
attaccaagaaaatatgcacacaagtaaggatgagaaaataacatgcaaacatgacaacagttgttagggatacaggactatgggtaatttaaaaattctaatgttatcacgctaatgtaatccctctgaaattctagtcaattttttctaatggttcttagaacataatactttcagatttgtatgatatcagtaattaagaacttagccctaaatattccaaagaataggggcagaagaatcagtttccttaaatggcgttcacgtgttctttacatctgaaactttctctaccatgtwacagccatgagtttttcccctgacaatgacactgaccttaccctatccatgctatgaagatctgtatggttttatggttcaaattgtttttacccattctgttgtgagaatcaaatggttctgaccatggagcttctctctgggactcccttaagctctttctaggcctgaagactattctctgaacaaaagataacttctggggatgtaccaaatctcccattagaaaatcattacttagataacgatttttaacctttatctttctcaaacaaaatttcatttctccttcaatgttat

SEQ ID NO: 34126 - DNA, 601 bp, Human
gtcttgaaaaggccaatctaaaccagtcttaacccagctccactccacacataaccctttccctggtttccacacaccatgtatctgtttaccccccggagtcgcccactccccagctcaattcttccctttggattctctgctaatcttatcttctccctgctcctcctggttcagcctactcatttctctccattttaagaaaagggggagaagcagaatgtagttttctcgatctgattgctttcaagggaccttctccccttctcctgccctctgtcccctgtcccagtccataacsccctctgggagctccccttcctctcttgggcagtcctccttccttgccctgcctcccctcaggccagcttgctgaccactcacctggacgtgctgggctcctgtctcctctgggctccctgggtagtagccatggggcccatcaacagggactgggccctgaccctgcagcagctccatggcctcttcaggactcagccccaatgcctccccagcccccagctgctgctgcagggtagccagccagtacagctcctccaggcctggccgggtgccctcggttgcccccaccatgcctggt

SEQ ID NO: 34127 - DNA, 601 bp, Human
cagggcgtggctaggaccagaaggcgctctggtaacgatgcagagaaccgtgcagccgcctcctgggcggagccaccccacccagcccccactacaccacaaggtgctctgaacggctcagaggaagaggtgggaggggtccccggacccggggccgctcgaggttagccggtcacagcgagccttgtagagatcgcgctcccgggccaggcgggccacctcggcccgcagcgcgtccagctgggcggccaggcgggcgcgctcggcctccagcccgcgccgctgctgcagccgcttggakcgacaggcctgcgcgtagccgcggttcttcagcgtgcggcgcctctgcttcagccgcagcgcctcgtcgcgcccgcagccccgcagctgccggtttagctcccgcacagacatcgagaccagcgccgcgtcggaaaaccgctctgccagctgcggagggagaatgcagaaaccgggtcagcgccaggtcgcacccggctctgccctgagggcccgacgctacctggctccgccccgggacagccccgccccggctcccaccttcaccggaaggctcgcccttccacgcagtctgtttcgg

SEQ ID NO: 34128 - DNA, 601 bp, Human
gggcagggaaaaagcatctcggatagaggtcctaatctatctagttgttggatattgaaatcttgaaaattctgtagtgctaaaatggggaggttacaagcttcagaatgaaaatacagcctcattgctaattacagctttaatgtgttacaggttgaaaaccctgaattaaaaactaaactgaggtgggagctgcaaccctcctccacctcccattcactgtgtcaccacacttccaccccccagtgcctggcactggtccctgcagagctcagcgtgctagtcatgtgggctgggtttytgtgttcgtaaggggaggggacccctctccagaaaatgaccagcatctaaattcgggcatgacttgaggacccaaaagctttggggatatttgcgcggtcatacagggcgtggctaggaccagaaggcgctctggtaacgatgcagagaaccgtgcagccgcctcctgggcggagccaccccacccagcccccactacaccacaaggtgctctgaacggctcagaggaagaggtgggaggggtccccggacccggggccgctcgaggttagccggtcacagcgagccttgtagagatcgc

SEQ ID NO: 34129 - DNA, 601 bp, Human
tgcagagacagcttctgaatgctcaattactcattcaccaaatctttgctgagtcccttctaaaagtttggtcttcttctatgtgctggggtataatggtaaatattacaggttgggctgtctgtccattctgctactacgagataccacaaatgagaagaaacagttaaggacagtgatctggagtaagatatttacttcttctctgaattacgaaagattctctttcatggatttactgacttctacatgctactgagttttaaattattataaataccaaagcattttctattaaacrttctcctaaacattttctattaggatactaaaactaaaagcaaaggtaaaaaccatcaagtttagctaggcaatctgagcacaattttggtcatccaatacacaacagcaccgcaatagctctctggtgaattgtcctgatctactttcatcagagacctaactgtacatggtattcctgtcttattttctgttttcttcaactagaaagtaagttctatgacagcagggatcatatctattttgttcactgccgatctgcagtgtctaaaacagtgactggtactaggcactaggtact

SEQ ID NO: 34130 - DNA, 601 bp, Human
gacagcagggatcatatctattttgttcactgccgatctgcagtgtctaaaacagtgactggtactaggcactaggtactatcaaatatgtgtttaattaattcttatctcaactatgtcccttagctgtgtagccatgggcataccatttaccttctttagatcttaaattcctcatttggccaggcgtgatggctcacacctgtaatcccagcactttgggaggccgaggtgggaggatcacttgaggtcaggaccagcctggccaacatggcaaaaccccatctctactaaaaatacaaaaaaaaaaatggttgggcatggtggctcatgcctgtaatctcagcactttgggaggtcaaggcggatggatcacctgagctcatgagttcgagactagcctgattaacatggtgaaaccccatctctactaaaagtacaaaattagtcgggtgtggtggcgcatgcctgttatcccagttactcgggaggcagaggcaggaaaatcacttgaacccagaaagcggaggttgcagtgagctgagatggtgccgctgcactccagcctggatgacagggtaacacaccatctcaaaaaata

SEQ ID NO: 34131 - DNA, 601 bp, Human
caggctggagtgccgtggcacaatcatggctcactgcagcctcaacctcccaggctcaagccgtcctcccacctcagcctcttgagtagttgagaccactacacgcagctacttttaaaaaaatttttgtagagacagggtctcactttgttgcccaagctgatcttgagctcctgggctcaaacgatcctcccaactcagtctcccaaagtgttgggattacaggcatgagccaccatgtctggccaagagctacattttctacagaactatattagtgaaagagacagacattccagargcaaaacaaatgtcctatgatataaaaaggaatttcagatatatatgtccacagggttcccaaatttgctgagggaaaagctgctataattatacatgacattttaatctaaaagctactttagaatttttctgaacagactccttgaagttcagtaaatacatctccctcacttttatcactcaccttggatatacgagttgatacgcaaagcccctctcactttttaaaaggtggaattaattttggaaaactgcagaaattagaatacctataaagttaaaggaatgaaagaaaatt

SEQ ID NO: 34132 - DNA, 601 bp, Human
agccgggcgtggtggcgggcgcctgtagtcccagcttcttgggaggctgaggcaggagaatggcgtgaacctggcaggcggagcttgcagtgagccaagatcacgccactgcactccagcctagggcaacagagccagactccgtctcaaaaaaaaagaaagaaagaaatattgaacggcagtctctctgttgttatccctcatcccactcttatcaggatcacaatcctccccacatggcctctgcatctttctcctcatttaatgcaatacagtatgggatgccccaacacagttggcrtaacatgctatttccaaataagatttttgtttgacacaaaaaaacagctaaggtgggatgtggatgaattattttggcctaagaaagtaggacgcaaggcaaaaaaaagaagcttgaaaaacaatgtttactagcggaatttgctccagagcaagttagagtttgacatttcttttttactactacaaaaatgtttcctgagcacctgctacatctagggaactacagtaagttctacatgtacacatgtagataagggcaaggacgaggtttttaactcctcttcctattaacagcatc

SEQ ID NO: 34133 - DNA, 601 bp, Human
tttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgaygagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttga

SEQ ID NO: 34134 - DNA, 601 bp, Human
tatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaamgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatat

SEQ ID NO: 34135 - DNA, 601 bp, Human
gtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcrtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattg

SEQ ID NO: 34136 - DNA, 601 bp, Human
aggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtwttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctccc

SEQ ID NO: 34137 - DNA, 601 bp, Human
gggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaa

SEQ ID NO: 34138 - DNA, 601 bp, Human
gaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgrgattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaaga

SEQ ID NO: 34139 - DNA, 601 bp, Human
caaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttaractcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaa

SEQ ID NO: 34140 - DNA, 601 bp, Human
aaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattrtcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagataga

SEQ ID NO: 34141 - DNA, 601 bp, Human
gcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagccggtctcgatctactgacctcaggtgatctgcccgcctcggcctcccaaaatgttgggattacaggygtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaa

SEQ ID NO: 34142 - DNA, 601 bp, Human
gtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagccggtctcgatctactgacctcaggtgatctgcccgcctcggcctcccaaaatgttgggattacaggcgtgagccactgygcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggta

SEQ ID NO: 34143 - DNA, 601 bp, Human
tgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcrtatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggt

SEQ ID NO: 34144 - DNA, 601 bp, Human
tcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgatttttttttttttttttttgatgaatagttttttacggaccctcatctgtttttttgtgttttggtatttcttttgcagtagcccccttgattttgattgaaaatgaactatttgaaacacacagtgamcaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcacc

SEQ ID NO: 34145 - DNA, 601 bp, Human
cgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctcccsgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaatgtgagttcctggagcttttc

SEQ ID NO: 34146 - DNA, 601 bp, Human
ccataaggtgtggctttcctgagagttgtcttcattaaactaaagatcacctaagtgcagaatatttatgcatcactgagctcagacttgtactcccatcccctgagtttttagtggaacttctgccagaaggttgttgcctgcatttattgattctgttttgctgtaccaaattctctttgcagtgataccttacatgtcatagtctatctgtgggaccctcacctggattatttcacatgatttttttctgacaattggtaggacagatcttttttatgcacatttcatagataaaatragagtgagagagttctaggacttgctcagattcatagatcgtaagtagcagagttatgactccagggccaacccctctccatgttcttacaataagagcacaggaaataaaatctgtatcatccttagagaatcagactttcttataaggttcgtcctctttctttttttttgaggagaacagttccccaactgatttccatgccagttataaaagaaaccattctcttagaagcagattgcctggacactctattgaaatttgttgatattatggaaaatattaatttcataaagccaa

SEQ ID NO: 34147 - DNA, 601 bp, Human
gatttttttctgacaattggtaggacagatcttttttatgcacatttcatagataaaataagagtgagagagttctaggacttgctcagattcatagatcgtaagtagcagagttatgactccagggccaacccctctccatgttcttacaataagagcacaggaaataaaatctgtatcatccttagagaatcagactttcttataaggttcgtcctctttctttttttttgaggagaacagttccccaactgatttccatgccagttataaaagaaaccattctcttagaagcagattscctggacactctattgaaatttgttgatattatggaaaatattaatttcataaagccaatatcatagcttcatattttataggtggcattaatgatgaagtcactttaaaaataaagtctgtaaattaagacataaaacattctacaaaaatgtgataaaactccagggaactttattaacacatttcaattaaatgctttttggaatcatttttgcagtctgcacaaatctttgcctgcacaaatctgatggctgcataggccttgatagcataaacaagagagaagttggatagaaga

SEQ ID NO: 34148 - DNA, 601 bp, Human
attaaatgctttttggaatcatttttgcagtctgcacaaatctttgcctgcacaaatctgatggctgcataggccttgatagcataaacaagagagaagttggatagaagaaaaaggcaaaatgctctaatgcagtcacttagatgtaattaatgacctcagtggttaagttctggtattttcattacagttgaccttagacccaaattactcaacaactgcattttactggctcttttatcacatcacttctcctaatgttgtgatttggacagtgggctctggctaattatagttttaktaatagacttactgattactttactttgtatattttcattattgcatgctatttctatgaatatgaaagccactttgtatattttttcatgttgatatatgacggtgattttggtggtattcttttttttttttttttttttttgagatggagtctcgctctgtcacccaggctggagtgcagtggctcgatctcggctcactgcaagctccgcctcctgggttcatgccattctcctgcctcagcctctccagtagctgggactacaggcacctgccaccacgccaggctaattttttt

SEQ ID NO: 34149 - DNA, 601 bp, Human
attattattttttttagtcacaaatatatctttttattgtctggttggtctaaatctgaagatggtatgtcactagaatggttcaagatgaaatctgacatattccttgttacctaatttttgtttgttctcatcgtggaggtatgcggttatttagatcatatgtaaacaatctcagtagagttttttttatcaataaaatgtctttcctataaagacgtattgaattcagttaatattcagagttttgtatgccacataatttcaaaatatccatgatgctctttagttttaaggcatmttttttccctactgggtttatagttttaaattttatttaatcttacatatcctcctattaattgttcaaaagatcagggtttctataagatatataacttggctccaaatcaacatatgaaaagtaagcttttgggtgaaaaagacattaaaaatacacaatatatttatgctacccctcccagcaaagaaaaaattatagacaaggttagaggaaaaactcagctatcactctaagtgaaagagagagagatctggatgtaagtaaagcttatataatgatcaaataaaattatatttt

SEQ ID NO: 34150 - DNA, 601 bp, Human
ccccacccatctttgtgagattttcttccagatctgttattgcattcaatatttatttttaagtcccattttcttctgttgtaaaatgatagaaaacgtattgaaaggtgttgatgactaacagccaggatttccaagtgagctccattccttgcattgtccccattaaacaaatatgaactgttgctattcttatggtaaggcacctcaaagcatcctaatgcagaggctttgtggggcagatgtgggcccaggaagaggcctttgaagattaggcaatggcatttgcttaaactctatsttgcctgaattgtggagtctttttatgaagatccatccttattcacaaggaaattgtgcagattggaagatgtcactgctggagagacaacaagttaataggtgtaatgggtgttatatggtgaaagtcttggcaattgagaattatttggaataaagtgaattcagggcgttgaagcactaatgcttctaacacaggaataggcatgacaaactaaaggaagatacatgagatagggtaaagtacttggtgtaaaaattttgggcaacattgtgtaaaattttcttgctggattaaaaa

SEQ ID NO: 34151 - DNA, 601 bp, Human
acaaatatgaactgttgctattcttatggtaaggcacctcaaagcatcctaatgcagaggctttgtggggcagatgtgggcccaggaagaggcctttgaagattaggcaatggcatttgcttaaactctatgttgcctgaattgtggagtctttttatgaagatccatccttattcacaaggaaattgtgcagattggaagatgtcactgctggagagacaacaagttaataggtgtaatgggtgttatatggtgaaagtcttggcaattgagaattatttggaataaagtgaattcaggrcgttgaagcactaatgcttctaacacaggaataggcatgacaaactaaaggaagatacatgagatagggtaaagtacttggtgtaaaaattttgggcaacattgtgtaaaattttcttgctggattaaaaattagagtttcaatttcaaatttatgtctcaatattcttcttgaagcatatttaatcaattaattcaacaaatgttaattgtgtacctattacaaatcaaaatgatatggcacagggccatggggataaagggagaaaagtttctatgttcctggattctgttatccagt

SEQ ID NO: 34152 - DNA, 601 bp, Human
ctggagagacaacaagttaataggtgtaatgggtgttatatggtgaaagtcttggcaattgagaattatttggaataaagtgaattcagggcgttgaagcactaatgcttctaacacaggaataggcatgacaaactaaaggaagatacatgagatagggtaaagtacttggtgtaaaaattttgggcaacattgtgtaaaattttcttgctggattaaaaattagagtttcaatttcaaatttatgtctcaatattcttcttgaagcatatttaatcaattaattcaacaaatgttaatwgtgtacctattacaaatcaaaatgatatggcacagggccatggggataaagggagaaaagtttctatgttcctggattctgttatccagtgggagaagtagaaacctaaagataaaagtgtaatgtgctgtcataatcatcgagcttgcatagtaagctggagaaagaagccagctgtgcaccagtgttgtgttgtcatatgaacattgctgtattcataattgaaacattcctttccttctttatcccttctgctgagttaatgatatcttcttttagaaagactctttagttttgcat

SEQ ID NO: 34153 - DNA, 601 bp, Human
ggtttaaactggtggtgggtcttttctgcattctattccatatctcataacatcaaatcccattttggtgttggagggatacttggaggtgatcaagcagacacaaattaaatgagtctaccatgaccacattttcccctaagaaactcctggaaaagtctccagggatccctgagattcttagaacccaaccagaaaaccacaggagtaaatgatgttgcaaagcccaggtcctgtcttcacggaaatcttaagtattgtggttaatgccaggcagagtctatgtaacgattttaaatgrcctcatttaaaggctcattaccataaatggaattcatcttaaataggccactgagtattataaataagcatttaaagatttttttttccttgtggtttttattttcctcttgactacttcctcttttacccattgcaggccacaggagtccaggcagcatggctgaggtctgaatggcggtggctttccacccacagtggtctaacgcagctcaatctgcagctcagttgccttgccctcagaatagcttgctctgtgtgtgtgtgtgtgtgtgtgtgtgtgtgtgtgtgtgtgtaagga

SEQ ID NO: 34154 - DNA, 601 bp, Human
attttggtgttggagggatacttggaggtgatcaagcagacacaaattaaatgagtctaccatgaccacattttcccctaagaaactcctggaaaagtctccagggatccctgagattcttagaacccaaccagaaaaccacaggagtaaatgatgttgcaaagcccaggtcctgtcttcacggaaatcttaagtattgtggttaatgccaggcagagtctatgtaacgattttaaatggcctcatttaaaggctcattaccataaatggaattcatcttaaataggccactgagtattayaaataagcatttaaagatttttttttccttgtggtttttattttcctcttgactacttcctcttttacccattgcaggccacaggagtccaggcagcatggctgaggtctgaatggcggtggctttccacccacagtggtctaacgcagctcaatctgcagctcagttgccttgccctcagaatagcttgctctgtgtgtgtgtgtgtgtgtgtgtgtgtgtgtgtgtgtgtgtaaggaggtctacagcttcctttcaggttctctctctcacctttactccagctatcttgaatcaatg

SEQ ID NO: 34155 - DNA, 601 bp, Human
cgtgtagacccatggccatagctggtatcaatatgctggttaacactcactcatagcacacattcagtgtgtgattgctggagtgaatgattgaaatcatcagctgtaatcctttatcattgttagtacaatcactatgcccagtgggtactaaactcataatttctcatcattttgacccactcagaagcctgaagtcaatgttatctccaaacatatgcaagcactttcaactgtatgtccttaaatcagcacctaacccaaaattcatttgagcatggtggaaggaatgatgggcccygggtgtggggacctgggctggtgggaggaaggtaagtgtggcccctgccccactgtggtccttgtagtggttggttcatagcacaggtctacaagtgtgtgtatctacacatgcatggaccttattttgtgtaatatatatatgtacattatatatattatatatatattatgtatatatatatgcatatgtataatatatatagggtctccccaaattatattttaattgaatttttatagatgaagtcacatattaaaaacttttgttttccaaagactattttaaggaggcctgtga

SEQ ID NO: 34156 - DNA, 601 bp, Human
gtgggtactaaactcataatttctcatcattttgacccactcagaagcctgaagtcaatgttatctccaaacatatgcaagcactttcaactgtatgtccttaaatcagcacctaacccaaaattcatttgagcatggtggaaggaatgatgggccctgggtgtggggacctgggctggtgggaggaaggtaagtgtggcccctgccccactgtggtccttgtagtggttggttcatagcacaggtctacaagtgtgtgtatctacacatgcatggaccttattttgtgtaatatatatatgtacattatatatattatatatatattatgtatatatatatgcatatgtataatatatatagggtctccccaaattatattttaattgaatttttatagatgaagtcacatattaaaaacttttgttttccaaagactattttaaggaggcctgtgagagatatttggtaaagcaaacaattaaactttgcccatttaaatttagtaatatcacatttctcagagtgagggacatagtcacaacatacatgtgcagagttcagctgcacaggtgctcagttgagaggaatgtcactggta

SEQ ID NO: 34157 - DNA, 601 bp, Human
ctccaaacatatgcaagcactttcaactgtatgtccttaaatcagcacctaacccaaaattcatttgagcatggtggaaggaatgatgggccctgggtgtggggacctgggctggtgggaggaaggtaagtgtggcccctgccccactgtggtccttgtagtggttggttcatagcacaggtctacaagtgtgtgtatctacacatgcatggaccttattttgtgtaatatatatatgtacattatatatattatatatatattatgtatatatatatgcatatgtataatatatataggktctccccaaattatattttaattgaatttttatagatgaagtcacatattaaaaacttttgttttccaaagactattttaaggaggcctgtgagagatatttggtaaagcaaacaattaaactttgcccatttaaatttagtaatatcacatttctcagagtgagggacatagtcacaacatacatgtgcagagttcagctgcacaggtgctcagttgagaggaatgtcactggtaactggaaatctttccgtaaattatgaaagtgaattgggtccttttatcggctttgcttcttcct

SEQ ID NO: 34158 - DNA, 601 bp, Human
tatatatatgtacattatatatattatatatatattatgtatatatatatgcatatgtataatatatatagggtctccccaaattatattttaattgaatttttatagatgaagtcacatattaaaaacttttgttttccaaagactattttaaggaggcctgtgagagatatttggtaaagcaaacaattaaactttgcccatttaaatttagtaatatcacatttctcagagtgagggacatagtcacaacatacatgtgcagagttcagctgcacaggtgctcagttgagaggaatgycactggtaactggaaatctttccgtaaattatgaaagtgaattgggtccttttatcggctttgcttcttcctaggtagtactgtgggaggatttacctgaatacaagtaagggggtaatatcagattacctgctttctattaaaaatatccaaacttgagtttttttctcagtttcaggttaatatctgtatggtcactaggctctgaaaaattgaccttatctgtcatagtttagacaaagagcagaagcaataaattataaataatattaacaactggctgggtgtggtggctcacgc

SEQ ID NO: 34159 - DNA, 601 bp, Human
aattatgaaagtgaattgggtccttttatcggctttgcttcttcctaggtagtactgtgggaggatttacctgaatacaagtaagggggtaatatcagattacctgctttctattaaaaatatccaaacttgagtttttttctcagtttcaggttaatatctgtatggtcactaggctctgaaaaattgaccttatctgtcatagtttagacaaagagcagaagcaataaattataaataatattaacaactggctgggtgtggtggctcacgcctgtaatcccagcactttgggaggccraggcgggtggatcacttgagatcaggagttcaagaccagtctgggcaacatgatgaaaccccgtctctactagaaatactaatattagccggtcacgatggcaggcgcctgtaatccaagctactcggaaggctgaggcatgagaatcgcttgaacctgggaggcagaggttgcagtaagctgtgatcgtgccactgcactccagcctgggtggcagagtgagaatctgtctaaaaaaacaaaaaacaaactaaaaatattaacaaccaagataaccagtgcagagaccccactcagagg

SEQ ID NO: 34160 - DNA, 601 bp, Human
gcaggcgcctgtaatccaagctactcggaaggctgaggcatgagaatcgcttgaacctgggaggcagaggttgcagtaagctgtgatcgtgccactgcactccagcctgggtggcagagtgagaatctgtctaaaaaaacaaaaaacaaactaaaaatattaacaaccaagataaccagtgcagagaccccactcagagggtttgtctgttccctggctacaataccttagatttttttctcctcttgtttgatgaacacatacagtcaagaagcagtgcctgagagggaagggccactgkattaaacatcaggattcaagattcttgttccagatctgccttgctcagtaaccttgatgagctcacttaacctcattgcactttggtttcttcatctgaaaaaaatgatgctattagatctcaaaggtcttttccagtccttgattttgtaattaccaaagccagactacattaaaatgaacagatgaagcattttaaataccctcacttaggataagtactctgtttaaaaattctacttgataatgtttgtttccccaaagcataaagtgctttatatctaaagttgaaataatccct

SEQ ID NO: 34161 - DNA, 601 bp, Human
ttaaaatgaacagatgaagcattttaaataccctcacttaggataagtactctgtttaaaaattctacttgataatgtttgtttccccaaagcataaagtgctttatatctaaagttgaaataatccctactctgtccaggcttagattggaccccaaacatttaaaagatctaaacattggcatctaggatcctagcaaaaatggacaacactatcatgaaatgtgatactttcaaagagtatttactattgacaatcagtaataaatgttgatttgttatatttataataattcatcakcagcagcaacatttattgcattgatcagtttgatctgttttcgaagttatgtgagatcagggcttcaggcaaaattttaaaagtcatttttgttatttaggaaagaagtgctatcaaaaagtattcattattttattattttgagtttttttggtgatgaatctgtataatatcaagatacagatattagaaaccaaagtcaacttcaaatgaactctttccgctgtcagaaatctcttggatctgtttggagctggttttcacttatactgaatagatttgagaaatgactgtaatgca

SEQ ID NO: 34162 - DNA, 601 bp, Human
caagaaaagggaggtatatcagtttctggctatgacagtaaagccaattcaaaatgatgtttcttgtgtaatgaaggtgtttggctcacagatgggaacctcaaaggtagggcttgatttagggttggttaaagcagcagctccactatgtcatctgggacccaagttcccttcaccctactctctttttcccaccacgccagcttcactgaaggctggtccccttgtggttacaagagaatgtggcgggggagctgctgccattcacaaggatgggagaaagggaagcgctcctgaaggygtcctcaaggaaagagaacttcccaagagacaagagccaagccctctttgtatccaagtcaagacccaattgggtcatagtccattcttgcccttattactgctaagagggatggattatcccttcagtaactaaattcacccccagactttaagtcagcttccccgaaggtggataggcttaaccccttgaaaaaaaaaatgggattctctcaggaacgtggaaagaaagaaaccaaagtccattatattagttttttttttttttttttttcccgagacggagtctcactttgttgcc

SEQ ID NO: 34163 - DNA, 601 bp, Human
gtctttacctgcttgtgcatgttaagccatatttcttccaagctgtggtttggttgattttttgcatatgatttgtgtgttgttgtgtttgtatttgtcttgatatggtttaaaggaagaatctctcaaattgtttcacagagaaatacgtttgaattgtggttttacatcttaaaattacatttttgaccctttcccagttaattcaagactttaaaaatgtcatcttcctgttagcctcagatcctactttggatcttttggccaaaatgtcatgatactaaactatagacacttgaaygatttaaattttgcagacgtagttggctataacatgaagagggaaaactaaacaaataaatgatatccattagtgtttaaaattaataagttttaagatattcaaaaggaaaatgatgagaatgtggttttggcattaagaatgaaacagcaaacacatagaaaatagatttttttctgttattttttattcacaaaggaacacattgctaataaaaatacaatttaaattggttgccctgaggccagcatgatgattctacctggagaagtttagctggggctgcattaacaaggtagc

SEQ ID NO: 34164 - DNA, 601 bp, Human
gatcctactttggatcttttggccaaaatgtcatgatactaaactatagacacttgaatgatttaaattttgcagacgtagttggctataacatgaagagggaaaactaaacaaataaatgatatccattagtgtttaaaattaataagttttaagatattcaaaaggaaaatgatgagaatgtggttttggcattaagaatgaaacagcaaacacatagaaaatagatttttttctgttattttttattcacaaaggaacacattgctaataaaaatacaatttaaattggttgccctgaggccagcatgatgattctacctggagaagtttagctggggctgcattaacaaggtagcctcttcaggatggaaattgaaggcagtgtacctatttagaattaaaatacaaacattataaacctcattgtttgcaataagtttaccaagagttttctgagaccttttatatgcaatattgctaataaaaactttgacaacccctgaaaaaaaatcagtcattatttctatcctgacccatgtagactaaaattgatccagaaggcagcaactgcatttgcgacttggtgaaatgagaacag

SEQ ID NO: 34165 - DNA, 601 bp, Human
catgtagactaaaattgatccagaaggcagcaactgcatttgcgacttggtgaaatgagaacagagcgttaacaattctaagtattgtgtggatctaccttttaatcattctgaaactgaaatattggcaattcagaactcttcaaaaaagtttacgtgtggacccaagtttcatactgatgcttgttccacatatcctcttacgtctctgccctttgtgcaaataagttgcacctgtcctggaaatcagtgttgctcatttcaaatctggcgtcacgtgtgagcgctaccatcttcttgycttcacctggtcatgtaactttcctccactgatattcttcagctgtaaaactggtagttatgctctgtctctgaagacctttccgggtctataaatctatgacacgtagatgatcgattccctgtcgtacttgttttaaatatgccatccataaaggggtatatgcttatgtgcaaagaaaaatccctgaaccaggtttggggctgaccaacaagacaatgatgtaaaggtctgggttgaataaaatgtgggcgttgtgcagtctcagcgctgcagtgcattgaactcagcagcctggtc

SEQ ID NO: 34166 - DNA, 601 bp, Human
gtatataggctgcagagacggagttagatctgtattggctgggcatggtggctcatgcctgtaatcccaggacttaggctgaggcaggcggatcacctgaggttgggagttcgagaccagcttgaccaacatggagaaaccccgtctctactaaaaatacaaaattagccaggtgtggtggcacatgcctataatcccagctactagggaggctgaggcaggagaatcacttgaacctaggaggcggaggttgtggtgagccaagatcgcaccattgcactccagcctaggcaacaggagygaaactccgtctcaaaaaaaaaaaagtctatactcaaacatttgcagaagcgtttttggggagatatactcacagttaaagtaccagagaagagaatgatcattacttttgctccacactggccaagagctttgtatgtcttctttttgtgctctgtgatttatttaatgctcttctcatctgacatgaaagatggtgtcctgggagaattagccatatgtttttattttcctgccttcattctcaaccacatgctttgcagagacagtgtagtggataaatcacaggatttatacttgg

SEQ ID NO: 34167 - DNA, 601 bp, Human
cacatcttggggacttaaaacaacaaagttttctttcttgcttcatttcgtgtattggctaggagctctgttcagccttgtccttgttccaggactgtggatgacaaagcatccacatttttaaaggttagcctttttctttatgacagagataaagagcactgtggagcaggtggagcagggttcctcaaccttggcactattggcgtttggggataaataatcctttgtttggggggctgtcttgggcacagtaggatgttaataatgcctggcctctacccactaggtgctagtagtrctttccccctcgttgtgacaaccccaaattgtcaagtgtcccctggatggcaatattattgtccctggttgagaaacactgccttagactaagatcttggacaagaagtgaagttctacaccctggcagtgacacaagtctgaactagtcacatgaaccacttaaccacaagcaagccaggaaatgtatcctacaaagagaaacacagagaaaaccagaaatattagacaaacagcattaatgattactatggatagggataataatatccatcttaaaaattgttgtgcagattcttaa

SEQ ID NO: 34168 - DNA, 601 bp, Human
ggcagagctggatccttagttgcgacagagactgcaaggctggcaaagcctgaagtatttaccatctgacctttacagcaaaagtttgccaactcctggtttagagaagccaactgtttttggaagcaggactttgggctgagtaagactggaaggagacacatagtgccgctgacaactttgctctaaaatgttaagatgcacttagaggagcatcatgccttggtcagcagcaatggtagcagagtgatcgcatttctatgtgtacctctgtcatctctacctctgggatgggagaggwttcacatatatctacatctaccctcttgacttgtgtaatccacacctggcaattacatttttaaacttacttaaacatttttaggcttatatcatatatatgggaaaatgcacatatcataaatttacaacccaatgggctttgacaagtggaactcaccccagaagtgccctcctgctcccttccagtgccactcactgttcccagggtaccctgacttctaagagcaacaatagctaaccttaaaaatagccttttattatggacaattttcaaacatgcacttcagtagagagaata

SEQ ID NO: 34169 - DNA, 601 bp, Human
tggtcagcagcaatggtagcagagtgatcgcatttctatgtgtacctctgtcatctctacctctgggatgggagaggattcacatatatctacatctaccctcttgacttgtgtaatccacacctggcaattacatttttaaacttacttaaacatttttaggcttatatcatatatatgggaaaatgcacatatcataaatttacaacccaatgggctttgacaagtggaactcaccccagaagtgccctcctgctcccttccagtgccactcactgttcccagggtaccctgacttctmagagcaacaatagctaaccttaaaaatagccttttattatggacaattttcaaacatgcacttcagtagagagaatagtaaaatgaaccccattgtattcttcaccagcttcaagaattatcgggctggatgcggtggctcatgcctatattcccagaactttgggaggtgtaggtggaagaattccttgagcccgggatttcaacaccagcctgggcaatatggcaaaaccctgtctctgcaaaaaaacttaaaaatgagccaggtatagtggtgtttacctgtagtcctagctactca

SEQ ID NO: 34170 - DNA, 601 bp, Human
aggaggtaaaaacattgattgaagactccagattatgcggagaccctgaggtcatgaaaagatggacagcttcaactgagaagttttgtgggatgtggggtcttcagaaaaaggcaaggcaaggaagagaaaatgttgactataaagggagtcactgggctattgattagggttagtgtcatttgaatttctagcattggcctgattggttgggatttatttatttatttatttatttatttatttatttgagacagagtctcgctctgtcacccaggctggagtgcagttatgtggtctkggctcactgcaacctccgcctcccaggttcaagtgattctcccacctcaacctcccacgtagctgggataacaggcatgtgccaccatgtctggtaattttcatatttttgtaaagacagggttttgccatgttggccaggctggtctcgaactcctgacctcgagtgatctgcctcccttagcctcccaaagtgctgggaaaacaggcatgagccaccacacctggccctgattgggttttagttcagctgtgccttctcaagaactcccctccctcagatgatgggtacagggaactg

SEQ ID NO: 34171 - DNA, 601 bp, Human
ttgggggatactctggcatagcctggctaggtgggaaggggtggggacccactgggctgccatgtccatcccactaggagagtccatctttccccatatgttttgtttttggttttgtcttccttcacctacctgctgcttctcagggtcagggggccctggtaagtgcctgaacccagcacagtgccagagcccctaaaatgtcaacctgtctgtacactggagggaagggggacattcaggcccacggggtcctgggaattccagactctttgggaaacagagcagcctgggtgctctyaggactgcagaagtacaactgtgtgagcacctttgtctcctcttcatgctaagtcaggcagcatcttttagcaccagcagctacagggtgggggtgaggagcttagcaagagggacggggaggggcaggggcaaagggcccctggagtgaaaatgctgaggcccccagcttcattctccatgtccttccccagggcacacggccctgatgccgtgctgatggctgagggcaacccgcccacggaactgacgcagtcgcagatgctgcatatagcccagcagatcgccgcgggcatggtct

SEQ ID NO: 34172 - DNA, 601 bp, Human
ttctcagggtcagggggccctggtaagtgcctgaacccagcacagtgccagagcccctaaaatgtcaacctgtctgtacactggagggaagggggacattcaggcccacggggtcctgggaattccagactctttgggaaacagagcagcctgggtgctctcaggactgcagaagtacaactgtgtgagcacctttgtctcctcttcatgctaagtcaggcagcatcttttagcaccagcagctacagggtgggggtgaggagcttagcaagagggacggggaggggcaggggcaaagggyccctggagtgaaaatgctgaggcccccagcttcattctccatgtccttccccagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtgagtagctg

SEQ ID NO: 34173 - DNA, 601 bp, Human
gcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttctttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttt

SEQ ID NO: 34174 - DNA, 601 bp, Human
ccccggatgatctccatggagccagtcaggagatcatagaattgctggatatgctgggtgtcatctccactcatttgatagtcagggttcgcctggaactggaatttcattttaaaaagcacttaatgaggttctctaaaatatataacccgtgaaattgctaaccccgtttctaataggggagccaggtttttataacaattaaacctctctctgaccagtaaggaaattagatgttccggggcaattaattcaattagggatggtgctacgaggtcgctgctttaaatatgtaaattgycatttccatacagactaaatacagtgccatccagccctgggaaacgttcactcttatctccacaaaacaattgacatgttagtattcatgctagtcccagagtgggcctcgagctgagacgcccttttgcaaatcttaataaaattgcagtccctaccaggtttgctcaacatacttcctccaattaaagcccgcatatttttcacagctggagtaaaaaggatctgaccacttgatcccccaccccactggcattctttacaccctctccttcccttccctgacccccagacaggcccc

SEQ ID NO: 34175 - DNA, 601 bp, Human
agcaataaatgagggatttaagagtcacctaattactgaagagttaataaaatgtagaccagtggaccttgaaagggtttaatttcataacaatcaagaacgccccctatcccacctccattccattcatccaaggcttctgggctcgcttcttctcgtctttttttgttttctttctttttcttcctttctccgacttccatttcctattctgtctttttctctaccccaccctctggtttcccttcctccctttcttttcctttcttgatttctctcacagcctccctggattgtctcctccctcccttattacctgtatgctaatcgaaggacaaacagttctaagaaagctgattcaaaaagcaggtcttggtcggctttgggcaggtctgcgaagccagggatcttctctgcccagccccggatgatctccatggagccagtcaggagatcatagaattgctggatatgctgggtgtcatctccactcatttgatagtcagggttcgcctggaactggaatttcattttaaaaagcacttaatgaggttctctaaaatatataacccgtgaaattgctaaccccgtttctaatagg

SEQ ID NO: 34176 - DNA, 601 bp, Human
tcttttagaatttgtaatatttattcataaataggcacaaaataatttaaaaagccaaactgcattgggtaaatttacaagcctttgccttcttcaactcatgccacccacgcaacatttagttttactatatattacagctttctttacagcagaaaactttgaagtcttgttaaagggcaatacttgtgggtccccttaagatgtgtctctgtgtgtgtgtgtgtgtgtgtatgtgtgtgtgtgttacatttgtctgaactgcaacaaccaagcatggccaaacatttcccattatacmttatagcaatctttcttctgaacaacaaactgatttttaaactgagaataaaaagtttataccactgtattgtgtgtagtccatgttctaaatccaggatgccccggagccaaaatgccctttcaggttctgcctgcaggttaggaaatagcaacagtttttgtttgtttgtttgttttctttagggatcaagggggctaggagggttacagaaatggggggcagcttgagctgagactgctcacacggctatctctgcccatgtgacttgccccctcttgacagtttccattatcattc

SEQ ID NO: 34177 - DNA, 601 bp, Human
gatttcccaggcaaagagggctggacactcacccttcagctgggcaattcgagccaccacagggggtgtagccagccgtggcttgcttcccccaatgccctttggctccaagacacctgtgcggtagtaacgccctaggatcttgctcacacagccattagatacctgagtcaggtgagaagcagggacaggtgaggcatgatgggcagaaggaaggagagtgtccctgggacaggaggaggctataagacaaagccaagacttactggaccaggccatgaagtcgggagtccagcctcasctttgagggcctgaggctccccttttcaacctccgagaggatctcccaggaagtgacccaagtcccagaagccctcagagcctgcaacagccccaggctcttgccttcagaggagccctttctccctgcttcctgtccccatcactgggtaaaggtgctggcccattaccttaaggatccgtgagatgtcacagggccgcattccactgactgctagccgcacaatctgctgccgggtatccagaggcaggggccggccattcacaaagagccccccaagctggttcatgctgctgatcc

SEQ ID NO: 34178 - DNA, 601 bp, Human
agggacaagcagtaggcttggtccaggggtgtgttatcccaaagaacatgaatgatgctctaagaagctatgcatggggcagagggagggtatgagatgcagtcctgcctcttcttcaatagatcctgtgaacccaggggctaggggacctgtgttctgttccagggcctgccatcaactaggtggtgaccttgggtaagtcacttcacttttctggacctcaattttcttctgctgggagagaatgagactccctgcccagtcctccttattgggttgttgtgagggtgatccaagaaaraacgagaaagggctttgagaactataaaatgctagagatttggctgtgattagccctggggacaactccaagacccacctggtgacctgagccgtgtgcacggtagtccctggtcctcctgtaatgcccgcaggactcggttgatggaggagacctgggagtgtcagggtgttgagtggagagatggtgctcagactcagggctataccctgaggatgttgcccttaatatcctttttcccatctgtctccacctacacattgttcccaagggcagcctcctctctctctctctatgctt

SEQ ID NO: 34179 - DNA, 601 bp, Human
gggtgactggctggctggatggatggatagatgggtggatggataaatggatggatggagagatggatgcatggatagatgggtggataaatgggtagctgggtggatgggtgggtgtggtgggtggatgatgcatggatgaatggatggatggatagatgaatggatgaatggatggatggatacatgggtggatggataaatggatggatgaatggaggatggatggattgatgcatggatagatgggtggataaatgggtagctgggtggatgggtgggtgtggtgggtggatgatgmatggatgaatggatggatggatagatgaatggatgaatggatggatggatacatgggtggatggataaatggatggacgaatggaggatggatggatggatggatggatggatggatggatggatggatagatgactgagcgggcagatggatgatggtgcagagaaatcacctggcagctgcatttcccacttgagcttctcttgccgacgccatttggctcttctgttggaaaaccagacctgagcgaggacagggacaatgcagctggctgtactttatgctgcctgtcacctgctg

SEQ ID NO: 34180 - DNA, 601 bp, Human
tttgatgacccccaatggagatccatgccctcctggaggttgagtcagtcgaccctccctacatcctgcaggactgaggcctggcctgaattcttaccccagcagggcttgagacaggctttaggtggggtgtcactcagacacctttctggtgctgttgcccagcacagctgatagcaggagggacccagtggttccagggcaggcagggctgctgtgggcacactgccaggggactgctaaaaaaaaaaagcaagagaagaaccttagcttccagtgatgcctcctgtagagaacgccrggaccccagagctgcctgccacccaagtagtatcctgcacaactccagagggcaccattcacatagtagactttgggttagtactttcttgacatgaacactgtggggccctggagagccggagatcctggctcaggccagaaatggaagagcccatgagcccttcagtcttcccagggcacagactcccctctcctcccgagtacctgtgcagagatgattcctggggcaacccttggtacagtcagcccctgggaagcacctataaaatgagagtgaatccactcagaaggaggaatt

SEQ ID NO: 34181 - DNA, 601 bp, Human
gtaattttgtggaccatgcaaagaatgaggaaagctgtattgagattcctttgatgacccccaatggagatccatgccctcctggaggttgagtcagtcgaccctccctacatcctgcaggactgaggcctggcctgaattcttaccccagcagggcttgagacaggctttaggtggggtgtcactcagacacctttctggtgctgttgcccagcacagctgatagcaggagggacccagtggttccagggcaggcagggctgctgtgggcacactgccaggggactgctaaaaaaaaaaagcaagagaagaaccttagcttccagtgatgcctcctgtagagaacgccgggaccccagagctgcctgccacccaagtagtatcctgcacaactccagagggcaccattcacatagtagactttgggttagtactttcttgacatgaacactgtggggccctggagagccggagatcctggctcaggccagaaatggaagagcccatgagcccttcagtcttcccagggcacagactcccctctcctcccgagtacctgtgcagagatgattcctggggcaacccttggtacagtcagccc

SEQ ID NO: 34182 - DNA, 601 bp, Human
gtttcttgttttttggggatgcatgctggaagatttaggaataaaatgccatgatataatatcagtgtgtgtgtgtgtgtgtgtgtgtgtgcgcgcacgcatgcacgcatacatacataatacacatatagatgcatacatagagtaggtaaattgatgcattgacaaatacattgtttagatacatgtattgcctacatacatgcatagattagatggtagatacatagatgtaaataaatgatagggcaaattgtctataattgttgaatattagagtgggcataggggtgctcatagrgaaaacatgatggacaacagaactactgctaataaaaacagcttttattactgctgagtggaggcctcttaaggccagtgtgagaagtgggtgggtgttgctttaccagcccctccaatcaggtgatgcgccagagaggcatcgaggcagggccaggcaacgtccacacaggagggagcaatcacaggaaggaggaaggagccacagtctgtatgggcaggacggtaaggacaatgggcaggatggtattagatcttctctatgccatctccttcccactcctgcctcattccaagccat

SEQ ID NO: 34183 - DNA, 601 bp, Human
agcagaatatgaaaaatggcatttcactctgtttgctgctatgacaaaaatacatatgcaaatacaaaatacatatgcaaatacaaaatacatatgacaaaatacatatgacaaaaatacataattttcttagattaagaagttacagtaaattttcttagatgtggatatattattgtgattatgtaagacaagtttcttgttttttggggatgcatgctggaagatttaggaataaaatgccatgatataatatcagtgtgtgtgtgtgtgtgtgtgtgtgtgcgcgcacgcatgcacrcatacatacataatacacatatagatgcatacatagagtaggtaaattgatgcattgacaaatacattgtttagatacatgtattgcctacatacatgcatagattagatggtagatacatagatgtaaataaatgatagggcaaattgtctataattgttgaatattagagtgggcataggggtgctcatagggaaaacatgatggacaacagaactactgctaataaaaacagcttttattactgctgagtggaggcctcttaaggccagtgtgagaagtgggtgggtgttgctttac

SEQ ID NO: 34184 - DNA, 601 bp, Human
aaacatgcccctggagcatgtataaataaagcacatataaatggaaagcagaatatgaaaaatggcatttcactctgtttgctgctatgacaaaaatacatatgcaaatacaaaatacatatgcaaatacaaaatacatatgacaaaatacatatgacaaaaatacataattttcttagattaagaagttacagtaaattttcttagatgtggatatattattgtgattatgtaagacaagtttcttgttttttggggatgcatgctggaagatttaggaataaaatgccatgatataatrtcagtgtgtgtgtgtgtgtgtgtgtgtgtgcgcgcacgcatgcacgcatacatacataatacacatatagatgcatacatagagtaggtaaattgatgcattgacaaatacattgtttagatacatgtattgcctacatacatgcatagattagatggtagatacatagatgtaaataaatgatagggcaaattgtctataattgttgaatattagagtgggcataggggtgctcatagggaaaacatgatggacaacagaactactgctaataaaaacagcttttattactgctgagtg

SEQ ID NO: 34185 - DNA, 601 bp, Human
cgatgcgggcggccacccgggcccggcgcggggcgatgggcggttccctggcgggtccgggtgcggacggccaagttctcggagagggagggccgccttgcaaactttgccgagctgtcaccctcccgctggccgcagtcggccggcctcctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgcctygttccggctgcagctttcgccgccggggcttgctggctgtcgggaactagtcaactggagtttttgttgacttcccacggttcaaaagggccttccagaatggggggctggaattaaatcttgggtctaacttaaaggaaggcgccatattattccataggtgatgctaatacctttgtgtttcgttatttgttttttaggaaacatgccctgaactgtcacagaatgaaaccagcgctcttcagcgtcctgtgtgagatcaaagagaaaacaggtaagacgctgcgccccgcagtgggc

SEQ ID NO: 34186 - DNA, 601 bp, Human
atctgacagaggtgataattatcatccaaatctcacagtattaaaggaaataactaagatagcttctcaactggaaaacaaagtgtgtggagcattttcagtgtttttcattttagctctttattttcatctcagttcctgcccatccttttgtacatgggctagcacagtacctactagtctccctgtctccagtcctactgccctccagcccatcctccatatcccttgtctgtttctataacatcaccgtgctaccatgattgctttgcttgaaaaccacagtagctttccaatgctygatacatgcatacttcacatatacactccttaacctgacatttaaggcctgttcctgtctgcattacttctttgttgttgtgaagattttattattcttttttctattttaaaaatgccaagctcactatggaaagtttggaaaatatatggaataaaaggatgaaggataaaagttaacctcatttttattacctaaagaaaaaatcactataaatgttttacaatattctctctctttttgtttgtttgggggctttttaaaagaaatatttctgtgatgggtcaatatgcataattt

SEQ ID NO: 34187 - DNA, 601 bp, Human
ttttttttcctaaacttccttctctatctccctcactcactcctcccattcaatacatcatcaggtcctattgcttttacctttcaagtagatcttgagtcttgttttcattgctctcaccttgtgccaagttactatcatcttcattttgaccagtgcaatcatctcctaaaatgggctttgcagttcctttcatgcgctcctccacctattctcagcagtcagaatgatcttttaaaaacataaaacttaaaacctttaatagtttcctattgcactcagcataaaatccaaaacttcytgtagctccactgagcttctgtaatctgccccctgcccatccttccagactcatctcacacattccctgtcttttacggtgccccaacctgctctaaccctttagacaagatatttctgtttcagaactcttcctctgcccagtcctcttccctgtaagctctctgatagaccttgtttgttctcactggatcttcattgaatatctaaaatattaggtcttcaaagaatgaagcacaatagtctgcttcatagtctggtatttttctcagtgatcctacatcttaaaatgagttggata

SEQ ID NO: 34188 - DNA, 601 bp, Human
ggaatgctggagggaagtgcagcagtgctttctgcccagcgccgctgtcctttctctgcctttcagcagcactgtctgagcggggctgacggcatgctcagcaggtggctagctgtgagggttatggtgcttaatacatgcatgcaagattcttggatcctcgtccggtacattttggctgcattttatgtgacgtttgtgagggggttagaaatactttaaaatttcagggaacttgaataacaatgaaagatgtgcagctagtccaaacagatggacttcagtagcaattccaggggcktttctgagaaggtctcttagctatatctttagaagttcagaaagtaggggggtttttgtttgttttgtcttgtctcctcaccccccagttctttttaatggcacataaaaacagatgaaaggagagggaggtatatgcatagcgaagaaagagctcctggaaaagtctcttctctgggtggctgtccactgtgacagccatgttgacaagctcgtgtaatgactaaatcctggagatgagtggaaacaaggggaagggtccaggccagctgctgggtgttttggtttattttttcttttt

SEQ ID NO: 34189 - DNA, 601 bp, Human
tccactgtgacagccatgttgacaagctcgtgtaatgactaaatcctggagatgagtggaaacaaggggaagggtccaggccagctgctgggtgttttggtttattttttctttttaatttattttgatttgtctctttgtttttgcttttgttttttaagtttgggcttccccactgatgggacttctcctagatgtggagtgactcacaggacccaactctctggagttactctccatcctcttagatctggaaatgctttatgttgtgcacagcctttcccttctgtactttttctcmtctccctgcctctaggtctttgaggattatgtgtgtagctctctgttattcagctacttaactctttcctttccaggttcttctggttcttttaacctcccaaattctggggacatgttcatgaacatgcagagtctgaatggggattcttaccaagggtcccaagtcggagccaatgtgcaatcacaggtaggagaaatgccccagtggggcctttctagcagggtagggtttgggctcaaaactccttcctctgaccccatggaagtggtctacacatccatgcagaacctgtgctgg

SEQ ID NO: 34190 - DNA, 601 bp, Human
agaatgcttgctgacaacctctcctccagctgccatgctgggtaaaaatattgtacatttgttgtttataaatttggataaaagaggaatgatgtttacttcagatggaatatctttagacttgtatctgtgtgagagtttttcttttcctaagtagattttcatacctgaggggggaaacagcttaccttttagagaagaggatttctgagagtccaccgaacacacatgggcatgtcattagccaacctggcaaaacagaggctttaaaacaataccaccatagcttttttttttttttaaatactgtttccttttgtttttcctaacctgaatttgatatgcctcaagcctggaaaatcctcttcccttagggtctggtcatctctgtggggttcttaggtcatagaggtagaaaaggtgctttgcatgccaactctgcagtgaattagaagacagggagttctccaggaactgtgatcacagaagaagaaacaatggctgccacatgctcatctaggagctgtatctaggctgggcagggaatctagacaagagttctcagcagcctggcagcccaggcctgaaagagggcattttg

SEQ ID NO: 34191 - DNA, 601 bp, Human
gggcatgtcattagccaacctggcaaaacagaggctttaaaacaataccaccatagcttttttttttttttaaatactgtttccttttgtttttcctaacctgaatttgatatgcctcaagcctggaaaatcctcttcccttagggtctggtcatctctgtggggttcttaggtcatagaggtagaaaaggtgctttgcatgccaactctgcagtgaattagaagacagggagttctccaggaactgtgatcacagaagaagaaacaatggctgccacatgctcatctaggagctgtatcyaggctgggcagggaatctagacaagagttctcagcagcctggcagcccaggcctgaaagagggcattttggatggacttgcagaggaagttgcaaatagatgtgagggaggcaggaggcaccttatgacccaccctgacattggtgtaggaggtccgggtctgggggcagcatggcggcagagggtggttggtgctgcaggcacggggagcctgctcaccctcacctcctctccagaaaggcctgccccatcacttccactcagtgttccccaactcacgaggctggcacctccctcttc

SEQ ID NO: 34192 - DNA, 601 bp, Human
ttcccttagggtctggtcatctctgtggggttcttaggtcatagaggtagaaaaggtgctttgcatgccaactctgcagtgaattagaagacagggagttctccaggaactgtgatcacagaagaagaaacaatggctgccacatgctcatctaggagctgtatctaggctgggcagggaatctagacaagagttctcagcagcctggcagcccaggcctgaaagagggcattttggatggacttgcagaggaagttgcaaatagatgtgagggaggcaggaggcaccttatgacccaccytgacattggtgtaggaggtccgggtctgggggcagcatggcggcagagggtggttggtgctgcaggcacggggagcctgctcaccctcacctcctctccagaaaggcctgccccatcacttccactcagtgttccccaactcacgaggctggcacctccctcttcctgactgacataaaaatatgtagcgacaagctgtctgccacagcagaaatctgatcagacattgatttcagcaattgccactataggccaagacataaggcaaatttgtttctgagtacggttattgctgctgca

SEQ ID NO: 34193 - DNA, 601 bp, Human
ttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcytcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagta

SEQ ID NO: 34194 - DNA, 601 bp, Human
gctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctrcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaaggtaggtggccttatgacagtggggcagaggtcttggcagggtcagggaggaacaaatgggaaagagagatag

SEQ ID NO: 34195 - DNA, 601 bp, Human
cagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaycgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaaggtaggtggccttatgacagtggggcagaggtcttggcagggtcagggaggaacaaatgggaaagagagatagtgctatccttgtggcattagtttggcaata

SEQ ID NO: 34196 - DNA, 601 bp, Human
tttcagtaagtttaagctgggttaagtttgcttttgagcctgactgcagctgcttcaagtgtctaaatggatgctcatccttagggcaaagttctctagacaaccaactggaaggcaatgtctgcacatcctgaggtttttctcatgggaatacgctccttgagggtccccaactgagcccatccctgctagcacatcaaacttgaaaaagtgacattcagcaattttttgaaaggcttttaaagaagagatgggtaaaatgatttctgctgttatactttgattagcccagttctctgtrgtgagaaggaaataagagcatggagctgcttggaggtggttttggtctgcggctgtccatggtgagcatcacggcatggacggagcacttcatctgggagtggggagtctctcctctcttctctggaggactcctggctgttctgggtgggacacagagaaatgtgtgttgaagacagatacggttctgtgctcacgagaaagagacctcattggttcttcatttcaactgcttcttcacatttttttctctctagagtggggattccaactctggctgtacattaaaaccatattaagc

SEQ ID NO: 34197 - DNA, 601 bp, Human
tgaaggtaacagggaagccactagtatagggagagggctgtggcatcagacagacctgggtgaagatccatgtctgtgacgtagtaactgtgtgatggagtttctacccctaagaaatggagataagcaaatgtacagattaaatgtatataaaggacctgactcatagtagatgctcaataaatgatagctgtgataatattgtcattatgccagtaggcgtttaggagctggatatggttggccaaaaaatggtcaatgattattgcctgttttaaaacaagttgaaggcaggaagacttttttttttttttttttttgagacggagtctcgctctgtcacaaggctggagtgcaatggcttgatctcggctcactgcaacctctgcctcccaagttagagccattctcctgcctcagcctccccagtagctgggattacaggcatgcaccaccatgcccagctaatttttgtatttttagtagagacagggtttcaccatgttggccaggctcgtcttgaacttctgacctcgtgatctgcccacataggcctcccaaagtgctgagaggaagacttttaagaacaggaaactgagag

SEQ ID NO: 34198 - DNA, 601 bp, Human
agagatatcctctttaagttgtttttttctctattcggaaagctgtccataaactatgggtgatcctgattctgactgtggtttaaaagtcctccttcctctctcttcctttcctcctctacttctgctttggatctcaggggttaagggtgtttaatcaggatttagcaatactgacatctgatgagggatcaggcctcctgttgctctaaacaatgttctccagctgccttcaagggcttctctgaagaaccatcaagggacacacgcaggatttatgcaaagaaacttcgctaaggawtttttgagctagtgaaaataaaacacaaaaacccctcccccatccccatcctgtaacttaatggctggtttatctagggctttcagatgcaataataagcaagtatcaaattttgaaacttacaagccattttctcaaaacagtccattgaacttaacatttccttgtgtttagaatctggaataaaatggcattaagtttgaagctgcagagtgaaatgtgtttgcaaagaagtgctgccagctaagcatggtggcttacacctgtaatctcagcactttgggaagctgaggtgggcag

SEQ ID NO: 34199 - DNA, 601 bp, Human
ctcattactcagcctctgctatggccagtggattagaattatctctcgaatctactctatgaggtctgaatctgggaagatccactttcctctctcccagagaaagaaaaaaaaataggaatggaagacataagcctggtagaacattaaaaacctgataagcatctgatgctggcaagagggtagtccttggtcctttcacacagggtcagtggaagttagaatgtgaacctttctttttctttttcttttttttgagatagagttttgctcttgttgcccaggctggagtacaatggcrcgatcttggcttactgcaacctctgtctcccgggttcaagcgactcccctgcctcagcctcctgagtagcggagattacaggggcgtgccaccacgcttggctagtttttgtattttagtagagacagggtttcatcatgttggccaggctggtctcgaactcctaacctcaggtgatccgcctgccttggcctcccaaagtgctgggattacaggcgtgaaccaccccgcccagcctcagaatgtgaacctttcatcaaagtaatctatgtaaagaaaaactgtatgttcctgtggctc

SEQ ID NO: 34200 - DNA, 601 bp, Human
aactattataagcaattagaaaaggaaattttagaaaaaatagaaaactctttgttcaagcatggagaaaggcataggagacacaccagcagttagcacggatttcttctagtaggctagattggaaggaactgggggcaatgataatttttgctttatgttatgacatatgggttgatgatttcaagtgcatgttttccctttgtaatgagagagaagcgctctatgaactgtgtctgtattcctagctgtgctctccttccctgcatgtacttgctgtctattgtaaccttgtgccttyccctctcttcctcttagcacctcactttccacttggctgtctgatcacctcttttcttctggcccaacctcagcctaacctaaataggccatagctcaggttggcagcgcttattctgaaatgggcaattccattctatgcagtcataggatggcaggtggagtgggattgtttactggggaccactgtactggagccctggttatctgttggtagcatttaaatgagagagaatgatctgtcatcatccctagatctaccactctatgattttgtgccactttgacaaatatgtgactg

SEQ ID NO: 34201 - DNA, 601 bp, Human
catggcagttaacaaagtaaatgcatctgaattttccaaacaggatgaagaggtaatgctaaccctgggcatctggttggaggctcaggaaatttatttgttgtataaccaaagaaaagatgtcacaaccataacttgttattctctgccgtctgtaggtcttttccaaatacctcaactttgtgtctatcatcctaaggcttcatcacaccagctacatgtacaatattgaatcccgaagaagccaggtaaaaggaaggcagcattagtcattccatgctgacctattctgacaaagccrcccagagacaacaaattcagacccctcctattcctcctgggggtgtaagccacgtggaacagatccccaaacttcagtcccacgtgtcctctcatgatcttcccgccactctccccacacacactcccctgcaccccaagctctccaattgtgtacacaactggcttggctttcttcagtctagatcccgagtggacttggcatttctgtctatgagatggtgatgacaataatggtacctacttcagatggttgttgtgactattagcgattagctctcaaataaagtttgtagaaatt

SEQ ID NO: 34202 - DNA, 601 bp, Human
ctccatagacccgcagccttgcaaaagtctactcatcatctcacctagaggatctgagtagtttgttggatgtacacatgttcaaaatcagaattgcactttccaatgatatgcatttattttatttgatgcacctcatgttttcttgtggtgaatgctctatctctccatagcatactttattctaactgttttctttttgatacctactttcagatccttatgtggtcagccaataaagtatttgaagaactcacagatgttgagcgacagtttcacaaagcgctctacacggttagawcatatctgaactgtgaacgatactccattggactgctggacatgaccaaggagaaggttcttattattctacacattttgtctcatctcacatcgcctatataacacacaccacaggaaatgtgatccttaaaaaacagatacactatgtaaataattagtcatgattgatgacaagaacagaggtaaaagtgtgtgtcttggagcaaaaaagatgtaggcttgaatcttggtttttccacttcctagtaatatgggttttcagcaagtctgttttttttttacattaattaatagacta

SEQ ID NO: 34203 - DNA, 601 bp, Human
tttcacaaagcgctctacacggttagatcatatctgaactgtgaacgatactccattggactgctggacatgaccaaggagaaggttcttattattctacacattttgtctcatctcacatcgcctatataacacacaccacaggaaatgtgatccttaaaaaacagatacactatgtaaataattagtcatgattgatgacaagaacagaggtaaaagtgtgtgtcttggagcaaaaaagatgtaggcttgaatcttggtttttccacttcctagtaatatgggttttcagcaagtctgttttttttttacattaattaatagactatttttagagtagtattgacagaaaaattgattataaagtacggagtttcctcttccctcccaatctcctctcccagtttccctgttattaatatcttgcattagtgtggtgtgatgaatcaatattgatatattattattaactaaagtccatagtttacatgagggttcatcctttgtgcagttctctgggttttgacaaatgtgtaatgtcatatatctgctactacagtatcagacagactactttcagtgcctcaaagccctctgtgct

SEQ ID NO: 34204 - DNA, 601 bp, Human
ttcacctagatcttctatgtcatctcctagaatttttatacttttgtgttttacatttaggtgtataatccatttcgagttattttttgtgaaaggtacaagttctgtttctagattcactttttttacatgtagatgttcagttgttccaacaaaatttgttgaaaagactatcctttgttcattgcctttgcgcctttgtccaagttaactatatttgtaagggtctatttctgggttctctattttgtttcattgattcatttgtccattctttcactaataccacactgtcttgatyattgcagcttcatggcaaatcttaagtcaggtagtgtcagctttttgattttgttcttcttgtcagcaagtcttttaacctacctgattcttggcttcttcatctgtaaaatgaggacatctctcttatcaattgtgagaattagagattttatatatttttttatatatataaacactatatgtacatagtgtctagaatttacacagtaggtggataatcaatattatctttaccaactttaggtttttgtattctaaaaaaatttaattaaagtagaaatattgaaacatgtaatat

SEQ ID NO: 34205 - DNA, 601 bp, Human
cctttgttcattgcctttgcgcctttgtccaagttaactatatttgtaagggtctatttctgggttctctattttgtttcattgattcatttgtccattctttcactaataccacactgtcttgattattgcagcttcatggcaaatcttaagtcaggtagtgtcagctttttgattttgttcttcttgtcagcaagtcttttaacctacctgattcttggcttcttcatctgtaaaatgaggacatctctcttatcaattgtgagaattagagattttatatatttttttatatatataracactatatgtacatagtgtctagaatttacacagtaggtggataatcaatattatctttaccaactttaggtttttgtattctaaaaaaatttaattaaagtagaaatattgaaacatgtaatattattcacaatataatgcccttgtgtcatcttctttaattctgttgctacccttctagttcaaaataactaacgataccatattatttatatattttttcttttgttttctttcctttttttgagactctgtcttggtctgtcaccaggctggagtgcagtggcatgatcttggc

SEQ ID NO: 34206 - DNA, 601 bp, Human
ttgtattctaaaaaaatttaattaaagtagaaatattgaaacatgtaatattattcacaatataatgcccttgtgtcatcttctttaattctgttgctacccttctagttcaaaataactaacgataccatattatttatatattttttcttttgttttctttcctttttttgagactctgtcttggtctgtcaccaggctggagtgcagtggcatgatcttggctcactgcaacctcagcctcccaggttcaagcgattctcatgcctcagtagctgggattataggcctgtaccaccaygtccactgattttcggtattttagtagagacaggatttcgccacgttggccagactggtctcgaactcctgtcctcaagtgatccgctcgccttggcctctcaaagtgctgggattacaggcatgagccaccgcacctggccttatttatatttcttcatattcatgtgattggaagttattttttcagagtaattgttctaagtggataaacataggatgaagcactaggagagctgggttctgatcttggttctgggactttgtagctgagtatgttggttaggattcttttggctat

SEQ ID NO: 34207 - DNA, 601 bp, Human
cagctttggcagtgaaacctcctgtttctgaggcacctgttcagataagtcactgatgaaaggagggtacgggtcactatatataatgtaaaactgactacagttaagaaattacatgatttgttctagtgaagttattaatgtcaggtatttctggacaacaaaagggatcacttgaaaataaaaacagactctctgatgatttggtagccaaagatcccccccaccccaaaagctgtttgggggcaattcaactttttaaaaacaaaatttattttagcctgtgcatgtagataaacarccaataatatttctggttttattataagtttgtagtcaggatataagtagtttgataatttatgttataatataatgtggttgggaaataaggttctatttgtaagagttttaaagtacaagttccccaatgaaaaatgatttctttgggaaataacattattcccataatatcctctttctttcttaggaagtcaacttttataaaatcattgattacattttacatggaaaagaagagatcaaagtgattccgtgagtattggcaggaagttgctgccgcagttgccgttgtattttt

SEQ ID NO: 34208 - DNA, 601 bp, Human
ggagggtacgggtcactatatataatgtaaaactgactacagttaagaaattacatgatttgttctagtgaagttattaatgtcaggtatttctggacaacaaaagggatcacttgaaaataaaaacagactctctgatgatttggtagccaaagatcccccccaccccaaaagctgtttgggggcaattcaactttttaaaaacaaaatttattttagcctgtgcatgtagataaacagccaataatatttctggttttattataagtttgtagtcaggatataagtagtttgataattyatgttataatataatgtggttgggaaataaggttctatttgtaagagttttaaagtacaagttccccaatgaaaaatgatttctttgggaaataacattattcccataatatcctctttctttcttaggaagtcaacttttataaaatcattgattacattttacatggaaaagaagagatcaaagtgattccgtgagtattggcaggaagttgctgccgcagttgccgttgtatttttgcacatattgcatttctctatattgcaatgattttttttcttctcttccccaaggacgcct

SEQ ID NO: 34209 - DNA, 601 bp, Human
ttcaatattgagttaaaagcttgggcctctaaggtcttgacccacctgtaaatgttcttataacatttagaacataatgttcttcaaagaaaggactaaaacagataattgctgatgaaaagtttaaaaaagaataggctgctttttgcctcttcaaaaacacagttgaagggtgctcagcccatcaaatgatgtaatttattcaagttagatcatgaaattaatgcatggcatgaaagattccttaaattcttaggctatatatgcttataaaaactttgaaagattctcgcattttctrtgtaagagtactacaaaaatagtagacatggttcattcaattattctcagaaagcacttaccttggggccgagaggcaggcagagtttggtgaggtggggatttaaggagggagcccacttagatcttgttagattgttagttttttaggacttttgtgagcaagttgttaaactgttggcagcttgaaatctcccatggcaagagaattgggaccatggaaattggcaactgatacaagccaaggatttccccaattcccagccaggagagctgatttccccagcacccattctggagc

SEQ ID NO: 34210 - DNA, 601 bp, Human
tggcatgaaagattccttaaattcttaggctatatatgcttataaaaactttgaaagattctcgcattttctgtgtaagagtactacaaaaatagtagacatggttcattcaattattctcagaaagcacttaccttggggccgagaggcaggcagagtttggtgaggtggggatttaaggagggagcccacttagatcttgttagattgttagttttttaggacttttgtgagcaagttgttaaactgttggcagcttgaaatctcccatggcaagagaattgggaccatggaaattggyaactgatacaagccaaggatttccccaattcccagccaggagagctgatttccccagcacccattctggagctcacagttctagttccatcccatagatttaaacaaatcacttaacctctttaggcttccatttgttcattttttttttttaagtatgaacttaattgctaagatcccttctggctttaaaatgctatgatagctgggtgtggtggctcacgcctgtaatcgtagcactttgggaggccaaggcaggtggattgcctgaggtcaagagttcgagaccagcctggccaac

SEQ ID NO: 34211 - DNA, 601 bp, Human
gcagagtttggtgaggtggggatttaaggagggagcccacttagatcttgttagattgttagttttttaggacttttgtgagcaagttgttaaactgttggcagcttgaaatctcccatggcaagagaattgggaccatggaaattggcaactgatacaagccaaggatttccccaattcccagccaggagagctgatttccccagcacccattctggagctcacagttctagttccatcccatagatttaaacaaatcacttaacctctttaggcttccatttgttcatttttttttttwaagtatgaacttaattgctaagatcccttctggctttaaaatgctatgatagctgggtgtggtggctcacgcctgtaatcgtagcactttgggaggccaaggcaggtggattgcctgaggtcaagagttcgagaccagcctggccaacatggtgaaaccttgtctttactaaaaatacaaaaattagttgggcttggtggtgggtgcctgtaatcccagctacttgggaggctgaggcaggagaattgtttgaacccaggaggtggaggttgcagagagctgagatcgcgccattgcact

SEQ ID NO: 34212 - DNA, 601 bp, Human
ctaagatcccttctggctttaaaatgctatgatagctgggtgtggtggctcacgcctgtaatcgtagcactttgggaggccaaggcaggtggattgcctgaggtcaagagttcgagaccagcctggccaacatggtgaaaccttgtctttactaaaaatacaaaaattagttgggcttggtggtgggtgcctgtaatcccagctacttgggaggctgaggcaggagaattgtttgaacccaggaggtggaggttgcagagagctgagatcgcgccattgcactccagcctgggaaacagarcaaaaactccatctcataaaatataaaaaataaaatcaaataaaatgctatgattttaattatctcttggaaagacatggtcttttattaagatccatttgtgattatgacccaaggtacagaaaacttaaaatgacccaaagttgagtgatttcttgtccttatagatgtgagcaatagtctgtgaattccactaagtaaagtgatatctctcactgaatccttactttggtgtaactaaaaacttatctggctgtttcctcctgcctcttaaccatcatcttctaacccaaatctcac

SEQ ID NO: 34213 - DNA, 601 bp, Human
aacccaaatctcactttaggaagaagaagaagaagaaaaaaagcaatcctagctctgctgctcatactggctgtagcagagctaggatttctcagctttctcctccccttggcctgagcagcctgttgctttgaatttgaaggggattccctggagtctgggggagtgggaaggggcagagacggtaccacatatcctccagtgatttaattagcagcagggaagccatcttgaatgagttgttagcagctgtggcctagttgaggtccatttgcccgcaagcagtcaagagccgtgtagraaatcctcactcccaatgcgttctttcttattctgctttgtggatcaagagggctccactacacaatatttcagaccatttgtctcctcttgccttccagatctgtaacatgatgaatgcccctgcggatgaatacttcacatttcaggtaactgcactctgggtcagacctcacctcttggggctggggtagaggagtggatgctctcgcctctcctccacccccagagtccgcctgatgctcaggtgtggccacaggcacacacgggtccatctcccactcaccctggctgggccagc

SEQ ID NO: 34214 - DNA, 601 bp, Human
gaaggggcagagacggtaccacatatcctccagtgatttaattagcagcagggaagccatcttgaatgagttgttagcagctgtggcctagttgaggtccatttgcccgcaagcagtcaagagccgtgtagaaaatcctcactcccaatgcgttctttcttattctgctttgtggatcaagagggctccactacacaatatttcagaccatttgtctcctcttgccttccagatctgtaacatgatgaatgcccctgcggatgaatacttcacatttcaggtaactgcactctgggtcagrcctcacctcttggggctggggtagaggagtggatgctctcgcctctcctccacccccagagtccgcctgatgctcaggtgtggccacaggcacacacgggtccatctcccactcaccctggctgggccagcaagtagcagattcttcagtgaaggaagaaaagaaggttaagacagaaggccagggaggggacctgccactcctccatttgctcacactcctggtcatttacggcagtggtccccaacctttttggcaccagggaccggttttgtggaagacaatttttccacagaatga

SEQ ID NO: 34215 - DNA, 601 bp, Human
gctttgtggatcaagagggctccactacacaatatttcagaccatttgtctcctcttgccttccagatctgtaacatgatgaatgcccctgcggatgaatacttcacatttcaggtaactgcactctgggtcagacctcacctcttggggctggggtagaggagtggatgctctcgcctctcctccacccccagagtccgcctgatgctcaggtgtggccacaggcacacacgggtccatctcccactcaccctggctgggccagcaagtagcagattcttcagtgaaggaagaaaagaargttaagacagaaggccagggaggggacctgccactcctccatttgctcacactcctggtcatttacggcagtggtccccaacctttttggcaccagggaccggttttgtggaagacaatttttccacagaatgagggtggggtgggagatggttttgggatgaaacttccacctcagatcatcaggcattagttagattctcataaggacggcacaacccagatctctcacatgcgcagttcacaagagggttcacactcctatgagaatctgatgctgctgatgatctgacaggaggtg

SEQ ID NO: 34216 - DNA, 601 bp, Human
tttgtggatcaagagggctccactacacaatatttcagaccatttgtctcctcttgccttccagatctgtaacatgatgaatgcccctgcggatgaatacttcacatttcaggtaactgcactctgggtcagacctcacctcttggggctggggtagaggagtggatgctctcgcctctcctccacccccagagtccgcctgatgctcaggtgtggccacaggcacacacgggtccatctcccactcaccctggctgggccagcaagtagcagattcttcagtgaaggaagaaaagaaggwtaagacagaaggccagggaggggacctgccactcctccatttgctcacactcctggtcatttacggcagtggtccccaacctttttggcaccagggaccggttttgtggaagacaatttttccacagaatgagggtggggtgggagatggttttgggatgaaacttccacctcagatcatcaggcattagttagattctcataaggacggcacaacccagatctctcacatgcgcagttcacaagagggttcacactcctatgagaatctgatgctgctgatgatctgacaggaggtgga

SEQ ID NO: 34217 - DNA, 601 bp, Human
tgagggtggggtgggagatggttttgggatgaaacttccacctcagatcatcaggcattagttagattctcataaggacggcacaacccagatctctcacatgcgcagttcacaagagggttcacactcctatgagaatctgatgctgctgatgatctgacaggaggtggagctcagacggtaatgtgagcaatggggagtgactgtaaatacagatgaagtttcacccgagtacccactgctctcctcctgctgtacaacctgctggttcctaacaggccatgggccagtactggtttayagtccaggggttggggacccctgatctaagggctcaacagttcctgacacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgactgagtcttcagagcttctcctgctgttagactcggttgtatccttccttctccactgtgcagagacccactgcctggggaatctgcctccactcaccgccagatg

SEQ ID NO: 34218 - DNA, 601 bp, Human
tcatcaggcattagttagattctcataaggacggcacaacccagatctctcacatgcgcagttcacaagagggttcacactcctatgagaatctgatgctgctgatgatctgacaggaggtggagctcagacggtaatgtgagcaatggggagtgactgtaaatacagatgaagtttcacccgagtacccactgctctcctcctgctgtacaacctgctggttcctaacaggccatgggccagtactggtttatagtccaggggttggggacccctgatctaagggctcaacagttcctgrcacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgactgagtcttcagagcttctcctgctgttagactcggttgtatccttccttctccactgtgcagagacccactgcctggggaatctgcctccactcaccgccagatgctcccaggaatcagcttctgtatgtgctactctacctgacccacttc

SEQ ID NO: 34219 - DNA, 601 bp, Human
gggagtgactgtaaatacagatgaagtttcacccgagtacccactgctctcctcctgctgtacaacctgctggttcctaacaggccatgggccagtactggtttatagtccaggggttggggacccctgatctaagggctcaacagttcctgacacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgaytgagtcttcagagcttctcctgctgttagactcggttgtatccttccttctccactgtgcagagacccactgcctggggaatctgcctccactcaccgccagatgctcccaggaatcagcttctgtatgtgctactctacctgacccacttctccccatcagggcttcctgctggaacctggctgcagacccgagttgatccctccccgccccccgagttcatccagcccaccagaagggccagcctgtcatcttcaccaccccctccccaactgtcaccccccacctgtcatctctgcc

SEQ ID NO: 34220 - DNA, 601 bp, Human
cccgagtacccactgctctcctcctgctgtacaacctgctggttcctaacaggccatgggccagtactggtttatagtccaggggttggggacccctgatctaagggctcaacagttcctgacacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgactgagtcttcagagcttctcctgctgttagaytcggttgtatccttccttctccactgtgcagagacccactgcctggggaatctgcctccactcaccgccagatgctcccaggaatcagcttctgtatgtgctactctacctgacccacttctccccatcagggcttcctgctggaacctggctgcagacccgagttgatccctccccgccccccgagttcatccagcccaccagaagggccagcctgtcatcttcaccaccccctccccaactgtcaccccccacctgtcatctctgccactcccttctctacctgcccatccctcctca

SEQ ID NO: 34221 - DNA, 601 bp, Human
caacagttcctgacacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgactgagtcttcagagcttctcctgctgttagactcggttgtatccttccttctccactgtgcagagacccactgcctggggaatctgcctccactcaccgccagatgctcccaggaatcagcttctgtatgtgctactctasctgacccacttctccccatcagggcttcctgctggaacctggctgcagacccgagttgatccctccccgccccccgagttcatccagcccaccagaagggccagcctgtcatcttcaccaccccctccccaactgtcaccccccacctgtcatctctgccactcccttctctacctgcccatccctcctcacctgtcatctctgccacccactccccacctgtcacctcctcccaacctgactgttagagataaactggcatttggctccacagcctcttattttctgcctctgggcact

SEQ ID NO: 34222 - DNA, 601 bp, Human
tctaaacagggagtgggaatggagctggcccaggagaatgcaggctgctctgaaatgtgaggccctttgctttctctcatgctccactgcagctactgctctgatgtgctctcatggcctgggcagagaggaggcctggggcctccccggggccttggggagtccccagtgtgggataaacctccaggccacagggatttcccagttctctgggaaacatcattgtggtgcccatgaaaatgtgcttctcagatctccacctgtgggaagtgtagccgtgcaatggctgctggcctgaaayccatggtcacatctgtgctgaggccacacgctccacaggccactcccaattggtaactaagtgtggcagggacagtaaagcaggcctgctcctggaagacagccagataccctgccaggcagcttgggccctaggaatgcctaacagctctgcaaacagtttcagaacagcacggtggtctaaggggctcccctcaaccttccatccttccgtttctcctttgcaaagggtcgggactgcatctctgtctgatgtctctctcagcacccccagcctccctccccgccgctcttcaacggc

SEQ ID NO: 34223 - DNA, 601 bp, Human
ctgtcacgaattgccactgagtggtttaaaaccacacgaaatgtattatctcacagttctggaggtcagaattccaaaatgagtcttcttgggctaaaatcacggtgctggtgggactcttgctttctggaggctctggggataattcatctccttgccttttccagcttctcagggcctcccgccttccttgcctggtgacccttcccctggcagagccagcagcaccatcactctgaccttgcttttgtcatcatagctccttctcccattctgattctaacctctcttctacttttawggatccttgtaattacattgggtccacctggaacatccaggctaatttccccatcttaaggccagctaattagcaaccatcattctatctgcaaccttagttcccctgtgttgtgtaagataacatattcacaggttccagagattaggatatagacatctttgggggccattgttctgcctgccatagggttcctcgaagtggactaaggggtcttcctttaacgtcaattaaagtggtcctaattcacaggaggaaaagtgtatagaatttcctcagttttttgtcctactaattttt

SEQ ID NO: 34224 - DNA, 601 bp, Human
aaaatcacggtgctggtgggactcttgctttctggaggctctggggataattcatctccttgccttttccagcttctcagggcctcccgccttccttgcctggtgacccttcccctggcagagccagcagcaccatcactctgaccttgcttttgtcatcatagctccttctcccattctgattctaacctctcttctacttttaaggatccttgtaattacattgggtccacctggaacatccaggctaatttccccatcttaaggccagctaattagcaaccatcattctatctgcaascttagttcccctgtgttgtgtaagataacatattcacaggttccagagattaggatatagacatctttgggggccattgttctgcctgccatagggttcctcgaagtggactaaggggtcttcctttaacgtcaattaaagtggtcctaattcacaggaggaaaagtgtatagaatttcctcagttttttgtcctactaatttttcttaaaccttgggttccttctgtaacttgtctgtcagtaaggtctaactaatggcaaagcacaagaatatgaactggtagcaaatgaatatttcc

SEQ ID NO: 34225 - DNA, 601 bp, Human
tgccttttccagcttctcagggcctcccgccttccttgcctggtgacccttcccctggcagagccagcagcaccatcactctgaccttgcttttgtcatcatagctccttctcccattctgattctaacctctcttctacttttaaggatccttgtaattacattgggtccacctggaacatccaggctaatttccccatcttaaggccagctaattagcaaccatcattctatctgcaaccttagttcccctgtgttgtgtaagataacatattcacaggttccagagattaggatataracatctttgggggccattgttctgcctgccatagggttcctcgaagtggactaaggggtcttcctttaacgtcaattaaagtggtcctaattcacaggaggaaaagtgtatagaatttcctcagttttttgtcctactaatttttcttaaaccttgggttccttctgtaacttgtctgtcagtaaggtctaactaatggcaaagcacaagaatatgaactggtagcaaatgaatatttcctgaaacactgagaagcagtcagcaaagcttattttggaagctttaacaaatacgcatgaa

SEQ ID NO: 34226 - DNA, 601 bp, Human
ggatatagacatctttgggggccattgttctgcctgccatagggttcctcgaagtggactaaggggtcttcctttaacgtcaattaaagtggtcctaattcacaggaggaaaagtgtatagaatttcctcagttttttgtcctactaatttttcttaaaccttgggttccttctgtaacttgtctgtcagtaaggtctaactaatggcaaagcacaagaatatgaactggtagcaaatgaatatttcctgaaacactgagaagcagtcagcaaagcttattttggaagctttaacaaatasgcatgaagttctttcacacgcatgtgatatattctctattactgattttgtccttggttcgtatgatggtgtaagtacataaatatttcttattgttttccaaagatgcaggctttgcaagcactatgcactgcatcttttttctaaagctttgaccatcaggagacggatgttgaggtttggttcctctgcttttcattccatgtataatgactacatagagtagtaacaaattacttagattgagcacttattacatgctcagtctaaatgttaaattgtggttcaggctataagtgc

SEQ ID NO: 34227 - DNA, 601 bp, Human
gatatagacatctttgggggccattgttctgcctgccatagggttcctcgaagtggactaaggggtcttcctttaacgtcaattaaagtggtcctaattcacaggaggaaaagtgtatagaatttcctcagttttttgtcctactaatttttcttaaaccttgggttccttctgtaacttgtctgtcagtaaggtctaactaatggcaaagcacaagaatatgaactggtagcaaatgaatatttcctgaaacactgagaagcagtcagcaaagcttattttggaagctttaacaaatacrcatgaagttctttcacacgcatgtgatatattctctattactgattttgtccttggttcgtatgatggtgtaagtacataaatatttcttattgttttccaaagatgcaggctttgcaagcactatgcactgcatcttttttctaaagctttgaccatcaggagacggatgttgaggtttggttcctctgcttttcattccatgtataatgactacatagagtagtaacaaattacttagattgagcacttattacatgctcagtctaaatgttaaattgtggttcaggctataagtgca

SEQ ID NO: 34228 - DNA, 601 bp, Human
atgcccaggccaggcatagtgactcacgcctgtaatcccagcagtttgggaggctgaggcgggcggatcacttgaggtcaggagttcaagatcagcctggccaacatggtaaaacctcatctttactaaaaatacaaaaattagccaggcttggtggggcatgcttgtaatcccagctactcgtgaggctgaggcaggagaatcacttgaacctgggaggcagaggttgcagtgagccaagattgtgccgttgtactccagcctgggtgacacagtgagaccctgtctcaaaaaaaaaaawaaaaaaaaaaaaaataaacaagctaaaacaaatctgttacacatggtccttggaccacactttgagaaacactcctaaacttttgtgcctgcatccctcgactagaccctaagcatcttgagggcaagacctgtgatttattctttgtaccttcagcaactgccccagttcctggcataccacagaggcttgacaaatgtttactcaactcaacacaccacagaatgaaagactatcttcatggatcagtcagaaaaacaaaaaccacactagtattttaacgggagaattttatttaag

SEQ ID NO: 34229 - DNA, 601 bp, Human
ccaggccaggcatagtgactcacgcctgtaatcccagcagtttgggaggctgaggcgggcggatcacttgaggtcaggagttcaagatcagcctggccaacatggtaaaacctcatctttactaaaaatacaaaaattagccaggcttggtggggcatgcttgtaatcccagctactcgtgaggctgaggcaggagaatcacttgaacctgggaggcagaggttgcagtgagccaagattgtgccgttgtactccagcctgggtgacacagtgagaccctgtctcaaaaaaaaaaaaaaawaaaaaaaaaataaacaagctaaaacaaatctgttacacatggtccttggaccacactttgagaaacactcctaaacttttgtgcctgcatccctcgactagaccctaagcatcttgagggcaagacctgtgatttattctttgtaccttcagcaactgccccagttcctggcataccacagaggcttgacaaatgtttactcaactcaacacaccacagaatgaaagactatcttcatggatcagtcagaaaaacaaaaaccacactagtattttaacgggagaattttatttaaggaat

SEQ ID NO: 34230 - DNA, 601 bp, Human
cctgcatccctcgactagaccctaagcatcttgagggcaagacctgtgatttattctttgtaccttcagcaactgccccagttcctggcataccacagaggcttgacaaatgtttactcaactcaacacaccacagaatgaaagactatcttcatggatcagtcagaaaaacaaaaaccacactagtattttaacgggagaattttatttaaggaattagctaaacaggtgttagaagatagaaaaagtgtaaagggaacagtgaggtaacatagtggtaagaagcacttcccatcactcrggcttgggaaagaaagggaaaaggttagaattgtcagaaaacagacacttggttctagttcactctattggatgtgctagagtacatataatggctgtatggtcctagccatgttctgacacaaagtaggaattgcacatctaacaccaaaagattactctttcttttttttttttgagatggaatttcactctgctgcccaggctggagtgcagtggcacgatcttggctcactgcagcctctgcctcctgggttcaagcaattctcctgcctcagcctcccaagtagctgggattaca

SEQ ID NO: 34231 - DNA, 601 bp, Human
ggaaagaaagggaaaaggttagaattgtcagaaaacagacacttggttctagttcactctattggatgtgctagagtacatataatggctgtatggtcctagccatgttctgacacaaagtaggaattgcacatctaacaccaaaagattactctttcttttttttttttgagatggaatttcactctgctgcccaggctggagtgcagtggcacgatcttggctcactgcagcctctgcctcctgggttcaagcaattctcctgcctcagcctcccaagtagctgggattacaggtgccsaccatcacgcctggctaatttttgtatttttagtagagatggggtttcaccatgttgaccaggctggtctcgagctcctgacctcaggtgatctgcctcccaaagtgctgggattacaggctccagccactgtgcccagcctttttctttaaattaaaaataaactaagtgacaggtggttgggtggtagctagaagggaggagtacaggacagtcttgtagtgatggaatagtgttgtatcttgattctaatggtggttgaaaagctacacaagggataaatttgcataaaactatatg

SEQ ID NO: 34232 - DNA, 601 bp, Human
acatgagtcacacatagctgtaaccaatatgttgttattttgtcgtttctatttcctgacttctataaactgcaacattttctaccaaagtataaaattttagcttaaccaaaatttgtaataatactcggaaaacaggaaagaggattttcttcttctttctcccactcctccttcctgttccctctcattcttattcttattcttacgcccagccccctgcctaatttttaggtcctgcttgactatactggtgttggtaacacctctctcttctattcatggtgcatggtacactttaaaaagcaataattcagccagttttattgtctgaagctgattattagtatgtttttcttaaattaaaagaaggaatggggtggttgatgatggaagggagatggatagaaaagcgtgcagattgttgcctccaaaccaatttttctttcactgaagagaattagaatcaccttttatccgtttcagactctcacacaatttcttggatggtctcttttaaatactgacacctacgataagatgaataagctagaaaacagaaaggacattgctcaggaaatgctcatgaaccaaaccaaag

SEQ ID NO: 34233 - DNA, 601 bp, Human
aagatgttacctaaccacatattctagaagtcatctaattacccaggggtctgacaaatgcaaatggtttactcctgggctgagagagagagacagggaaggaggggttggaagaagacatggatggcccagtgtacagagacccttactggaagtacagctgcttggctggaatagcactttgttcaaaacagccctggggctatgggagctatagcaagaaaaaaatatatatattttaggaagggaaatgtatcagtcagctattgtcatataatgctgcataacaacaaccctaacrcctcagtgtcatgcagtaatgaacctctatctctcactcacatttgtgggttgaccaggctttgattgacagtggctggacttggctccaagctatgaatttggtttgctctatgtgtctctcatccttcttggaccaggagctacctgatagatgtccttctcacaaagatgacagaagtgcaagagagcaaacctaactgtgcaggcatacttcaggtttttgctcacatcacattcaccaaaatgctcattggccaaagaaagccacatcacgaagaccaaccttatagatgatggg

SEQ ID NO: 34234 - DNA, 601 bp, Human
ctattttgactattttcccctgtattttcataaatgtattgatgtgtattattttaaggtacccatcttaataccagaatcacctgtagatctgattctactgtttatttttacacctgggttctagtcatttgatcctgttttaaagcatgccttatgcttttaaaataaaaaatcagatattgtagataaaaacgtgtaggggctctgagtgatattatccttctgcaaagagcattagagtttcttctggcaggtgagagaattgttttagatttcatttggaatgatcttttttggytttattcctactattagggtggagcccttgtttctagaaagtggctcctctggaatccatgaaatcctgggatatttacgaagaccccaagaccttgaatttcagaggattgaattccttctgattgaaatggaaatatcacacttaatttccttactaactgctataacctgttttccaccatctctttccgatctgtgatgtgagcattctttctaaactaagacacatcgactatctcaccttctccctttccatcttttgtgggctctgtcctcccacccagggcctttgctctgc

SEQ ID NO: 34235 - DNA, 601 bp, Human
ctggcaggtgagagaattgttttagatttcatttggaatgatcttttttggctttattcctactattagggtggagcccttgtttctagaaagtggctcctctggaatccatgaaatcctgggatatttacgaagaccccaagaccttgaatttcagaggattgaattccttctgattgaaatggaaatatcacacttaatttccttactaactgctataacctgttttccaccatctctttccgatctgtgatgtgagcattctttctaaactaagacacatcgactatctcaccttctccctttccatcttttgtgggctctgtcctcccacccagggcctttgctctgctaccataagactgttggtctttgacccttttttggggcttacttcccacccccgtgttttcatgtcatctgaggttcccttttctcccattttgcttggctccacctttggcaccatcctctcagcctggcccagaagaccaccctttcttctccccacctgccctcaacaataggcatcttcttggaaaacaaaacttttattgacatccgtgtcaccagaaattctctaatttcttatttaaaggaa

SEQ ID NO: 34236 - DNA, 601 bp, Human
cttaccagatggatgtacactgtgaggaaagggtaccgagctgtcacttaccacaattggcggcatgggttcaacgtggggcagaccatgtttactttgctgatggtaggtacagagggctgtaaatccttgtaaacctgcagatttcccatttgagcatgatgagaaataggtatggtccatcattttagatcagtaatttaaaaattcagggcacaaacccctctccgctgcagatgagtcccagtatccttgagcaccggtgggatgatcattcagacattcacacacttaccttctyaaaggaaggttcagtcttcacccacagtactacaatactcacaacaaataaagtgaacttgctccagaaacctagtgggcctattctctattgcaggctgcacttggtatagaggtatattaattcaaataaattatagatatgcatatatatgttatttttttagacaggaagattaaagaagtactacacagatctcgaagcctttgccatgcttgctgctgctttctgccatgatattgaccacagaggcaccaataatttgtaccagatgaagtaagtgaacacatgtccaatgtt

SEQ ID NO: 34237 - DNA, 601 bp, Human
tagatatgcatatatatgttatttttttagacaggaagattaaagaagtactacacagatctcgaagcctttgccatgcttgctgctgctttctgccatgatattgaccacagaggcaccaataatttgtaccagatgaagtaagtgaacacatgtccaatgttgacacgtattggtggacattggaaagtacttagggtgagaaaaacgcttctccctattccttggcccagtcaatgcctctttgccatgttggaaattccagggctggattctattccctcccaagcttccgccttcrcgataacgttgctctttctccctaggttcttgcgtccccctttcctttctgttttcatttccagatgtgcctctgccttcttcctataggccttcaggctttcttctctcaactttgtttaatcagagtattgaattcctatattaaagtgcatgaatctggctgggcacagtggctcgcacctgaaatcccagcactttgggagagtgaggcgggcggatcaagtgaggtcagttcaagaccaacctggccaacatggtgaaaccctgtctctactaaaagtacaaaaattagtcggat

SEQ ID NO: 34238 - DNA, 601 bp, Human
gccttcacgataacgttgctctttctccctaggttcttgcgtccccctttcctttctgttttcatttccagatgtgcctctgccttcttcctataggccttcaggctttcttctctcaactttgtttaatcagagtattgaattcctatattaaagtgcatgaatctggctgggcacagtggctcgcacctgaaatcccagcactttgggagagtgaggcgggcggatcaagtgaggtcagttcaagaccaacctggccaacatggtgaaaccctgtctctactaaaagtacaaaaattastcggatgtggcacacctgggattataggcacatgtctataggaggtagacgtgtgcctctgaggtaggagaaacacttgaacccaggaggcagaggttgtagtgagccaagattgcactactgcactccagctggagcgacaaagagagactctgtctcgaaaaaaattaaaaataaaaaacaagtacataaggtacatgaatgttaggcttacacttgtacactcctatggagcactccccagctcaggctagagaatactacccctgggctcactacccttcacctccctggtctttt

SEQ ID NO: 34239 - DNA, 601 bp, Human
gcacctgcagtctcagctacttgagagggtgaggcaggataattgtttgaacccaggaggcagaggttgaagtgagctgaggtcacgccactgcactccagcctgggtgacagagcaagactcagtctcggaaaataaataaataaataaacttcaggtattattatggttactattattgttgtgatgtcattggactattcattcaccagtattgctcatggccagcccagttccttgataatgggttttaagatggtctatctgccttagccacacttcattctcatttctgacacattgaactacccctctccagaagtagtgaagtgttgtagacagactgaatgggctttggagtcttgggtttgtggggaccaactacttcttggttgggggatcttggacaagtcatttaatctatttgagattcagtttcttagccatgagatgtataaagtgttgacctctcaaagattgttgtgagaatccagtgaaattacatatgtgaaacctacttgagaaagtgcctgctaggcaggtttcacatatataatttcattgagcgaaaagcactttgtaagcagtgactcctcatctt

SEQ ID NO: 34240 - DNA, 601 bp, Human
gatgatctccatccagacttgaggcaagagacatcttcatctcaaaggttccagcctacactggccgctcgctcctccagaatgcaagtcccctgacagtcactgaagtcctcgtcctccttcttgatcagtagtatactagccaattcagttccagagaaacaaattgagcatctattgtgtgctagtaaggacttgatacctactgcctcatttaaccttcacagcacagtgaagggaggtgccatataggaggtactagtatcccccactttaactgatgagctcaaaagatgaagtyaaaccttccctaggttataggaagtagcaggattgaagttgccatcttgcctccaggtttgcaggaaagatgcatgcagccacaccctgccctctgcattggcctggttttctttcatcattcctcctctgtaaactcaactgtatgggcatgtggtgatggaagggcttcctgactgcagactgtcagtgtgtgtgaatgtctgtgtgtgtatataaataatatatatattttttggagacagggtcttaccctgtcacccagggactgcagtggcatgatcacggctcactgcagcct

SEQ ID NO: 34241 - DNA, 601 bp, Human
aaggttccagcctacactggccgctcgctcctccagaatgcaagtcccctgacagtcactgaagtcctcgtcctccttcttgatcagtagtatactagccaattcagttccagagaaacaaattgagcatctattgtgtgctagtaaggacttgatacctactgcctcatttaaccttcacagcacagtgaagggaggtgccatataggaggtactagtatcccccactttaactgatgagctcaaaagatgaagttaaaccttccctaggttataggaagtagcaggattgaagttgccrtcttgcctccaggtttgcaggaaagatgcatgcagccacaccctgccctctgcattggcctggttttctttcatcattcctcctctgtaaactcaactgtatgggcatgtggtgatggaagggcttcctgactgcagactgtcagtgtgtgtgaatgtctgtgtgtgtatataaataatatatatattttttggagacagggtcttaccctgtcacccagggactgcagtggcatgatcacggctcactgcagccttgacctctggggcccaagcaatcctctcacctcagcctcccaag

SEQ ID NO: 34242 - DNA, 601 bp, Human
gatgaagttaaaccttccctaggttataggaagtagcaggattgaagttgccatcttgcctccaggtttgcaggaaagatgcatgcagccacaccctgccctctgcattggcctggttttctttcatcattcctcctctgtaaactcaactgtatgggcatgtggtgatggaagggcttcctgactgcagactgtcagtgtgtgtgaatgtctgtgtgtgtatataaataatatatatattttttggagacagggtcttaccctgtcacccagggactgcagtggcatgatcacggctcaytgcagccttgacctctggggcccaagcaatcctctcacctcagcctcccaagtagctgggactacaggtgtatgctaccatgcctggctaacttttaaattgtttttgtagagacagggcctccctatgttgcccaggctggtgttgaactcctgggctcaagcaatcctcctgcctcagcctcccaaggtgctgggattacaggcctgagctactgtatgtggccaactaattctttttttttttttcactaaatcatttgtgagtcagctgcaatactagatttcattcctaaatatt

SEQ ID NO: 34243 - DNA, 601 bp, Human
tggagtgtattcacacattcttgcattgctataaagaaatacctgagactgggtaattataaagaaaagaggtttaattcactcccggttctgcaggctgtacaggaagcacggcagcatcaacctctgggcaggcctcaaggagcctacaatcatggtggaagctgaagggggagcgagcacttcatatggccagagcagaaggaagagagatgcgggggaggtaccacacacttttaaataaccagatctcatgagaattcactcagtatcatgaccaaggaggatggggctaaaccattcataagaaacactgctcgcaaaatccaatcacctcccaccaggacccacttccaacattggggattacaactgaacatggggtttgggtggagacacagatccaaactatatcatggaggtaggcatgacgtagccaccatcagagaggcactgagccatgctctgagagttccaaagggagaaaccacatttgtgtgaagacagtggcagcggaaaggggcaaagagggtgggatcagagatggctttctgcaggagcggctcagccccttgaattcattgtgaattgcacatattac

SEQ ID NO: 34244 - DNA, 601 bp, Human
agagattctcacacctcagcctcccaagtagctaggattataggcatgcaccaccactcccggttaatttttgtatttttagtagaggcagggtttcaccatgttggccaggctggtctcgaacccccaacctcaggtgatccacccaccttggcctcccaaagtgctgggattacaggtgtgagccaccatgcctagcctaaactgcatctctagagtgcccaattccatgagttttgactattttatatacctgggaaaccagcaccacaatcaagatgcagaacacttctatcatccragtaattgctcatatcatgacccttcacagcacatcccactgtccactcccagccctaggcggcaacctttgaaatgttttcagttgctatggattagtttacattttctagattttatataagtgcaatcacacaattagcacaataatagaataatcatgcaatcaatcacactcttttgcattggtttctttcacgcaaaataataatttttagattactcatgttgtgtatgtccatgattcattcctttttttagagatggggtcttgctctgttgccaagactggagtgctgtg

SEQ ID NO: 34245 - DNA, 601 bp, Human
cacacctcagcctcccaagtagctaggattataggcatgcaccaccactcccggttaatttttgtatttttagtagaggcagggtttcaccatgttggccaggctggtctcgaacccccaacctcaggtgatccacccaccttggcctcccaaagtgctgggattacaggtgtgagccaccatgcctagcctaaactgcatctctagagtgcccaattccatgagttttgactattttatatacctgggaaaccagcaccacaatcaagatgcagaacacttctatcatccaagtaattgytcatatcatgacccttcacagcacatcccactgtccactcccagccctaggcggcaacctttgaaatgttttcagttgctatggattagtttacattttctagattttatataagtgcaatcacacaattagcacaataatagaataatcatgcaatcaatcacactcttttgcattggtttctttcacgcaaaataataatttttagattactcatgttgtgtatgtccatgattcattcctttttttagagatggggtcttgctctgttgccaagactggagtgctgtggcactgtta

SEQ ID NO: 34246 - DNA, 601 bp, Human
ttgactattttatatacctgggaaaccagcaccacaatcaagatgcagaacacttctatcatccaagtaattgctcatatcatgacccttcacagcacatcccactgtccactcccagccctaggcggcaacctttgaaatgttttcagttgctatggattagtttacattttctagattttatataagtgcaatcacacaattagcacaataatagaataatcatgcaatcaatcacactcttttgcattggtttctttcacgcaaaataataatttttagattactcatgttgtgtatrtccatgattcattcctttttttagagatggggtcttgctctgttgccaagactggagtgctgtggcactgttatagctgtctgcagcctcaacctcctgggctcaagcaaacctcctacctctgcctcccaagtagctgggactacaggcatgagtctctatacctggctaatgttttgtattttttgtagaaatgcattcttgctgtgttgcttaggctggtcttgaactcctgagctgaagcaatcctctctccttggccttccaaagcactgggattacaggtgtgagtcactgtgc

SEQ ID NO: 34247 - DNA, 601 bp, Human
tagctgggactacaggcatgagtctctatacctggctaatgttttgtattttttgtagaaatgcattcttgctgtgttgcttaggctggtcttgaactcctgagctgaagcaatcctctctccttggccttccaaagcactgggattacaggtgtgagtcactgtgcccagtcaattcattttttttcattgctaagtagaatccctttatcttaaataaaaggtattgcatttgactttatttgaatttaacagaagaaatgtttttgaaatggaaagaattgcagaacttcacatgatrgtgtccttatcacaagaaatgttagctcttaaagagccctctaaaatgaataacaaatgactatgaaaaattatgaaaagttgtagctgagcatttagatgtttgacatttttaagctatatgtgttaactttacagtatctactaactcccttctatgaaatatgaaggaattggtatactttttcccacatgtctgttttatatgatatatttttttaccattatcaatatttataaaattacattttgctctgtaatttccactattgtttattttaattcaacttttaattgagtc

SEQ ID NO: 34248 - DNA, 601 bp, Human
ttagtctgttttcacactgctgtaaagctactacctgagactgggtaattataaagaaaagaggtttaattgactcacagttctgcactgctggggaggcctcaggaaacttacaatcatggctgaaggagaaggggaagcaaggcatgtcttacatggtggcaggcaagagtgtgtgagaaagagtgaggaagtggcacacttaaaaccatcaactcttgtgagaactccctcactatcatgagaacagcgtgggagaactgcccccatgattgaatcacctccttccaggttcctcccycaacacctggggattacaattcgagatgagatttgggtggggacacagagccatatcaacacctctttgattttgttttccggaagttggtaaagctcacactgagcaaagcccatgaagctccaggccttctatttgggatctggccattgctgtctgccttccctccttcacttcttgttacctatgacaatgtctttggtctaggagattgaatatcagaagtcaatacaaatgtacatcagcataacttctccatcaactcctcttttgctgttgttttgtgttgtcaaagtaggt

SEQ ID NO: 34249 - DNA, 601 bp, Human
caacacctctttgattttgttttccggaagttggtaaagctcacactgagcaaagcccatgaagctccaggccttctatttgggatctggccattgctgtctgccttccctccttcacttcttgttacctatgacaatgtctttggtctaggagattgaatatcagaagtcaatacaaatgtacatcagcataacttctccatcaactcctcttttgctgttgttttgtgttgtcaaagtaggtcttgaaaggaattccttgcttctcctgtgcgctgggcacatcttgagacctcttgcyctaattaaagaatcactgagtctgtgtttacttactaaacaaacaaaaaacccaacttgtgtgcaagtgtgtgtgtgcatgtgtgtgtgtgtgtgtctgtgtgtgtgtatgtcccactttgttccaaagaggatttgatggagcttcgaagaatacatacaacactaaagaaaaagaaaatgaggactaatggaaaaataagaaaaacgaggtgagcatagtaaaggccatacatacccaaaatgtatatcagagatgggccacaaatttggccaaaacgtttatcagacacaggccaca

SEQ ID NO: 34250 - DNA, 601 bp, Human
atagtaaaggccatacatacccaaaatgtatatcagagatgggccacaaatttggccaaaacgtttatcagacacaggccacaaatttggccaagtgctttctagcaactaatacaaaaactggaatgggatcttttatatgaatctatatccacaacttaataagtcaattagaagctcttctttcaagaacctcaggtgtgaaagggagaacagagaaaatctaaaagaatgtagaattaagaaagagtttttcaattaggaggcttgtacatgtttttagataaaaatgaaaatgagygagaagaaaaaggtatgaatgaaatgcagatatgtagtgctatatgcaaaagaagcagtactgaaatggtgactataaaccctttttcttcattatatcaatttttaaaaatccagtattgactcattttgaaaagtaagatagtttttgataatctatcaactttaatacagttgttttattattttggattggaaaaaggtataagagtaaacagtatttgtcacatatgtttctatatatttctttatatatagcgttttctttcacgtctattaaatagcaacaagtgtccaggtt

SEQ ID NO: 34251 - DNA, 601 bp, Human
tatttaattattaaatagttcaatgtgaagacaaatactaagaataataaaatggatatccaaatatctatagcctaaatttaacaaatgcgaaattttgccatatttgcctcagattttgctttataaggagaaaaaaactagtgatgcaattgaggtattccacccctactccactatgaaaaatcccttcccttcttccacaaagatatcaccgtctgacgttgatgtgtattcataatttccatccatgtttttatatggtattgttgtgtgttgttttttttgtttggtttcttgktttttttgcgacggagtctcactctgtcaccaggctggagtgcagtggcgcaatctcggctcactgtaatctctgcctcctgggttcaagtgattcttctgcctcagcctccagagtagctaggactacaggcacacgtcaccacgcctggctaatttttttttttttttttttttttttgtattttagtagagatggggtttcaccatgttggccaggatggtctctctatctcctgacctcgtgatccacccaccttggcctcccaaaatgctgggattagaggcgtgagccacctcg

SEQ ID NO: 34252 - DNA, 601 bp, Human
aagatttatcattgataataaatggagctccaatgcatccattttaactgaatagagtattcaactgttgaatattcataattaatttacccagtcttctattcatagacatttcaattgtttctaatttttcatcattgcctacaatgctaccttgtatgtccctgtatatatatgagagtttctctaagaaatgtaaaagtgacaatgctgtaggatttgcatgtcttcaatttcatgctacattacaaaactgcactcctgagaagttgtgccagttagcactcccacacacagtgtrcaagagttccagctgagtgaggtggctcatgcctgtaatctcagcactttgggaggccaaggcaggaggatcacttgaggccaggaatttgagaccagcctgggcaacatagcaagactgtctctacaaaaaaattaaaaaattagccaggcatgctggagcatgcctgtagtcccacctactcggtaggctgaagtgggaggatcccttaagcctaggagttcaaggttccagtgagctaggatcaagctatttcactccagcctgagtggtagagcaagattctgtctcaaaaaaaaa

SEQ ID NO: 34253 - DNA, 601 bp, Human
taactgttgatccaaccaagaaagagattatcatgtaggtagttgaaattgtatttctctcttgttttttgtaaaaataacttattttgtacttatttctattttaaaattttttgttttcttcctaagggcaatgatgatgacggcatgtgacttgtctgctattaccaagccctgggaggtgcaaagtcaggtgagtccagttaagttttcttttctgtcacactgtcaggtactgcctaggtcccatgtaaatgtccacctaaagatctcaggcaacctcagaattctgaaaaattamaaatattagtgagacagtaggcaatttgattaggccctagaataaagcaaatagaaggaactttggaaggagaattctttcttgaaagaattctttaacattgaaacactgtaaataatttatataaaattatccaagaaatgtctgagtttttaaatagaggagtgtattagcctgttctcatgctgctgctaataaagacatacccgagactgggtaatttataaaggaaagaggtttaatgaactcacagttccacatggctggggaggcctcgcaatcatggtggaagatgaagga

SEQ ID NO: 34254 - DNA, 601 bp, Human
ttgaaacactgtaaataatttatataaaattatccaagaaatgtctgagtttttaaatagaggagtgtattagcctgttctcatgctgctgctaataaagacatacccgagactgggtaatttataaaggaaagaggtttaatgaactcacagttccacatggctggggaggcctcgcaatcatggtggaagatgaaggaagagcaaagggatgtcttatgtggtggcaggcaagagagagcgtgtgcaggggaactcccctttataaaaccatcagatcttgtgagacttacttaatatyactagaacagcacgggaaagatttgtccccatgatccaattacctcccactgggtcactcccatgaattgggaattatgggaactacaattcaagatgagatttgtgtggggacatagccaaactatatcaatgaggtaagtcagaacaagatcaggatgcatcgttagtgttttcctctatcaagggtgtttttgctcctatagtctcttcttcaatgtgctgtgaattataagaaggcactgactgtgagatgatgtctaaggttgccttccactgaagttcttcccccaccttgggg

SEQ ID NO: 34255 - DNA, 601 bp, Human
cttatgtatttatcagatgtcttctctgtataaagcccggtgttaggcaggccctggggaaagatgggatcctttatcttgaacaatttaccatttggtgggggaactaaacattgtgaaccaatgcacaattaacgatctcgaagaaggcactagtgtgcacatgggccatggagaaggctttcctgaagaatgcttacgctaaccacagaaagcaggcattggggaggaagagtaagaaaatatgtacaaaggcttggagtaggaataagcttggtgcaattgaaaaatttttaagctgatatagctggagtctagagagtaaagagtgcgaagtacatatgaagctggtagtgcaggtagctgccagatactgtattgccttgaaggtgggctaaaaatgttcatgggtcatttgagagatttaaggtaagatatgatttgcatttcaaaacaataagtgatttttaccaagcaagtgaaaagtgagggtatttcttagtactattagatttaacctttatctcaactttattatgaagagatgatcaggtcctttaagtgacattggatatggatctgtattttatttgcacaaaaa

SEQ ID NO: 34256 - DNA, 601 bp, Human
tcatctttcaggcgtcttactgtttgaaccttgaattttaacctgggacatgtttgactaaaatgatgctgttaatattttctgttgtgcaaaacacaaagagaactaggctccagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttwttaccagtactctgcatacacagtccaaaagagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtc

SEQ ID NO: 34257 - DNA, 601 bp, Human
ttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggktttttttttttttttttttttttttttgagacagggtctctcgctctattgcccaggttggagtgcaaaggctgactgcaacctcaatcccctgggctccagtgatcctcccacctcagcctccaaagtagctaggactacaggtgtacaccagcacacctggctaatttttttatttttttatttttgggggagaccaggtctcactacgttgcccaggctggtctcgaactcctgagctcaagcgatcctcccacttccacctaacaaagtgctgggattatagacatgagcctttgc

SEQ ID NO: 34258 - DNA, 601 bp, Human
actcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttytatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccagg

SEQ ID NO: 34259 - DNA, 601 bp, Human
atgctgctcgggatccatatgtggtaatcattatttaatggaaactcttccctgtacagagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcctttttttagtgtgcatcagaggcrgactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagaca

SEQ ID NO: 34260 - DNA, 601 bp, Human
aatctggaacccatttgccctaattgaggactccacaggaaagaagagtagagcctggctaatcaggagagagatgtgcagtgagttgcttggatccctaccttttaatcagaatggtagattgctctcatctcttaattggtggtggagttttgaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagrtacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggc

SEQ ID NO: 34261 - DNA, 601 bp, Human
taaaatatttttggggaagtttctctttaataaagtttgaagagacatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtsaggctggtctcgaactcctgacctcaagtgattcacctaccttggcctcccaaagtgctgggattacaggtgtgagtcatcacacccagcctataacttttttttaataggtgatagaatcccgtgcttgaaaaataatcaaacaaaaagagaatgcattgtaagaagcctcactgtactcctgtccccagctgcccagttctcccctcctccccacagggaaacatcttcattagtttcattaggttcttatgaaaccttccagagtttctttaagcaaaatacaagcaagtaggactg

SEQ ID NO: 34262 - DNA, 601 bp, Human
tggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtgaggctggtctcgaactcctgacctcaagtgattcacctaccttggcctcccaaagtgctgggattacaggtgtgagtcatcacacccagcctataactttttttwaataggtgatagaatcccgtgcttgaaaaataatcaaacaaaaagagaatgcattgtaagaagcctcactgtactcctgtccccagctgcccagttctcccctcctccccacagggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatattta

SEQ ID NO: 34263 - DNA, 601 bp, Human
gattacaggcatgtgccaccatgcctggctaatttttttttttttgtatttttagtagagatgggggtttcaccatgtttgtgaggctggtctcgaactcctgacctcaagtgattcacctaccttggcctcccaaagtgctgggattacaggtgtgagtcatcacacccagcctataacttttttttaataggtgatagaatcccgtgcttgaaaaataatcaaacaaaaagagaatgcattgtaagaagcctcactgtactcctgtccccagctgcccagttctcccctcctccccacrgggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctga

SEQ ID NO: 34264 - DNA, 601 bp, Human
actcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcaytgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttgcctgggaactagactgcctttgcg

SEQ ID NO: 34265 - DNA, 601 bp, Human
attcctaatgaatgaaagcaagacaaaggcaaatgaaagtagaggtagaggttgtgttatgatgaatgatctaacagtatatatgttaaagaatgccaaatgcaggttttaattatccaccggtctcattgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttgcctgggaactagactgcctttgcgggactaacgaattagctacaagattagaaagtatggtttaggggtcactgttgtaaaacctgaggtcagtgcttgagatattttggagaccctgtatttcgatgcaccagctgacaccacccaggtcaataaactggctcatctgatcttggggcccctacctaggaactga

SEQ ID NO: 34266 - DNA, 601 bp, Human
atgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcrcgctcacaccagggagggctgcaccctcctttctcccgtctgtgttttctttcccttgcaagtgttattcgacaaaagcaattatgctaatttccttccctgtgggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaag

SEQ ID NO: 34267 - DNA, 601 bp, Human
actcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaarcttttttggtatcttatttttttctgcgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatct

SEQ ID NO: 34268 - DNA, 601 bp, Human
catataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttwaaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgta

SEQ ID NO: 34269 - DNA, 601 bp, Human
atataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttawaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtat

SEQ ID NO: 34270 - DNA, 601 bp, Human
aacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatatccagagcacactgatgcaaggggtggagctcttgggagggatggaacaccctgtggctttgcagggtttagcccctgcagctgctctcaggggctgttgtcgagtgcctgtggtttttcctggtgcagagtrcaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatactccgaaatctaggcagaggctcccaagcctcaactcttaacactctgtacacccacaggctaacaccacatggaagcggccaaggtttatggctgtcaca

SEQ ID NO: 34271 - DNA, 601 bp, Human
cttgggagggatggaacaccctgtggctttgcagggtttagcccctgcagctgctctcaggggctgttgtcgagtgcctgtggtttttcctggtgcagagtacaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatmctccgaaatctaggcagaggctcccaagcctcaactcttaacactctgtacacccacaggctaacaccacatggaagcggccaaggtttatggctgtcacaagctgaagcagcagcccaagctgcacctgaactcctttgagccacggctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaa

SEQ ID NO: 34272 - DNA, 601 bp, Human
ctgctctcaggggctgttgtcgagtgcctgtggtttttcctggtgcagagtacaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatactccgaaatctaggcagaggctcccaagcctcaactcttaacactctgtrcacccacaggctaacaccacatggaagcggccaaggtttatggctgtcacaagctgaagcagcagcccaagctgcacctgaactcctttgagccacggctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagtt

SEQ ID NO: 34273 - DNA, 601 bp, Human
caggtgttgcttctagagattcggtgcctgttttttaaaacatcaatagatttcaaggggtcagtacactgccttggcagcagattgcccaggtgtgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttttttatttatttatttatttatttatttatttatttattttctttttttttgagacagagtctcactctgtcacccaggctggagtgcagtggcgcaatcttggctcactgcaaacttctgcctcccaggttgaagcaattctcctgccttagcctcccgagtaggtgggattacaggcatgcaccaccatgttcagctaatttttgtatttttagtagagacagggtttcaccatgttgcccagactggtctcgaactcctggcctcaagtgatctacctgcctcagcctcccaaagtgc

SEQ ID NO: 34274 - DNA, 601 bp, Human
tcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgtkagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggaaatatgtacagt

SEQ ID NO: 34275 - DNA, 601 bp, Human
cttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgtgagacctctccaatgtttaaggatcatgaaggctttgggtattatccacccaatagaaggcctcactgcctctctrtgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggaaatatgtacagttaaataatggtaagttctgagtgtctctattcatttttgaggtttggttgttaacacttgattaaatatgttcaa

SEQ ID NO: 34276 - DNA, 601 bp, Human
agttggtcaaagatgctctgactggtggaaatgtgttggtgggaagagattgaagttattgttgaaaatagggtcttttcacatccaatgtgagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggcccyttcttcatgttctatgtctctggggatagttgacatgactctccttcaactaagtcccacatcttccaggtagtttggaaatatgtacagttaaataatggtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctga

SEQ ID NO: 34277 - DNA, 601 bp, Human
ccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggaaatatgtacagttaaataatrgtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacct

SEQ ID NO: 34278 - DNA, 601 bp, Human
gggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaattkgaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatc

SEQ ID NO: 34279 - DNA, 601 bp, Human
gaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggwatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatc

SEQ ID NO: 34280 - DNA, 601 bp, Human
ctatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaatyaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagtttttttttttttcttcatgcctgatgaaagctttgg

SEQ ID NO: 34281 - DNA, 601 bp, Human
aggggccgactagccgaagacccaagtcagcattccggtggtgtaactgtgtgtttccctccagccctggcctcctgcccttgtcactaatcaccaaggagtcattaacttcctccctctatgcccacccctgacacttcaccattaatcttaacacagaacatgaggttatgtgtttataggacaacttaagctgttcttcagtttgaaacatcttttcacccaggggcaagttagcaaattgagtcttttaggacagattctcagatgggatgatctggaggaggaggaaaaagatacrctcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccag

SEQ ID NO: 34282 - DNA, 601 bp, Human
caatcagaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccattaatcttaacacagaacatgaggttatgtgtttataggacaacttaagctgttcttcagtttgaaacatcttttcacccaggggcaagttagcaaattgagtcttttaggacagattctcagatgggatgatctggaggaggaggaaaaagatacgctcccttggggctgagcatgccccacactcttggatcttctctctgttccctggtgtcttcactaatgtcctcatgttggtgaagtgttgggggatggagggcgggtgagcagtcgggggacaaaaagtctatttttc

SEQ ID NO: 34283 - DNA, 601 bp, Human
gagttcactctgctgctacgaaagcttccaatggagagtggctgctgctggtgctccttgatcctgcctggctcaagggccagtgtcatgctgacactcctggcagcatcaggacagtggttgaatattcccagcctgccacgctgcctactaggagggtggtatcttaggagcagcagttgtttctgggtaagggcagtaagaaggtgccgttgccttcttccatacttcgcttcccgatcttcgggagctcctgggaagcctgcattgtggatgctgagctcagcatcctgagctgctkggaagctgttgtggtcagaccttattggcctttgctgtacccaggtgacccccttccattgggctctctggctacaatacttcctgtttttgcctgcgtggaaggatctaagatggccttatttccttccttagccactcagaaggttgggtggctttgtggtctggggtttaagggaggagttgtacaactctaagaggtggtcaaagtaagggaaactcattatgagctctgtagattctttcttccactaacttgaccttactccataatactaagagacttccctcgcctggtctt

SEQ ID NO: 34284 - DNA, 601 bp, Human
tttcccaaaatttctcttggctttctctcttcttgagtacaaaagtagacatttctttctttttttttttttgtgacacggagtctcgctctgtggcccaggctggagtgcagtggcgtgatcctggctcactgcaacctctgcctcctgggttcaagcaattctctccctcagcctcccgagtagctgggattataggcacctgccaccacgcctggctaatttttgtagttttaggggagatggggtttcaccatcttggccaggctggtcttgaactcctgaccttgtgatccacccrccttggccacccaaagtgttgggattacaggcatgagccaccgtgcccggccgacatttctttttctttccttccttctacccttttatttttcatgcaaggtctccagtcccttcagtttccctccttctctgcttcctgttccttttagcctcttgactttcttgacctgtaagttccccccagtagtaggagaatgtggtagcttgagctagagaagttgcctctttccggcagtggtcctcacccggtgagtcacagacactctgtgacactctggtcacaggcagctgcaataca

SEQ ID NO: 34285 - DNA, 601 bp, Human
accgcatccagccacacttatgacttttataaagagaacaatctcatgttggcctcaaagcaagcaatgtctgaaagtgtctttgagagaagcatgattaggtagatgcagggagtatatagacatttctgtctgtgcttctgctgcctcttcccttcccctcgttgctcgtcgtgccatattctggccaggtcttaactgcctcaaaaggggcctattcttctcaccaaattttgggcttagcaaaatcttcaggtcacctagtctagcccctgatgggaaggctgaattctgtttatcytatttatctacattacttgtcacactacaggcactgaggaaatggtacaaacttactagaagttcaggaaattgtacttcatcttggttttaaggagtaattaatctcctaccatttggttccataaacgtgggtgtgacagaggaggggaggaagagcagctgtgagcctgcaagtccctgtagaaatccttttccctctgattcttattctcagatcttcttacctagggaattttttttttcctttcctgtcccagggatctttctttcatcaaggtgataaacgtgggccagcgat

SEQ ID NO: 34286 - DNA, 601 bp, Human
agagccaataaaagaagacgtcctgggtcctgaaaaggctgggaaccattgctctcctagaccatccttcaggattagaatggagagcaagttgtgtttaccgtgagggaacctttgtcaagtgctgacatgaggcacaggagctggcagctgggactgaatgggcagtcatgagatcaggagactggtcagaaccctgaccttgactgtctattgtgggaccatgggcaaagctcttaatttctccaggcttgagtttttccatttacacgagggaagttatcaagtcctcattttttttgtaaatcttttttttaaaatacatttatttatttattttgagaccgggttatgagactggctaatttttatatttttagtagagatagtgtttcaccatgttgccaaggctggtctcaaactcctgggttcaggcgatccacccaacttggcctcccaaagtgaggattacaggcataagccactgcgcccagcctcaagtcttcattttatctaagcaagtttatgaaaggaaaatgagtttaagtttaagaaaaggagttgaacctggcttaaagaaggtggaagagaatttcaggat

SEQ ID NO: 34287 - DNA, 601 bp, Human
actatagccatagtggttaactgaaacatcagctttcttagtgtttgaccgtagttatacgaacttggttatttcatgcctgtcaactggcaggagataatcagcagttctgacttctgatgaataaagataaaatgtcactaatgaaacatgctttatgggcagcatatttctaaatattaggcctctttagagccaataaaagaagacgtcctgggtcctgaaaaggctgggaaccattgctctcctagaccatccttcaggattagaatggagagcaagttgtgtttaccgtgagggwacctttgtcaagtgctgacatgaggcacaggagctggcagctgggactgaatgggcagtcatgagatcaggagactggtcagaaccctgaccttgactgtctattgtgggaccatgggcaaagctcttaatttctccaggcttgagtttttccatttacacgagggaagttatcaagtcctcattttttttgtaaatcttttttttaaaatacatttatttatttattttgagaccgggttatgagactggctaatttttatatttttagtagagatagtgtttcaccatgttgccaagg

SEQ ID NO: 34288 - DNA, 601 bp, Human
catcagggggctaaaagggagaagctccttgagcataacattccaaagcaggaaaaagacccaaagaaaggaaggggcttattgaagaccacacagattaccagtgacagacctaggaacaaacctacacctcttgacccccaccttataggctcctctggactctgctttctaaagggacacttggggttggaggggggtagtaatttgcatttcacttcagccaaacactttccatatttaattggatttccaggagccaacattcaaggttaagactcatgaaaggggtactaatttaaaaaaaaaataattccaacatcagtttcagacgtagcaaactacgtttggacgtaagttctgaatctgtttcccttttgtacataaaagaaaccccagtctcttgatgtcaaagcttcagagactcaaggtggcagggaaactggtgtgttcatcgtgggaaaatacttacagttggcttgtcacggtgcgtgttcacagcctccacgttaagtttaattgtttccactttgcaccctgagaaaacagaggaaagagaggacttaaagaaaaaggttcaatggaaaattccttagttatg

SEQ ID NO: 34289 - DNA, 601 bp, Human
tgtgcgagtgtcagccttggtccccagggagagcattgcaaaggccatagccacgcttgttggggtgactaagacattgctggtttgtgatagatcagccagctctttgtacaaatcaaaggcgaggtcggtgacgttataggagatcttctggcaagcaaggtcctcccagtccccttgatcatggtgggatgtatccgtcttttgggcagcatcttcctggggatcctcaaccagggagctggggaccaggcagcacaggcctgccagcaggaggacgccccatgagacagagaatggyattgtcctgcaagacagaggcagagggccaggccccaagtcagggcacatgatgactcccagtgaccagggactgacattgtgtgattgcaaccatgaattattaaacatccaccatgtgcccagcccattgcaaacactttcctacaccatcatcattgaaagaataagaaagatagcaagcacgtgtaaggtacttagcttatgccaagaactgttctaagcacacgtgtgttaactcattgctttcttgtaacaatcctgtgaggtggtaatgctactatcttccttttacacatga

SEQ ID NO: 34290 - DNA, 601 bp, Human
cccagcaccctggcattttaacccctcaggggcaggaaggcagcctgagatacagaagagtccatcacctgctgtatgccacacaccatccccatggtctctgtcacttgtttaatccttaaaacaacctgacagcaaggatgctattttgtccatgctaagacgggaaattagcacctcagagaggtagaatgcattgtcctttatcaaaagctagtaagtggtagaggcaggatttgaaccccaatattttagacggcaaagctgacactgcttctgggacactagggtcgtctaaagyatgttccatgaaactattcctttatgcatgtgccacaaaatatttttctggctttagcatgtgggaagcatttcatattctgccccctccctattagggatttccaatgagtattaggacaataaaggctctgacaaggtctgtagagaagatgatggtttggctgtcttaaactcatcattcttcaatcttgtttgatcatggaaagtattttattgtttgtgtttggaaaattgcagaatccatgttaaatgccctgccatatctcatagtacattgtctaggaaagcttaagaacta

SEQ ID NO: 34291 - DNA, 601 bp, Human
gcctgggcctgccctaaggccacagcagagcccggacctcagctgtgctgactgcagcctggctgctctccactgccctcctttgcctcaagagcaagggagcctcagagtggaggaagcagcccctggccttgcctccacctcccctcccctatgctgttttcctgggacaataggagctggcttagaatgccctggggcccccagcaccctggcattttaacccctcaggggcaggaaggcagcctgagatacagaagagtccatcacctgctgtatgccacacaccatccccatggtmtctgtcacttgtttaatccttaaaacaacctgacagcaaggatgctattttgtccatgctaagacgggaaattagcacctcagagaggtagaatgcattgtcctttatcaaaagctagtaagtggtagaggcaggatttgaaccccaatattttagacggcaaagctgacactgcttctgggacactagggtcgtctaaagtatgttccatgaaactattcctttatgcatgtgccacaaaatatttttctggctttagcatgtgggaagcatttcatattctgccccctccctattagg

SEQ ID NO: 34292 - DNA, 601 bp, Human
gtgcctcagggacccttgagctcagctttctcattggacagaaggaggagacgggggctggagaggggcctgggcctgccctaaggccacagcagagcccggacctcagctgtgctgactgcagcctggctgctctccactgccctcctttgcctcaagagcaagggagcctcagagtggaggaagcagcccctggccttgcctccacctcccctcccctatgctgttttcctgggacaataggagctggcttagaatgccctggggcccccagcaccctggcattttaacccctcagggkcaggaaggcagcctgagatacagaagagtccatcacctgctgtatgccacacaccatccccatggtctctgtcacttgtttaatccttaaaacaacctgacagcaaggatgctattttgtccatgctaagacgggaaattagcacctcagagaggtagaatgcattgtcctttatcaaaagctagtaagtggtagaggcaggatttgaaccccaatattttagacggcaaagctgacactgcttctgggacactagggtcgtctaaagtatgttccatgaaactattcctttatgcatgt

SEQ ID NO: 34293 - DNA, 601 bp, Human
tggaactatctggctgctggagagcttttgtgagaatcacctgaagataaagaagaatccagagtttctatatacttgaactaattggcaaaatcctggtgccacagaagaagcatttatatttggctctgtttattcgatagcggcttggggatggttaatgaaagttaatgagtaaaatcggaactccttatgccttgccacctttggctggaggcttctgatctcatgcagagggctggttctgttgagatacgaggacagcattgtgcttacttctcctgaggcctttccctggatsagcaggggagatgcagatgcctaggcagactcccctctgccgtaccaagaaagcttcaccatcgaggcatgccaagtgggcaggtgcctcagggacccttgagctcagctttctcattggacagaaggaggagacgggggctggagaggggcctgggcctgccctaaggccacagcagagcccggacctcagctgtgctgactgcagcctggctgctctccactgccctcctttgcctcaagagcaagggagcctcagagtggaggaagcagcccctggccttgcctccacctcccctcc

SEQ ID NO: 34294 - DNA, 601 bp, Human
ttggatcgggcaggatgaagaaggcagtggcgttccccacatagtgctgtgccagcacccagctggataactccctgtcccggtggatgtcaaatctacccaggtggtttatcataggcactctgatgatggtcttatcatccacatggaagccctctaccataatgcgctcagccttgaatttatctttccacttgcctggaagaaaaggaaggtgggcatcagccaggtgtgggataaaagggtggaagtgtgtgaatgaaaggagccctgagcccctttggcaggacacttccctctscttcagctttatcatctgtaaaatgggattcaaatggaactatctggctgctggagagcttttgtgagaatcacctgaagataaagaagaatccagagtttctatatacttgaactaattggcaaaatcctggtgccacagaagaagcatttatatttggctctgtttattcgatagcggcttggggatggttaatgaaagttaatgagtaaaatcggaactccttatgccttgccacctttggctggaggcttctgatctcatgcagagggctggttctgttgagatacgaggacagca

SEQ ID NO: 34295 - DNA, 601 bp, Human
gacacccaatctaacagcatcgataaagcgacagagaaacgcaagccttctgctaacatggcctggctgttccaattccgaactttgtttttctgggccttgccacacaggctcttcccccgtcccctgaaggacatgctacccttgaactccacactccactgttgcctttgccaggaagcccatctgttccttcttggttctgccagaatgtgtggtggtgctgctgtccctgccctgggcactggatattgggaagggacagtgtccacactggagtgggaagtccccagggacgagwtctttacctcctcacccctgggtactgtcctcctcatggagcatggatggtcctgcctgaactcagtggtggcctctgcagtagctgtgacccagggatgtgaggtccaccctccccagccctctggccagtcctgttgggcctcagtcctgacatggctcaaaggtctgggcagcttctgactcagcccctgaactggaaatcaccttatgtcaaaggctctctggatattttcaaggtggctgtaggtcaatttttcttccaactgccacatcttctttggatcgggcaggatgaaga

SEQ ID NO: 34296 - DNA, 601 bp, Human
cttcattaaataaactgctttgtcaactatctacatttcagtccagatagttactcctctcctattaaatccagtatagctcaattgttttttactttatagtcaaataacttccttcaaaagatgccatcttttaaaccccttaacctttcaaaaacaccagaagcaccacagttccttaaggcaaatgtacaaatgtagaaccgagtatttgcagggggactaacacaccctggtgtctcccacctccagataacagaggaggagataaaatccagcagacccaaagcaccaagctctygggcttagtggttttcaagcccattttccaaccagtcataactacccagggcatctccagttaaccaattcacttactatattataccaggatcaatttcccatgttattaacattattactttccatgaatatagtctacagttggccctcggttaagtggttacagtaaatgtctcctcttactcatccaccgtgtttctctctgagctcctaccttgctgatgatttcctccttcaggaacaccagccctctctcggtccatgtgcctcattctcttcctcactctggctactgtgt

SEQ ID NO: 34297 - DNA, 601 bp, Human
taaataaactgctttgtcaactatctacatttcagtccagatagttactcctctcctattaaatccagtatagctcaattgttttttactttatagtcaaataacttccttcaaaagatgccatcttttaaaccccttaacctttcaaaaacaccagaagcaccacagttccttaaggcaaatgtacaaatgtagaaccgagtatttgcagggggactaacacaccctggtgtctcccacctccagataacagaggaggagataaaatccagcagacccaaagcaccaagctctcgggctyagtggttttcaagcccattttccaaccagtcataactacccagggcatctccagttaaccaattcacttactatattataccaggatcaatttcccatgttattaacattattactttccatgaatatagtctacagttggccctcggttaagtggttacagtaaatgtctcctcttactcatccaccgtgtttctctctgagctcctaccttgctgatgatttcctccttcaggaacaccagccctctctcggtccatgtgcctcattctcttcctcactctggctactgtgttggttc

SEQ ID NO: 34298 - DNA, 601 bp, Human
caatttcccatgttattaacattattactttccatgaatatagtctacagttggccctcggttaagtggttacagtaaatgtctcctcttactcatccaccgtgtttctctctgagctcctaccttgctgatgatttcctccttcaggaacaccagccctctctcggtccatgtgcctcattctcttcctcactctggctactgtgttggttccttgtcctctccccactccctacacataaaggatcgccaagattctctgcttttcacctccctctgagaacccacccatacatcccargccttctgctcctcccaggctgcagaaaactcctagaggaatcctcctgaactcctctcacctgggctccagacccgtgttcccaatcactttccatagttcccagaaatcctgccttctcttcctgccctgccattgtgcctgccacagcctcctcccccatccataaatcccagtcgcacttcaaatcccagattaagtgtcctctggtaagagaacattgcactgattctccacccaccccagtggagtgggccctccttcctcatgttctgattgttagttgtatctgcaggactc

SEQ ID NO: 34299 - DNA, 601 bp, Human
gcagaaaactcctagaggaatcctcctgaactcctctcacctgggctccagacccgtgttcccaatcactttccatagttcccagaaatcctgccttctcttcctgccctgccattgtgcctgccacagcctcctcccccatccataaatcccagtcgcacttcaaatcccagattaagtgtcctctggtaagagaacattgcactgattctccacccaccccagtggagtgggccctccttcctcatgttctgattgttagttgtatctgcaggactctctctccccatatggagtgagstttctttactgatggatctgggtatcccagcactcagtacagtgtgtggcacagagcatagctcaataaacacatcccatcccgtggaaattggaagattctaagaccattagtctcctaataggcacatctgctgcagtctctgtaaaggttttacatttccatctttcagagactcaaaaatttggagcatgtctgcatctctccatagcatcttaaatatctggggtctagacaacattatcagctctacttctttgaaacaagtcagaaaatggacctgtaaaagcctcacaatgg

SEQ ID NO: 34300 - DNA, 601 bp, Human
acctgggctccagacccgtgttcccaatcactttccatagttcccagaaatcctgccttctcttcctgccctgccattgtgcctgccacagcctcctcccccatccataaatcccagtcgcacttcaaatcccagattaagtgtcctctggtaagagaacattgcactgattctccacccaccccagtggagtgggccctccttcctcatgttctgattgttagttgtatctgcaggactctctctccccatatggagtgaggtttctttactgatggatctgggtatcccagcactcagyacagtgtgtggcacagagcatagctcaataaacacatcccatcccgtggaaattggaagattctaagaccattagtctcctaataggcacatctgctgcagtctctgtaaaggttttacatttccatctttcagagactcaaaaatttggagcatgtctgcatctctccatagcatcttaaatatctggggtctagacaacattatcagctctacttctttgaaacaagtcagaaaatggacctgtaaaagcctcacaatgggggactaacaccttcacagtgctcgctaaccccccgga

SEQ ID NO: 34301 - DNA, 601 bp, Human
actatttgagtatggctgcttgttgttagactataatttttattggtaaatgactcacacccaaatccattgcaacgtcctggcctttaacctaattgtgaatggtacttacttcatcagctcaaggagaaaaaactggattcactgagttgttttagagacaaaaataaggcaaccaatcccaagaaagagtgtggggaaatttatttcaaactccctaaaatttggcctggtgcagtggctcacacctgtaatcccagcattttgggaggctgaggcaggtggatcacttgaggccagsagttctagaccagcctggccaacaaggcgaaaccctgtctctactaaaaatacaaaaattagctgggcatggtgatgcatgcctgtaatcccagctactcaggaggctgaggcagaagaatcacttaaacccaaaaggcagagatttcagtgagctgagatcatgctactgcactccagcctgggggacaaagtaagactctgtctcaatcaatcaataaaattccctaaaattctactgcaaaacgagctaccttctggtagttctttctatcttcatgagatgaaaattctaatgagg

SEQ ID NO: 34302 - DNA, 601 bp, Human
caaaacgagctaccttctggtagttctttctatcttcatgagatgaaaattctaatgaggtgacttgcagtaggagttccttatatgtttgtcttctatgctcatctgctgtatttgtcctcagatattctagcaggacctcacaaagcaaatagctcccaaatgtctcttggtcagaagtggtgtgactctttagtggcagaaacttgaccacctttgtgagctgctcctttcatccccaatgggttcatatgcctgtttcccactttgtaccctaatctttgagcccagacacccaaawggccatttgttcactttccccataagcccagctttacagatgaatttggcagccatctgagactccagatgcccatacgcattctggcttaatatagcaatgccatcagcgtgggctgccaaaacgtgtccagctcacttaataagccattaacccatctctggaaaaaggctggtgagttccccgcaccagagggtcaggcattaagctcctatgcccatctggtgctacaaatgcgttgtgaatttagcttcctcctatttgcccaaaaccctctcctaagtcaagagttgagatgat

SEQ ID NO: 34303 - DNA, 601 bp, Human
caaagcaaatagctcccaaatgtctcttggtcagaagtggtgtgactctttagtggcagaaacttgaccacctttgtgagctgctcctttcatccccaatgggttcatatgcctgtttcccactttgtaccctaatctttgagcccagacacccaaatggccatttgttcactttccccataagcccagctttacagatgaatttggcagccatctgagactccagatgcccatacgcattctggcttaatatagcaatgccatcagcgtgggctgccaaaacgtgtccagctcacttaayaagccattaacccatctctggaaaaaggctggtgagttccccgcaccagagggtcaggcattaagctcctatgcccatctggtgctacaaatgcgttgtgaatttagcttcctcctatttgcccaaaaccctctcctaagtcaagagttgagatgattttgtcagcatctaatttatctaacagtgcatcaagtctgggtatggactgtggcatctggtttgatcacacaatttcattttctctgactgacacaaaatctaattactatctgggcttggaaacccaggggctcacagaag

SEQ ID NO: 34304 - DNA, 601 bp, Human
tttgttcactttccccataagcccagctttacagatgaatttggcagccatctgagactccagatgcccatacgcattctggcttaatatagcaatgccatcagcgtgggctgccaaaacgtgtccagctcacttaataagccattaacccatctctggaaaaaggctggtgagttccccgcaccagagggtcaggcattaagctcctatgcccatctggtgctacaaatgcgttgtgaatttagcttcctcctatttgcccaaaaccctctcctaagtcaagagttgagatgattttgtyagcatctaatttatctaacagtgcatcaagtctgggtatggactgtggcatctggtttgatcacacaatttcattttctctgactgacacaaaatctaattactatctgggcttggaaacccaggggctcacagaagatctaagcacctccaagtttaacaactcttccacttgtttccataaactgacggagcagaacaattcaacaagcagtttggggctcctgttctgcaaggattgggccaagcatgctcaaaagtcagatccagctcccccactctacccttctatgactttccc

SEQ ID NO: 34305 - DNA, 601 bp, Human
taagctcctatgcccatctggtgctacaaatgcgttgtgaatttagcttcctcctatttgcccaaaaccctctcctaagtcaagagttgagatgattttgtcagcatctaatttatctaacagtgcatcaagtctgggtatggactgtggcatctggtttgatcacacaatttcattttctctgactgacacaaaatctaattactatctgggcttggaaacccaggggctcacagaagatctaagcacctccaagtttaacaactcttccacttgtttccataaactgacggagcagaamaattcaacaagcagtttggggctcctgttctgcaaggattgggccaagcatgctcaaaagtcagatccagctcccccactctacccttctatgactttcccagtgctagccacacttctctgcatccctgttgactttgtagagcagagtttctcaaacttgccactatgggcacttttgactggggaattatttgttgtgggggttgtcctgggcactttaggatgtttactggcatccctggcctctaggtgccagtaacacacacacacacacacacacacacacacacaccaccag

SEQ ID NO: 34306 - DNA, 601 bp, Human
gacggagcagaacaattcaacaagcagtttggggctcctgttctgcaaggattgggccaagcatgctcaaaagtcagatccagctcccccactctacccttctatgactttcccagtgctagccacacttctctgcatccctgttgactttgtagagcagagtttctcaaacttgccactatgggcacttttgactggggaattatttgttgtgggggttgtcctgggcactttaggatgtttactggcatccctggcctctaggtgccagtaacacacacacacacacacacacacacaaacacaccaccagttctgacaaccaacaatgtctccagagattgccaaatggccccttagtgggcaaaatcactcccagttgagatccacgcctgtagagtactaactcaacaggattctgatctgaaagaatatactacacattgattctagctggttttcttccaagtatttcaggagcaggctaagtacagacccaggtgactctttctctgtaggagtctttaaccaccgtgttctgtgatggcttcttcctcctcagagcaagttccaaaacaggatttctccaggtatcatccag

SEQ ID NO: 34307 - DNA, 601 bp, Human
ttcccagtgctagccacacttctctgcatccctgttgactttgtagagcagagtttctcaaacttgccactatgggcacttttgactggggaattatttgttgtgggggttgtcctgggcactttaggatgtttactggcatccctggcctctaggtgccagtaacacacacacacacacacacacacacacacacaccaccagttctgacaaccaacaatgtctccagagattgccaaatggccccttagtgggcaaaatcactcccagttgagatccacgcctgtagagtactaactcracaggattctgatctgaaagaatatactacacattgattctagctggttttcttccaagtatttcaggagcaggctaagtacagacccaggtgactctttctctgtaggagtctttaaccaccgtgttctgtgatggcttcttcctcctcagagcaagttccaaaacaggatttctccaggtatcatccagtctcagaatcacctgagctattgctaaaaatacaaatttctgggccccacccttgacttagtggatcagaatctccaatgctttaggctaaaaatttgcattctaacaa

SEQ ID NO: 34308 - DNA, 601 bp, Human
agttccaaaacaggatttctccaggtatcatccagtctcagaatcacctgagctattgctaaaaatacaaatttctgggccccacccttgacttagtggatcagaatctccaatgctttaggctaaaaatttgcattctaacaaactccagtagcatttttttttctttgagacagtcccgttctgtcaccaaggctggagtgcagtacagcaatctcagctcactgcagccttgacttcccaggcccaagcaatcctctcacctcagcctcccaagtagctagaactgtaggcatgcacyaccacaccccactaacatttttatttttgtagagctgaggtctccctatgttgcccaggctgctctcaaactcctgggctcaaaggcgcctccctccttggcctcctaaagtactgggattataggcgggagccaccatgcccagcacagtagcaatttttatagaatactccagaagtttgcaacttcattgttcttaaggcagccctccctatctatggaagttacctatcattttttataatcagtaacattgcaggtgtgaaaaagtagttcccttcctctccctgctgaggtcat

SEQ ID NO: 34309 - DNA, 601 bp, Human
atttgcattctaacaaactccagtagcatttttttttctttgagacagtcccgttctgtcaccaaggctggagtgcagtacagcaatctcagctcactgcagccttgacttcccaggcccaagcaatcctctcacctcagcctcccaagtagctagaactgtaggcatgcaccaccacaccccactaacatttttatttttgtagagctgaggtctccctatgttgcccaggctgctctcaaactcctgggctcaaaggcgcctccctccttggcctcctaaagtactgggattataggcrggagccaccatgcccagcacagtagcaatttttatagaatactccagaagtttgcaacttcattgttcttaaggcagccctccctatctatggaagttacctatcattttttataatcagtaacattgcaggtgtgaaaaagtagttcccttcctctccctgctgaggtcattctgtcagcaactaggttccatgtgttaagcatctctgagcaaaagctaaatgaaaaagccatgctcagaaaaaccacggcgtgagcatcactaggggccagtgtcacctcctgtgactaataggtgg

SEQ ID NO: 34310 - DNA, 601 bp, Human
gttatctaaccgtgttgttttggacacattactcaaccacatcataaaatgcaaaggttgaattatattcatgatttgcaaacccaggcaaatatcggaattacctgaactttgtaaaattaagtttttaattcctttgtaaaaataagttttaatccctgcttctattcttcagagatttagttgagtcttgaaattctgttttgtttttttctgagtaggagtttcactcttgttgcccaggctggagtgcagtggtacagtctcggttcaccacaacctccgcctcccaggttgaagygattctcctgcctcagcctcctgagtagctgggattacaggcatgcaccaccacgcccagcttattttttgtattttaagtagagacagggtttctccatgttggtctggctggtctcaaactcccaacctcagatgatccgcccgcctcagcctcccaaagtgctgggattataggcatgagccactgcgcctagccgaaattctgtttttaaaagctctgcaggtgattgggactcacatccaggtgtgggaccctttagaccaggtgtgggctctgtctccaaagaaaaaaaaaaaa

SEQ ID NO: 34311 - DNA, 601 bp, Human
cccaggttgaagtgattctcctgcctcagcctcctgagtagctgggattacaggcatgcaccaccacgcccagcttattttttgtattttaagtagagacagggtttctccatgttggtctggctggtctcaaactcccaacctcagatgatccgcccgcctcagcctcccaaagtgctgggattataggcatgagccactgcgcctagccgaaattctgtttttaaaagctctgcaggtgattgggactcacatccaggtgtgggaccctttagaccaggtgtgggctctgtctccaaagaaaaaaaaaaaagaataaaagaatcctggaatcctggactaatgggacagataagtaatcagataagcaaagggtggcagcagggtgacaggagctgcctgcaacagtgcgcatgctaagcactaggggcgtcccagtcctggttgcaactagctgcgacccctgttcttccagggactctttctcacctcttttcattcccttcttttatactctcagctaaatatagagtgacttcttgattaattcatctcagttcaactaacctctactggaaccctactctttactggaaggaga

SEQ ID NO: 34312 - DNA, 601 bp, Human
gcatgcaccaccacgcccagcttattttttgtattttaagtagagacagggtttctccatgttggtctggctggtctcaaactcccaacctcagatgatccgcccgcctcagcctcccaaagtgctgggattataggcatgagccactgcgcctagccgaaattctgtttttaaaagctctgcaggtgattgggactcacatccaggtgtgggaccctttagaccaggtgtgggctctgtctccaaagaaaaaaaaaaaagaataaaagaatcctggaatcctggactaatgggacagatragtaatcagataagcaaagggtggcagcagggtgacaggagctgcctgcaacagtgcgcatgctaagcactaggggcgtcccagtcctggttgcaactagctgcgacccctgttcttccagggactctttctcacctcttttcattcccttcttttatactctcagctaaatatagagtgacttcttgattaattcatctcagttcaactaacctctactggaaccctactctttactggaaggagaagattcctgcaagggattcacacatgagtaagatgtggtccctaacttgtcat

SEQ ID NO: 34313 - DNA, 601 bp, Human
cagggtttctccatgttggtctggctggtctcaaactcccaacctcagatgatccgcccgcctcagcctcccaaagtgctgggattataggcatgagccactgcgcctagccgaaattctgtttttaaaagctctgcaggtgattgggactcacatccaggtgtgggaccctttagaccaggtgtgggctctgtctccaaagaaaaaaaaaaaagaataaaagaatcctggaatcctggactaatgggacagataagtaatcagataagcaaagggtggcagcagggtgacaggagctgcctgcaacagtgcgcatgctaagcactaggggcgtcccagtcctggttgcaactagctgcgacccctgttcttccagggactctttctcacctcttttcattcccttcttttatactctcagctaaatatagagtgacttcttgattaattcatctcagttcaactaacctctactggaaccctactctttactggaaggagaagattcctgcaagggattcacacatgagtaagatgtggtccctaacttgtcatattccgccttagaaggtattgcaatttaatgacataaagcattaaa

SEQ ID NO: 34314 - DNA, 601 bp, Human
ctgtttttaaaagctctgcaggtgattgggactcacatccaggtgtgggaccctttagaccaggtgtgggctctgtctccaaagaaaaaaaaaaaagaataaaagaatcctggaatcctggactaatgggacagataagtaatcagataagcaaagggtggcagcagggtgacaggagctgcctgcaacagtgcgcatgctaagcactaggggcgtcccagtcctggttgcaactagctgcgacccctgttcttccagggactctttctcacctcttttcattcccttcttttatactctyagctaaatatagagtgacttcttgattaattcatctcagttcaactaacctctactggaaccctactctttactggaaggagaagattcctgcaagggattcacacatgagtaagatgtggtccctaacttgtcatattccgccttagaaggtattgcaatttaatgacataaagcattaaaatttccacaagaggaatacaaagttctgtgggaagacagaggcaggagagagtgattcttgccagggaactagaagttatcagagaggggcagcactggagcttgtctgggtcccaaa

SEQ ID NO: 34315 - DNA, 601 bp, Human
agacctagatggtgggctggaccaggtggtagagggatttgaatgctttgctcaagagtttggagctgttttatggatatgataaacaattagacagctgtgagcaaggtaatgacatgattagttactcttcaggaagagtatcctgccaggggtaccacactgatgacagtggcaaagaccagagatgcggagatcagttagggacccacttcacctaagaggcacttaggcggtggtagagggagtgggaggaggggcagaactgtagactggcaggatgggggcagtgagagaggasgaaaagatatgcccagggtttgaaatctgagtcaactggggagtgaggtgccactcagagacagggaccgagaggccaagcagaaggacaaatatatcagataagaatgaaattcacctgctagtaacaaacatctaaagtgacagcggctgaaatcaatagattcagttcctcacaaggagtgagaagggaacagcccagggctgcagtggcagctccagtctcctctctcttctctgccagtcggcagcttctagcccatgactcccatcctttgagtcgctgcatggtttctagatg

SEQ ID NO: 34316 - DNA, 601 bp, Human
gacagctgtgagcaaggtaatgacatgattagttactcttcaggaagagtatcctgccaggggtaccacactgatgacagtggcaaagaccagagatgcggagatcagttagggacccacttcacctaagaggcacttaggcggtggtagagggagtgggaggaggggcagaactgtagactggcaggatgggggcagtgagagaggaggaaaagatatgcccagggtttgaaatctgagtcaactggggagtgaggtgccactcagagacagggaccgagaggccaagcagaaggacaartatatcagataagaatgaaattcacctgctagtaacaaacatctaaagtgacagcggctgaaatcaatagattcagttcctcacaaggagtgagaagggaacagcccagggctgcagtggcagctccagtctcctctctcttctctgccagtcggcagcttctagcccatgactcccatcctttgagtcgctgcatggtttctagatggcaaacacaatgtcagcccaaatgtccacattccaaacagaaagttggaggaagaggaaaacggaatgttcttcccacttaagtcagtctcc

SEQ ID NO: 34317 - DNA, 601 bp, Human
ccacttcacctaagaggcacttaggcggtggtagagggagtgggaggaggggcagaactgtagactggcaggatgggggcagtgagagaggaggaaaagatatgcccagggtttgaaatctgagtcaactggggagtgaggtgccactcagagacagggaccgagaggccaagcagaaggacaaatatatcagataagaatgaaattcacctgctagtaacaaacatctaaagtgacagcggctgaaatcaatagattcagttcctcacaaggagtgagaagggaacagcccagggctgcrgtggcagctccagtctcctctctcttctctgccagtcggcagcttctagcccatgactcccatcctttgagtcgctgcatggtttctagatggcaaacacaatgtcagcccaaatgtccacattccaaacagaaagttggaggaagaggaaaacggaatgttcttcccacttaagtcagtctcctactttcttggaaaccccatctgatgcccgatcaccttttttttctttttaggcaaagtctcactctgtcacccaggctggagtgcagtgacatgatagctcaccgcaacctccgc

SEQ ID NO: 34318 - DNA, 601 bp, Human
acatctaaagtgacagcggctgaaatcaatagattcagttcctcacaaggagtgagaagggaacagcccagggctgcagtggcagctccagtctcctctctcttctctgccagtcggcagcttctagcccatgactcccatcctttgagtcgctgcatggtttctagatggcaaacacaatgtcagcccaaatgtccacattccaaacagaaagttggaggaagaggaaaacggaatgttcttcccacttaagtcagtctcctactttcttggaaaccccatctgatgcccgatcaccttttttttctttttaggcaaagtctcactctgtcacccaggctggagtgcagtgacatgatagctcaccgcaacctccgcctcccaggttcaagcaactcttttgcttcagcctccccagtagctgggattacaggcacccatcaccacacccgtctaatttttgtatttttagcagagatgggtttttgccatgttggccaggctggtctcaaactcctggcctcaagtgatccgcctgctttggcctcccaaagttctgggattacgtttccttttttttttttttttttttgagacggag

SEQ ID NO: 34319 - DNA, 601 bp, Human
atttttgtatttttagcagagatgggtttttgccatgttggccaggctggtctcaaactcctggcctcaagtgatccgcctgctttggcctcccaaagttctgggattacgtttccttttttttttttttttttttgagacggagtctcgttctgtcgcccagcgtcaagtgcagtggcacgatctcggttcactgcaagctccgcctcccgggttcacgccattctcctgcttcagcctcctgagtagctgggactacaggcgcccgccaccacgcccagctaattttttttttttttttgtatttttagtagagatggggtttcaccatgttagccaggatggtctcgatctcctgacctcgtgatccacccgcctcggcctcccaaagtgctgggattacaggcgtgcgccaccgcacccggcctacacttccatttttatgtcgtcagctacttatggctccaaggaagcttgggaaacatatacgttgcctttaggaataaaacagtgttctgtgcataaggagaaggggagatgaataagggccagttgcagcctctgccccagaaggtgacctggaagccaggcaggagctcca

SEQ ID NO: 34320 - DNA, 601 bp, Human
agtagctgggactacaggcgcccgccaccacgcccagctaattttttttttttttttgtatttttagtagagatggggtttcaccatgttagccaggatggtctcgatctcctgacctcgtgatccacccgcctcggcctcccaaagtgctgggattacaggcgtgcgccaccgcacccggcctacacttccatttttatgtcgtcagctacttatggctccaaggaagcttgggaaacatatacgttgcctttaggaataaaacagtgttctgtgcataaggagaaggggagatgaatamgggccagttgcagcctctgccccagaaggtgacctggaagccaggcaggagctccacgctatgatgaggagctctgcctactgagtcacagcagtaaggtcaggttgaagtggggtttccagccggctaaggccagaaacctggactgaaattaggggtgaagccaaaacagcaaataggaagaaaagctgggggcagaggcttccaggagacccaatcagaaccaagaacgtgggaggtggggggccaaggtcagaaccagccaagagggggtggagaaacatcgtggtccagctggtg

SEQ ID NO: 34321 - DNA, 601 bp, Human
gtgcataaggagaaggggagatgaataagggccagttgcagcctctgccccagaaggtgacctggaagccaggcaggagctccacgctatgatgaggagctctgcctactgagtcacagcagtaaggtcaggttgaagtggggtttccagccggctaaggccagaaacctggactgaaattaggggtgaagccaaaacagcaaataggaagaaaagctgggggcagaggcttccaggagacccaatcagaaccaagaacgtgggaggtggggggccaaggtcagaaccagccaagaggggstggagaaacatcgtggtccagctggtggctagaagtcagggttggcaggagaggcagagcagagtgttcctaggagccgagcgggtctgctgggctctggtctgatgatggcatctctccccacacctggaactggatcacaggttcagccccgcacgtccagccggcctaccaccccacagggtcttgaccccatttgctataaatgatacacagatagtgacgactgctgtacgcgggatgaaaaattaacaacacctaggtagatctttacatggtgaccttaaaataaacctgcag

SEQ ID NO: 34322 - DNA, 601 bp, Human
tatacaagtccacatgtctcataatatacatcaaataccctaactgattgcctgttcattcaaaacccaactttccttaggatatcaaccaatacatcactttgagtggcattggcaacctagcacagtagaattttctgaaaatttaggaaactcccaaccatcaaggctatgtgccttaatttgtatatgggaatatgatcatctgcagagtcccatacgtctccttaaatagctaagaaacttgccatattcatccattttgcattgctacgaaggaatacctgaggctgggtacttyataaacaaagtttatttggctcacgttctgcagtctatacaagaagcatggcacccgcatctgcttctggtgaggccctcggggagcttttactcatggcagaaggcaaggggagctggcgtgccacatggcaagagggggcaagagggggaaaaggggaggtcccagcctctttaacaaccagatctcccacgaactcattaccatagggtgggcacaaaggcattcctgaaggatccacccccatgacccaaacaccacccactaggcccacctccaacattagggatcacatctcaa

SEQ ID NO: 34323 - DNA, 601 bp, Human
ttgaaaatcaggcccattaacaggaatccatttattttttaaaaaatgatttgagcctctatccaggcaattggtttttctaatcttctattatgcttccaactgagaggcactgaaacaaagccagtaaggagcttctgtctgtggctctgctcaaatgtcaagttctggatggaaactggaaacattaaccagctcatttgggtattattgatgactctcctttctccttctgcaaccatctctctgcttcttttcccccaacatgcacagttggtgagttccaatatggatatttatragtctataacagccggcttcaaccttgttttcatccacatacacacaccccaacctgccctacacatgatggagatgtctccatcttgggggactcttgttaccaatgctgtccttgacttctaagatacctaatactaatagacatggagaaggctgggaagaagtggggccaccttacactggaatgggataaagaaccctattcagggccgggcgcggtagctcatgcctataatcccagtgctttgggatgccgaggctggtggatcacctgaggtcagaagtttgagaccagcct

SEQ ID NO: 34324 - DNA, 601 bp, Human
tccccgggaaggggcttgccactgtgcctatcgagtcacagcctacagacctcccgtttagtctattagtccagccagtagacccggggctgggggagcagatgtgcggagatgctgaggacccctctggctacgttaggaacgatttacttgggttgatagcttttctttgcctccctttcactgcttccgtctctagggggaatagaaaagggtcagaaaaaccatcaggtttgccattttttaaccatttctgtctccccaggcgtccaggtgatcccccaaacagcatgtgctcagmcccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgta

SEQ ID NO: 34325 - DNA, 601 bp, Human
ggatgttgccttttctctttgaagccgacagtttggcttctttaatgtgagaccggggtgtgttttcctccagtggagccaccgcttgagctgaggctgtttcctgggctttttaaaggcctgggttcccgctgcgtgggccgcgtcatcacatcctcccacctcaggcaccggtgcaacgtttctgcagccaggccgcctgtcaccccactgtgcgcgccccagcggccccggcccagagcgctccacactcggagctagccagctgggacagagcaacagcgcagcgcgggcagccacrgcctgcaccggccccgcggggacctgctgtgtgtgggtgtgaaggtggtgtggggcaagctgtgggaaccccgtgtcaagccctccccaggccagtgatgagcccaaaagctcctctggaaaacgttgatctttgcacggcgcccatgcaggcttccaggccaccagggcatgggcaggactcagcccgccatgggcgcctgctcagcgggaaatgcgattcccaggggtcactggttctcaactgggaggaaacacctgtcatctcttcaagcctcagtaaacaacctcctcattcttt

SEQ ID NO: 34326 - DNA, 601 bp, Human
tcctacccttcccgcgtctccccccacccaaaccccagaaccatcctgctccttaaaacccctgctcgggtctccgctttccttccccccactccccactcccccgaatgctcccccccttctcccctaccctatactccaatccccacacccagcaccccagtcctcaaggctaggggacagcaaaggcaggaaaatcagagaatgggtggaggaaagagagcgagaagggactccccaaatgcaggcaggataacggacactccaaatccgaggggaggcaagcagaggaaagcccccyaaaaatgcctcctcagctccccattctgtcccgcccgacacctcccagccccctcagtaagtggcagagaatttcatccgcttctgcttctgtctctggttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcaggcttgttcattttctcgcgctgggcg

SEQ ID NO: 34327 - DNA, 601 bp, Human
ttaaccaatccttgtcactgaacattaaggctgctttcacactgtccctattacaggatatgttgcagtccccatctttctgaaaataacccttaacgtatccaacagccacaaagcatgaacaacctaacaataatcgtttttcgtcctcatctaagcaacagtttaaagcacattacgtgcaatggcatagaaagtgtgaacaaagaaaatgatattaaggaggggggctgtagaagggatagagggcaaaaggatggttttgcatcttcctcaccgcagtaaaccaatgaggtattasacatttcctgccatgtcaagtcttgcctataatcttccttgtctttttcaggaagtgaataagaagatgacagtgtttcaaatgccttgaaacataatgtgatcatgctctaacttcaatataccaataaaataatcagcttgcaatttctgattatagcatctccttctgagtgtttgggactctggaatctgagacccatgttcacattgtaagaacatccaggaccccttctccttgatgtttccagcaagcttctttcctccttatccttattaagtcatctgcctggggaaggag

SEQ ID NO: 34328 - DNA, 601 bp, Human
ctggttcccatcaccagcagagggttgagattgctgtcctcccaaaggtggtccctgacgctcctcatctatgaactgctcagagtctcctccatctgtgtgagttgaaacaagaagagctgagctcatgctggaaaaccctcctgtcttcatacctctctgtcttcaccacacggccggcccctctctgcctgacctgcctctcaactcccaacctccccccttcccaaggcttcctaattagaactcctcttaatccacataagggtgatgaaaaatcgaatttctttactcatggtcyccagaatcaaggttgggagaaaactgtttatatctttggggcattggtattagccaattcctgacaagaaaatggtgataagaagacactggagaactcatcaatttttcagggaaaaatggagacagagtttactgagaatttattgggatttacctgatattacgaggggaacatcttcctggctgacatctagaaaagaagtacaggatgatgggaaaagttacttcctgaatcattcaaggctcatagtgttctacgaggataaaggacctctgatcacaccctgtgcatcccctt

SEQ ID NO: 34329 - DNA, 601 bp, Human
tatctgaataacaatttttagaaatgtgttccaggacagggcaatattaacaggttttcagaggattcattggcacaatgaagttggagaactgtagcagttggagcctttgatggataataaactggaatcgtacctgtcattgaatcctagattactgaggagactgcccctgtggaggtccttgtgggcggcccccttggggaggtggtccctggggctttccaggaggaggtgggggaggaccttgctgatggcctccctgttggggtggtccttgtggccttcctcgaggaggacrgggatggcctccctgttggggtggtccttgtggccttccttgaggaggagggggatggcctccctgttggggtggtccttgtggctttccctgaggaggtggtggaccttgttgctgctggcctccttgttggggtggtccctgctgagggccatcattctggttcccatcaccagcagagggttgagattgctgtcctcccaaaggtggtccctgacgctcctcatctatgaactgctcagagtctcctccatctgtgtgagttgaaacaagaagagctgagctcatgctggaaaaccc

SEQ ID NO: 34330 - DNA, 601 bp, Human
atattttctttgttcactctttaagccattgcacataatgtgatttaaagtgttgcttagatgagaaagagaaacaattattgttatgtgttcatgctttgctgctgttggttatgtaagggctatttttacaaagatgggcactgcaacatatcatataatagtgagaatgtgaatcccgccttaatatccagtgacagggattggttaaatagattacggaacaaccaaacaatagaatagtatacaattgtaaaaacaaactaaccagtaaacactgaagagatctaaatgaactcakgagaaagttttctaaacaataaatttttccagtgagtaagacacaaatctgaatatacagtatggtataagtgcttgtaataaaagcattatatatatttatgtagcaatatatatttcaaaaagtagattccaaagagtaaaaggtgggggttttgagaaggatagaagggaggaaagatgagttaggctcttactatttagctctgtacatttcggttcagtgagattagtttttgttagcttaagcatgtatgactttaaatgtaagtatactaaaaatgagataccattttacaac

SEQ ID NO: 34331 - DNA, 601 bp, Human
atcccttctacagcccccttctccttagtaatattttctttgttcactctttaagccattgcacataatgtgatttaaagtgttgcttagatgagaaagagaaacaattattgttatgtgttcatgctttgctgctgttggttatgtaagggctatttttacaaagatgggcactgcaacatatcatataatagtgagaatgtgaatcccgccttaatatccagtgacagggattggttaaatagattacggaacaaccaaacaatagaatagtatacaattgtaaaaacaaactaaccartaaacactgaagagatctaaatgaactcaggagaaagttttctaaacaataaatttttccagtgagtaagacacaaatctgaatatacagtatggtataagtgcttgtaataaaagcattatatatatttatgtagcaatatatatttcaaaaagtagattccaaagagtaaaaggtgggggttttgagaaggatagaagggaggaaagatgagttaggctcttactatttagctctgtacatttcggttcagtgagattagtttttgttagcttaagcatgtatgactttaaatgtaag

SEQ ID NO: 34332 - DNA, 601 bp, Human
tacagacaacacttgacatggcaggaaatgtctaatccctcactgggggttactgcagtgatggagatgcaagcccctactcttgccctctatcccttctacagcccccttctccttagtaatattttctttgttcactctttaagccattgcacataatgtgatttaaagtgttgcttagatgagaaagagaaacaattattgttatgtgttcatgctttgctgctgttggttatgtaagggctatttttacaaagatgggcactgcaacatatcatataatagtgagaatgtgaatccmgccttaatatccagtgacagggattggttaaatagattacggaacaaccaaacaatagaatagtatacaattgtaaaaacaaactaaccagtaaacactgaagagatctaaatgaactcaggagaaagttttctaaacaataaatttttccagtgagtaagacacaaatctgaatatacagtatggtataagtgcttgtaataaaagcattatatatatttatgtagcaatatatatttcaaaaagtagattccaaagagtaaaaggtgggggttttgagaaggatagaagggaggaaag

SEQ ID NO: 34333 - DNA, 601 bp, Human
gttacaaatacaaaacattgaggtttcatttaaaaagcaggttcatcatatttcacaatgagttaataatattcaaactaaatttcttctattgtggctaagcagtggcagtagcctgacaatgcgtttggggcaaattatcttccaagataccttattgtccaatccctaacagtggctagattagaaacactctaggtagacaaaggaggagctgtgtgggtagaaacctcccccaggaatccagccacatcccaggacacattgtaggactgaagtcttttctgtagtgtccgcagayttgttttatggcaaccccaacttccagacaaaaagcatttccagtaaccctctaacagttccacagatgggacataatactttgcctaatactttaagagtaggtaattttggtctttttacctggaactaggctggaaataatagatttggcttggtaaatgaggggttaaattaaggatcactgagttaatcaccttcttccacaagttctggtctaaatgtccaaatctatttacaacttgtgactagtatagtaggtcatttgtttataacatgtgacttgtttctattttggtcc

SEQ ID NO: 34334 - DNA, 601 bp, Human
gcacttgacgtggtggacctttgcctgcttgatggcaccccggcgctgatgcaaagcaaagaagccttccgtctcaaattcattcatgtcctttgtgtctacaggaagagagaggggaagaaagtgaagttctgcaaaaggacgactcctattctaagctgggtcaggaggggagggagatgggcaagggatggaggaggaccagctctgagtacctgctgtaacattccaggtactcattatggtgggtaccacactaagcatctttcctcaaattctacaacacagattcatcataggrcatattgttagagggtgaaaacaatgttggattgctggctcaatccttcgctcctctttgactgggctgagcgatatatcctcttcaagtttcaaaaccagagattagaactttgaagggatctatcaacctctctttgtcaccatcaatgatgactcagtcagaaaaggcaggaagtggcaaaggctttcctgtctgtaattctagagaatcacatggttactgacagcctcttgggaacagcatttcagaggtgccaggatgctttatagcaggttgttggagacatgctggagtaga

SEQ ID NO: 34335 - DNA, 601 bp, Human
atggtgaaaccgcatctctactaaaaatacgaaaattagccaggcgtggtggcatatgcccgtaatcccagctactcaggaggctgaggcaggagaatctcttgatcctggaaggtggaagttgcagtgaaccaagatgacaccactgcactccagcctgggtaaacagagtaagattccatctcaaaaaaaaaaaaaaaattgaaaaaagaaatctgcacttgtacctcctaaatacatataaatttttaaaaatttaaaattcataatgatacactgcccatgtgctagcccagtttcmcccctccattaggtaaaatgtaatttgtcttccgattatacctcaacgtttactctaaaagaaatatttgcttctcaacataaaattatgcctctgttattatctctaaccttgtaaatgccatgttgctgtatcttatcatcatttgcctttatttactcttttactgtcacttctagctgggggtgccacaaggattattctcatataattaatctaaactatgctttctggccactttctatgccatttttctggaaaagtagagcaatgaaaattcttcctgtatataatttgtgt

SEQ ID NO: 34336 - DNA, 601 bp, Human
tctactacagcatcccaaagtgggctttctactacaagttgcacaaaatacaatcatttttccaggctccaaagaaaccccgcatgacccaggccttggtgccttccccagtgtgggcttccagtctgcgcagcccttgcagctgtcaccacactggtcccatttcagttcctggaacacgttggactctccctcagcagggtcttccagcctgtaaggagcttccttcctcctgctcttcacctaaccagctctgtcactcttcagctgtcagtttcaatgttccctccgttggggagaytcccggaccacagagtctcagtaggccacatgcttactctccaccttgcaccttgttcactatctttgtagcacttaatataaatcgaagccatacatagctgtttattatctgtttctccaacttcgcaggaccacgtctgttttgtgttatgctgtcattggaagaatgcggtatcttccatgaatcagatacccagtgaggatttgtggaatgaaaaaggaaacggtgggagaaggaagtcaaaagatttcataatgagtgacagagtggagtaatagacattggagactacagatg

SEQ ID NO: 34337 - DNA, 601 bp, Human
ctgcggcatcatccttatatccacctctttcatctaatcttttggcaaatccagtcatttctaacatcaaaatcacctgagaacctgcccctttgctccacctctgctgacgtctcactggtataaaccaccaacctccccgcttggaggattccttccatctcctctggtttcactttcacatctcaacgcactatttctactacagcatcccaaagtgggctttctactacaagttgcacaaaatacaatcatttttccaggctccaaagaaaccccgcatgacccaggccttggtgcmttccccagtgtgggcttccagtctgcgcagcccttgcagctgtcaccacactggtcccatttcagttcctggaacacgttggactctccctcagcagggtcttccagcctgtaaggagcttccttcctcctgctcttcacctaaccagctctgtcactcttcagctgtcagtttcaatgttccctccgttggggagattcccggaccacagagtctcagtaggccacatgcttactctccaccttgcaccttgttcactatctttgtagcacttaatataaatcgaagccatacatagct

SEQ ID NO: 34338 - DNA, 601 bp, Human
aattatctcatagatcttcctttttcctcgaaggcacttgttgctttctcttttccttcctccagccatcaaactccatgggggacacatgcagtctaagggaagcgcctttgtgtgcccatcaccaaagctccacacctatccccatcagcaactgtcttgccctactcccttccggttaaactgtggaagctccagggaccagtctccaccagagctcaggccctcttcgcttcctgccaacagacttgactgttttgtttatctgtctctccagctttatccatctctccctggccaygggagcacttgccatccttggggtctcatttcccagccactgttctctgtccatcatctccttcatggttcaccttcttcataatatcaacttacaggttgttttcatgtcatcacctcagtcacccttcatgcaggtcaatcagactaatgcctccaagatgcccctgacatttctctgatttaagcctgtgaagatctgcacgtgggcctcaatttcaacacctcaactgcacagaacacaacccacctcttcttcttctggtttctgtaacttcatagactctgggtgtaggaggag

SEQ ID NO: 34339 - DNA, 601 bp, Human
caatgagctacatggggctggcgaacacttgaaaggtggtgagttagagttgagatgtgctggacgtgtaaaataatacatcctggagtttgaagacttttgtataaaattacttaagatatctgaatttttcaaatgtcgattttttgttgaaatgatatttgaacagattggattaaataaaatgtattattaaaattaatttcacccattgctttttcctttatttaatgtgggctacttggaaatgtaaaattacacatgtagccctcattctatttatttctatcggacaatactrctccaggggtagaggaacaaaagaatcccaaagatgatgtccccttgagtgaacaagaaatcaaaatatcctgggagaagataatatcacagacatttatttatgtagctgacagtttctcaagactttgtaccaggaactttgttagtcattgaggttaacagtgattcagagatttgcgtttttttctagaaaagctgaaggcatcaagtaaaggaagaagtctgggaggtgaaaatttgatctaagcaagcaaaaacatggtctgagagattgtgatcttaattttagtaccagctc

SEQ ID NO: 34340 - DNA, 601 bp, Human
aagaaaaaaataattttcgggactcacttatattccacagtttaaatatggacaattaataggtcaaggtccaggctggaaggggaccacttcgaatcttgaatgcaggggcaaacagctcaagacaccatggctgatgaagacgctatgtacacgctttccagtatgaaaaccaatgagctacatggggctggcgaacacttgaaaggtggtgagttagagttgagatgtgctggacgtgtaaaataatacatcctggagtttgaagacttttgtataaaattacttaagatatctgaatttttcaaatgtcgattttttgttgaaatgatatttgaacagattggattaaataaaatgtattattaaaattaatttcacccattgctttttcctttatttaatgtgggctacttggaaatgtaaaattacacatgtagccctcattctatttatttctatcggacaatactgctccaggggtagaggaacaaaagaatcccaaagatgatgtccccttgagtgaacaagaaatcaaaatatcctgggagaagataatatcacagacatttatttatgtagctgacagtttctcaagact

SEQ ID NO: 34341 - DNA, 601 bp, Human
agggagcagttcctgccaggtgcggttaacaaatatgtcacacgcatcatctattacataggtgatatctcacgtaatcctcagaataccccttttgaagtcgcttctattagtatcctcctttgacagacgaggaaatgaagcacagagaaggtaagaaacttgcccaggacacgcagctctagagctgggatatctataagcttggcagtcagaatcagagcccagccattctcttttctgtctcaaaataaatgtgaaggcttatcggggtagggagaggggagtgggagagggatgytagtgatcgacatggaatttttttaaaaaacagttttccagagtttaaatcaaacttattgcaggaacaacaaaacacttggatagttggattcctggtaagaatgtcaatattcttgtgcaggataaaatgctttattttctaaaggtttataatctctgcagaagtttctaattcaacagttcctttgggaaggtgcatagcaaagatgccttattcatcagcacagcaatagatctaacgttcccgccaggggtactggtcagcgttggttctttagaaagcctgtgtagaatcgat

SEQ ID NO: 34342 - DNA, 601 bp, Human
attattcatgaactgaggtggcaagaggagggagcagttcctgccaggtgcggttaacaaatatgtcacacgcatcatctattacataggtgatatctcacgtaatcctcagaataccccttttgaagtcgcttctattagtatcctcctttgacagacgaggaaatgaagcacagagaaggtaagaaacttgcccaggacacgcagctctagagctgggatatctataagcttggcagtcagaatcagagcccagccattctcttttctgtctcaaaataaatgtgaaggcttatcgggrtagggagaggggagtgggagagggatgctagtgatcgacatggaatttttttaaaaaacagttttccagagtttaaatcaaacttattgcaggaacaacaaaacacttggatagttggattcctggtaagaatgtcaatattcttgtgcaggataaaatgctttattttctaaaggtttataatctctgcagaagtttctaattcaacagttcctttgggaaggtgcatagcaaagatgccttattcatcagcacagcaatagatctaacgttcccgccaggggtactggtcagcgttgg

SEQ ID NO: 34343 - DNA, 601 bp, Human
agtgctaaggaaacagtgctcccatttaaatagatgaagattcccttcctgttttactataaatatttccttttctctttcagtccagaactagtgcttttaacctttggaagatgtaaaaaaaaaaaaaaaaaatgccttctttaaaggaaacatttctatgggtttatcagtattactgcctaatgtgagaagcattttcacacctattattcatgaactgaggtggcaagaggagggagcagttcctgccaggtgcggttaacaaatatgtcacacgcatcatctattacataggtgrtatctcacgtaatcctcagaataccccttttgaagtcgcttctattagtatcctcctttgacagacgaggaaatgaagcacagagaaggtaagaaacttgcccaggacacgcagctctagagctgggatatctataagcttggcagtcagaatcagagcccagccattctcttttctgtctcaaaataaatgtgaaggcttatcggggtagggagaggggagtgggagagggatgctagtgatcgacatggaatttttttaaaaaacagttttccagagtttaaatcaaacttattgcag

SEQ ID NO: 34344 - DNA, 601 bp, Human
ctagggggtccacgtcgggccatgctcatcccccactggactcaccatcacacttgagtccttgccgtgccagtccccacagcagggtcccacagtgttcacagaaggtcgggctcttgtaattgtagactttaaatctgtgtggcatgtcaattttgaatctctccttgtggaactgaaagaaaggcagaaggtgaaatctgtgtattcctggggccccgactttggatgttcttgcagataccttagcataactaacagagatcataatgaaaacactggcattgtgtgcattttaaaycatcattgtcacttgtcaagccctacagtcatgcctgaagaaggcaggcagcctcagcaactgtacgtgacggggcatgcttgccttctgcatgtagcaagaaccttgcagacagctgaaatctgaggcattcacacagacaggctaaaagctcaggaagactgcatgagggttattttaaaaagtgctaaggaaacagtgctcccatttaaatagatgaagattcccttcctgttttactataaatatttccttttctctttcagtccagaactagtgcttttaacctttggaagatgt

SEQ ID NO: 34345 - DNA, 601 bp, Human
cccagaaagccttgctccatcccctagggggtccacgtcgggccatgctcatcccccactggactcaccatcacacttgagtccttgccgtgccagtccccacagcagggtcccacagtgttcacagaaggtcgggctcttgtaattgtagactttaaatctgtgtggcatgtcaattttgaatctctccttgtggaactgaaagaaaggcagaaggtgaaatctgtgtattcctggggccccgactttggatgttcttgcagataccttagcataactaacagagatcataatgaaaacrctggcattgtgtgcattttaaaccatcattgtcacttgtcaagccctacagtcatgcctgaagaaggcaggcagcctcagcaactgtacgtgacggggcatgcttgccttctgcatgtagcaagaaccttgcagacagctgaaatctgaggcattcacacagacaggctaaaagctcaggaagactgcatgagggttattttaaaaagtgctaaggaaacagtgctcccatttaaatagatgaagattcccttcctgttttactataaatatttccttttctctttcagtccagaactag

SEQ ID NO: 34346 - DNA, 601 bp, Human
tagaaagaccagtgagaggagaaacactgtcttcatttcccccagggctatggtacggcagaaggtgatggagctaggagtttgaccttgaacctgaactgttgtgctcttttctgggatgtgtgggtgggggtgttgcagggtgcaaggaaaggaacatagtggcttattgccccagaagaccatacttatgatcatgacttgtctgggctgggtgtggaagtggtaccccctacatcctccctccagttccccagaaagccttgctccatcccctagggggtccacgtcgggccatgcwcatcccccactggactcaccatcacacttgagtccttgccgtgccagtccccacagcagggtcccacagtgttcacagaaggtcgggctcttgtaattgtagactttaaatctgtgtggcatgtcaattttgaatctctccttgtggaactgaaagaaaggcagaaggtgaaatctgtgtattcctggggccccgactttggatgttcttgcagataccttagcataactaacagagatcataatgaaaacactggcattgtgtgcattttaaaccatcattgtcacttgtcaagcccta

SEQ ID NO: 34347 - DNA, 601 bp, Human
cttcttgcaagtggattctcgggctcccaggacagagaacccgacctgagaccatcacaggagaaccaagaggcgagaatttctcctgtttctgtggataccgtcaggatgcaggatgccgggacactacgttttgtctctgacctcctaatgaactcttaataccctgcctatccatgtcttcttgaacaggggtgtagagaaaagcgtgtcagtgtcctttggggccaggaacggattcttgaggctaatgttggcctcctgtgatgtctgctttaggtaatgatttgaaaacctaacycctcctgcctccactgagaggtcgctctgggttccaccagacatgtgaacaggattgggatgaagaaggggagaatgcggaagatgctgtgccgccttccatcacgtacctcattgctcaaaagagaggacatacattagtcagtagcactgatcaaaatagggctgccaagaaaaaataaagtggcttatatatttaatacttcatcataagaaaaggtctgtgctcaccaggcatggtgactcactcctgtaatcctagcacttttggaggctgaggagacaagatcgcttgaaccca

SEQ ID NO: 34348 - DNA, 601 bp, Human
gggtaaaaggctaaggaggccctacttaagacgacggcctgcaaggaggcaggatgaaagggaggcagagagggagggaagagagctggagaagagggcgagaagagtcgagaaaggaggacgcgggggcatgcggggtgagcggagcaggcggggtgagcacagtggaggggcagggacccgggagtgtcagaagcaagaatggaaaacaaaccagggcaggggagggagaggagaggggacaaaagaaaaaggggaggggagcacttgaaatgtaggtggtaggagagagcggggaacrgaatggagcggaaaggaaagagtattcgaggaaagaaatgaaacgaagcaggcagaagagccatgaaataacgcccaggaacccctgggaagttctaagctgtgccgcggcgctgctgggaccagctcttcttgcaagtggattctcgggctcccaggacagagaacccgacctgagaccatcacaggagaaccaagaggcgagaatttctcctgtttctgtggataccgtcaggatgcaggatgccgggacactacgttttgtctctgacctcctaatgaactcttaataccctgccta

SEQ ID NO: 34349 - DNA, 601 bp, Human
gagtttgagagcagcctggccaacatggtgaaacctcatctctactaaaaataataacaataaaaattagccaggtgtggtggtgcacatctgtaatcccagctactcaggaggctgaggcagaagaatcacttcaacttgggaggcggaggttgcagtgagctgagatcgtgccactgtactccagcctgggagacagagcgagactgtgtctcaaaaaaaaaaaaaaaaagaaacatcaccattaaaatacagaaaaatcagatataaagatttccaaactccagctgacagagtctgygagtagagagtgttgtaatagaagcaggcaccaggtgctatgacatcatgcagtcttaatcttatctgctgatttgcacatgtgtgtgcaaagaagcttagcacaatgactggcatcgagcaggcgctcaacaaatacaacttccttttcatcttcatcatttattgcatagatgtagatattaaaatatttaggtgaaatttgggcaaccctcacctgtagttttcactggtccactcttcttcaaatagctcaataataaaataaagcagaattttctatgtaaataactattacttt

SEQ ID NO: 34350 - DNA, 601 bp, Human
tgtaatcccagcactttgggaggccgaggcgggcagatcacctgaggtcaggagtttgagagcagcctggccaacatggtgaaacctcatctctactaaaaataataacaataaaaattagccaggtgtggtggtgcacatctgtaatcccagctactcaggaggctgaggcagaagaatcacttcaacttgggaggcggaggttgcagtgagctgagatcgtgccactgtactccagcctgggagacagagcgagactgtgtctcaaaaaaaaaaaaaaaaagaaacatcaccattaaartacagaaaaatcagatataaagatttccaaactccagctgacagagtctgcgagtagagagtgttgtaatagaagcaggcaccaggtgctatgacatcatgcagtcttaatcttatctgctgatttgcacatgtgtgtgcaaagaagcttagcacaatgactggcatcgagcaggcgctcaacaaatacaacttccttttcatcttcatcatttattgcatagatgtagatattaaaatatttaggtgaaatttgggcaaccctcacctgtagttttcactggtccactcttcttcaaat

SEQ ID NO: 34351 - DNA, 601 bp, Human
tcaccattaaaggccaggcgtggtggctcacacctgtaatcccagcactttgggaggccgaggcgggcagatcacctgaggtcaggagtttgagagcagcctggccaacatggtgaaacctcatctctactaaaaataataacaataaaaattagccaggtgtggtggtgcacatctgtaatcccagctactcaggaggctgaggcagaagaatcacttcaacttgggaggcggaggttgcagtgagctgagatcgtgccactgtactccagcctgggagacagagcgagactgtgtctcaaaaaaaaaaaaaaaaagaaacatcaccattaaaatacagaaaaatcagatataaagatttccaaactccagctgacagagtctgcgagtagagagtgttgtaatagaagcaggcaccaggtgctatgacatcatgcagtcttaatcttatctgctgatttgcacatgtgtgtgcaaagaagcttagcacaatgactggcatcgagcaggcgctcaacaaatacaacttccttttcatcttcatcatttattgcatagatgtagatattaaaatatttaggtgaaatttgggcaaccctca

SEQ ID NO: 34352 - DNA, 601 bp, Human
aaagacaattattagttttagaaattcaaattttgctaatgaaacatcaccattaaaggccaggcgtggtggctcacacctgtaatcccagcactttgggaggccgaggcgggcagatcacctgaggtcaggagtttgagagcagcctggccaacatggtgaaacctcatctctactaaaaataataacaataaaaattagccaggtgtggtggtgcacatctgtaatcccagctactcaggaggctgaggcagaagaatcacttcaacttgggaggcggaggttgcagtgagctgagatygtgccactgtactccagcctgggagacagagcgagactgtgtctcaaaaaaaaaaaaaaaaagaaacatcaccattaaaatacagaaaaatcagatataaagatttccaaactccagctgacagagtctgcgagtagagagtgttgtaatagaagcaggcaccaggtgctatgacatcatgcagtcttaatcttatctgctgatttgcacatgtgtgtgcaaagaagcttagcacaatgactggcatcgagcaggcgctcaacaaatacaacttccttttcatcttcatcatttattgca

SEQ ID NO: 34353 - DNA, 601 bp, Human
ggtgaagcagcagaagtgcatggacatccttgctgagcggccatggcgggaacgtgtccacggcacatgctcctacctgttgagtgctctcaatcatggccagcgcttcagccattagcttctggtttatgccacaaaggttggccacctttgtctggcatctatgatgcacattcatgccacatgctggaaggaagaaggcagatagtgagcaagagtggaagaaccccctggtgctaaacaactctctctggaggtaagacagagccttgcggatagggaggaaagcctaaagtgccayggctgggaggaagttgaccctggctctccctggtagtgatcctcgtgctggaagggaagtgaggtaggaggtgggactcaactctggaggtggggttcagacgccagaccaaattgaagactagctaaaacagggacagggcagaagcagctttccagaagatgcccacctgcgtgccatgtcagtttagtgttgccatggcaacacccagacgttaccaccctttttccaggaacttaatttgcatgtagttaaaagtggtataaataggattgcagcactgccctgagctgctactct

SEQ ID NO: 34354 - DNA, 601 bp, Human
aagggcattaggttagggttaattgagattaatgactgacagtgattagactgctgatcaggacagctacctctttttcccggtgtcggtaaacatggcggccttgcttcatttttgatggagcatgggagaccaatttcaaccggaccttctctgaagatctgttcagtatctcttaagcagcgagcctggatgacaaacagagagtcagaccacccacccacccaccattgatggaacagctcagcctgctaacgatggggacaaaggccatttaaaatgtttaaatgcatagggtcamcaaagatctccttatcctcaacgttcttttggaaccccatattctgggagagtctatctactgtattttatgcattagccgaacacgtttgcctccttcacacttttctggggctgacaggattctctcatgctgtctacatcattccatcacaaataaggacaggtagttaatggatgggaaaacagctgatacaggcaatgccaagtcttaaagagggtttatccttggatctaggaattcagctaatgccaaaacagtaaacagcaggccaaatttgccctggactcggtgttccat

SEQ ID NO: 34355 - DNA, 601 bp, Human
gaagccccatctctactaaaatacaaagaattagctgggtgcggttgtgtgcgcaagtagtcccaggtactcgggaagctgaggcaggagaatcccttgaacccacagggcagaggttacagtgagctgagattgtgccactgcattgtagcctgggccacagagcaagactctgtcttcaaaaaagaaaaaaaaaagatgctgcctatgttgatcattgctaagacatagtctccttgactgcctggcaacccctcctaaatgtaacccaaacctttcatttacatttttaagttgattkgaagtcagagaaaacataagagaaatttttaggaatttccccctgcctacaatagtctctatatttttaaatccctaggtttatctttcatactcttccaaggacactaagtattttagaatgtatgctgaaacgactcaggtctcagaaacatgggtcatatccactcatgaactgctttcaaacagtaggctggaaaaactgccataatgtcatgaaagtggctttgagtccttctctttcctacccttaaatttaagtctcaaaggtgcagagtaagaatgtcttctgtggccttcc

SEQ ID NO: 34356 - DNA, 601 bp, Human
atgctgaggctccatcatagtaattgggggtgtttagagggtttcctacagttcaggcagctttaatacctttccatctgtctgtgagggcagcaccccctgtctgtgagcctggcatttggattttggagtgtggactatgtctctttcttcaatagactgggaaatagttcaacttaagaaacaaattccaatcagtaaaagaccatatatgcaaaatacacaagcactgttaataatgccacatcaaggacatctagggattttaaccaaattttaggaaaaaaatgattttcaattstttgcatggctcacaaacacagtggcatcaatttctacaatttacagcgtgagagagacaggaaatgaaatctagcagatttttaaagatctgaactgcatcattcatcccagaattcaagtcaagatgctgcctacgttggccgggtatggtggctcacacatgtaatctgacaacttcgggaggccgaggtgggcggattgcctgagctcaggcatttgaggccagcctgggcgacatggtgaagccccatctctactaaaatacaaagaattagctgggtgcggttgtgtgcgcaag

SEQ ID NO: 34357 - DNA, 601 bp, Human
aaatgtggaaatccacatgggaacaaagaaagataaacatttcattaacaattaaaagtcctcttttagtaattgcttctttcagtaaaacaccctaaaaccagccataaactaagaagccaaaaagacaatttccatctatataatgtgctttcaatttttggtaacaggttataattgcacattaattgctgctaaattacaatgaagactggctgtaacattgcctattatgctcagattagcaccaaatgagcctactgtggttcatattattgtggaactgaacaaaaagaattcmtgaatatcagctaccatgtgctggacagagtcgattctgctgaaaggcaaggcatcagtgtttaaatccaaaccccaaatggagctcaatattattcagctgtggtgaccgctcagttgcattttagtttgtttaatattaaataaactgggtaagacatcctgccaaagtctggtgagcagttgtggtgtataatgctgcctttggctgcacagattcatagaacagtcatctctgattaaaattttcctgggagtcccatccaagaatgtaaaacaaataggagccccgttaatacat

SEQ ID NO: 34358 - DNA, 601 bp, Human
gatgaaacttagatgggaattcaggcaaatgaatgatgctcacatccccagagaacacacaatttgttttcttaggcttaaaagttgtttgagaacaagggtatagaggtcttggtgaggaaacatactttccacataaagccagaagagagagaaaagacaagttttggagtattctcagtgttgtgagaaagagaaacagccatcctgtcttgctttgatatctccccctcctctcctctccgtgtatagggacccagggtcctgatgaaaagaagtagacagctttggacatggagtrggggaaacctggggctcccagctgcaccttgggataccgactaaggcttgtaggtttaacttaatgtcttccttattaaccttattcaaatgtggaaatccacatgggaacaaagaaagataaacatttcattaacaattaaaagtcctcttttagtaattgcttctttcagtaaaacaccctaaaaccagccataaactaagaagccaaaaagacaatttccatctatataatgtgctttcaatttttggtaacaggttataattgcacattaattgctgctaaattacaatgaagact

SEQ ID NO: 34359 - DNA, 601 bp, Human
aagtcaggtaagatgagacctgggaaagtagactctaaaatgatctctgaatcacagttgctaaaattcagtcatttgtcatttgtttctgttattgacttttgggaaaggccgaagtcaatgatgtgacaacagccctgaacatgtaagtgtctaggtttaaaagcgacggagcaggttcgtagcttgatggtagctgacttgatagaagggaagggatgaaacttagatgggaattcaggcaaatgaatgatgctcacatccccagagaacacacaatttgttttcttaggcttaaaakttgtttgagaacaagggtatagaggtcttggtgaggaaacatactttccacataaagccagaagagagagaaaagacaagttttggagtattctcagtgttgtgagaaagagaaacagccatcctgtcttgctttgatatctccccctcctctcctctccgtgtatagggacccagggtcctgatgaaaagaagtagacagctttggacatggagtgggggaaacctggggctcccagctgcaccttgggataccgactaaggcttgtaggtttaacttaatgtcttccttattaacctt

SEQ ID NO: 34360 - DNA, 601 bp, Human
caggccaaaagaagaatggagggatatagttctccttgtgtacttaaaaaataaacaccggccaggtgcggtggctcaagcctataatcccagcactttgggaggtcaaggcaggcagatcatctgaggttaggagttcgagaccagcctggccaacatggtgaaaccccgtctcgactaaaaaaaaaaaaaaaaaaaaaaaaaaaatacaaaaattagccgggcatggtggtgggtgcctgtagtcccagctactcgggaggctgaggtggggaattgcttgaacctgggaggcggaggytgtggtgaactgagatcatgccactgcactccagcctgggcgtcagagtgagactgtgtctcaaaataaaaaaaaataaataagtaaacaccattttctctgacaacacagcaatgaattattcatagcagaatgtatggcatgtagtaggtcctaaaatgtgactgacactgggttcaaaggataacttgctcagattcttcgagctactagggaaagatttaactccgaagtttactttcccacttgatttcgtggctctcgtatcaaaggacaccaaaatgggaatgaaacatttta

SEQ ID NO: 34361 - DNA, 601 bp, Human
agaaagaagagttgagtgtggagaggagaaactgtactcgaaacatcactgcaagtgcacataaatcctagctttacgttttacccagtttttccaggccaaaagaagaatggagggatatagttctccttgtgtacttaaaaaataaacaccggccaggtgcggtggctcaagcctataatcccagcactttgggaggtcaaggcaggcagatcatctgaggttaggagttcgagaccagcctggccaacatggtgaaaccccgtctcgactaaaaaaaaaaaaaaaaaaaaaaaaaaaatacaaaaattagccgggcatggtggtgggtgcctgtagtcccagctactcgggaggctgaggtggggaattgcttgaacctgggaggcggaggttgtggtgaactgagatcatgccactgcactccagcctgggcgtcagagtgagactgtgtctcaaaataaaaaaaaataaataagtaaacaccattttctctgacaacacagcaatgaattattcatagcagaatgtatggcatgtagtaggtcctaaaatgtgactgacactgggttcaaaggataacttgctcagattcttcgag

SEQ ID NO: 34362 - DNA, 601 bp, Human
tacaataaaaatccagagagataaagtgcacagtgaagaaagaagagttgagtgtggagaggagaaactgtactcgaaacatcactgcaagtgcacataaatcctagctttacgttttacccagtttttccaggccaaaagaagaatggagggatatagttctccttgtgtacttaaaaaataaacaccggccaggtgcggtggctcaagcctataatcccagcactttgggaggtcaaggcaggcagatcatctgaggttaggagttcgagaccagcctggccaacatggtgaaaccccrtctcgactaaaaaaaaaaaaaaaaaaaaaaaaaaaatacaaaaattagccgggcatggtggtgggtgcctgtagtcccagctactcgggaggctgaggtggggaattgcttgaacctgggaggcggaggttgtggtgaactgagatcatgccactgcactccagcctgggcgtcagagtgagactgtgtctcaaaataaaaaaaaataaataagtaaacaccattttctctgacaacacagcaatgaattattcatagcagaatgtatggcatgtagtaggtcctaaaatgtgactgaca

SEQ ID NO: 34363 - DNA, 601 bp, Human
acatcactatttcatactatctttgtactctttccaagggttcacaaaattattaagcaattgaatggatttttaaaagtgtgccctgcctgctcagggatctgagtgaaggtacaataaaaatccagagagataaagtgcacagtgaagaaagaagagttgagtgtggagaggagaaactgtactcgaaacatcactgcaagtgcacataaatcctagctttacgttttacccagtttttccaggccaaaagaagaatggagggatatagttctccttgtgtacttaaaaaataaacacyggccaggtgcggtggctcaagcctataatcccagcactttgggaggtcaaggcaggcagatcatctgaggttaggagttcgagaccagcctggccaacatggtgaaaccccgtctcgactaaaaaaaaaaaaaaaaaaaaaaaaaaaatacaaaaattagccgggcatggtggtgggtgcctgtagtcccagctactcgggaggctgaggtggggaattgcttgaacctgggaggcggaggttgtggtgaactgagatcatgccactgcactccagcctgggcgtcagagtgagactgtg

SEQ ID NO: 34364 - DNA, 601 bp, Human
gataaatatggaggcaatgactcgtgtctcctaatgagggcgccattgaaggtatcatgctgagacaggttagaggggaggtagggttgtcggagcagaagccataccttggtctggaatgtacaaaacatgtgcgtcagaaacggatgctcccaggccaaggaaagaactctcttctctaccatcgtgcactcaacatcatcgtccatcaagaccacatctttctttaaggcctttattgcgaaaaattgattggttttcttgaattctgccaggaagacctagaaggagagggaagaartaactttattttagaatttggattcccatttcttaaaaaagagacagagtcctgagagacacctgtgttgggtgggaaaaggggttccttctccaacccccatccatcctgcataggccattcctgagacaaaatggagcacttctctggtttcggacatgacatcactatttcatactatctttgtactctttccaagggttcacaaaattattaagcaattgaatggatttttaaaagtgtgccctgcctgctcagggatctgagtgaaggtacaataaaaatccagagagataaagt

SEQ ID NO: 34365 - DNA, 601 bp, Human
acagaagaacgtgaaatgatgtcatacagcagagaagaagaaaattccataagcatttctaggtggctcaaagcaaagacaagcaaaaataagaggtatgaaggggacaaaagagaaagaaaccgtaaggtatgataagaaagagaaaacaggacagtgaaaatgggaaaaggaaggtgaaagaaggaattcaagtgagaaccagcataaaggacagaatgagctcagcactttcctgctgttgagactggaatgtcttccttggttgtaagtcatcatccatgtaatcattgtgggcagsagacctatgtgtggagcttactcccaggaaatcacatgggctgtctcacagcactcggtgcaatgattaaattaactgagccaggaaagccgatatcttagcatttgtttccacaaagcaaaatttacctgtagactattcctttggaatgaaggaactgcagaccaagaatgatttcagcagcataaaacctgggggaaggagaaccaaggttcaacatgaatgttgtcatggaacgaaataaaatcccaaacccagactgacctttttctgacatgctgtgtatggctaaatggcata

SEQ ID NO: 34366 - DNA, 601 bp, Human
aagagcttggacagaagaacgtgaaatgatgtcatacagcagagaagaagaaaattccataagcatttctaggtggctcaaagcaaagacaagcaaaaataagaggtatgaaggggacaaaagagaaagaaaccgtaaggtatgataagaaagagaaaacaggacagtgaaaatgggaaaaggaaggtgaaagaaggaattcaagtgagaaccagcataaaggacagaatgagctcagcactttcctgctgttgagactggaatgtcttccttggttgtaagtcatcatccatgtaatcaytgtgggcagcagacctatgtgtggagcttactcccaggaaatcacatgggctgtctcacagcactcggtgcaatgattaaattaactgagccaggaaagccgatatcttagcatttgtttccacaaagcaaaatttacctgtagactattcctttggaatgaaggaactgcagaccaagaatgatttcagcagcataaaacctgggggaaggagaaccaaggttcaacatgaatgttgtcatggaacgaaataaaatcccaaacccagactgacctttttctgacatgctgtgtatggct

SEQ ID NO: 34367 - DNA, 601 bp, Human
catttgtccatccattcaaccatccacacccatccatccatccaaatatctgttcatccattcatccaaccatctgttcactcatccatcatccatccatccatctatccatccaccccacacaatttagtcagtgcctaggtacaaaaatattttagatacattgcaggccttacacatataaagaaaaatttaaaaaaattctgctaagagtttttaaataatattctggtgagtatttctcaatttcctgaagattaaaaaattataaaacagattcttaatctatgattttgtagawagaccaaaaaaaattacattcaaagaggctgcttaagaatacttacttctcaaacctcctctaagcctttagttgtgtgactccaaatagggcaaccctcacttgactgcaccctcagaaaatggagagatccttccttgttaagtgaattctacactctgtaagcaccaaagcttcaatactaattatctgctctccagcagctcagccatcctcctcactagatcctttcttttttttcctttctatttttcctcctaatctgcagtgagttggaaatctgacagtaagcttgtaaag

SEQ ID NO: 34368 - DNA, 601 bp, Human
catctgttcaatttacccatcaccatccatccatccatcccatccatccatccaaccatctgttcaatttacccatcacccatccatccatacccatccatccatccgtccaaccatctgttcatccatccgttgtccatccatccatcatccatacatcatccatccacccatctgttcatccattcctcatccatccatcatttatccatccatccatccaggtacatccattcatccatccatccaaccatctgttcatctactcatcattcatccatcatttatccatcatttatccatccatccatccatccatccatccacatccatccattcatccatccattcaaccatctgttcatccattcatcattcatccatcatttgtccatccattcaaccatccacacccatccatccatccaaatatctgttcatccattcatccaaccatctgttcactcatccatcatccatccatccatctatccatccaccccacacaatttagtcagtgcctaggtacaaaaatattttagatacattgcaggccttacacatataaagaaaaatttaaaaaaattctgctaagagtttt

SEQ ID NO: 34369 - DNA, 601 bp, Human
caaatttggggtaatttcttatggcagcccttcaaaactaatgtatcagttttgtgaacaaattcagaaaattattatcctatgaggtcaaaagaaagaaatgaattgaatccttttgttaattcagttgccaaattaaaagtttaggtgagtcaaattacacacagacagttgaataatttcttactattcaacttattataaggcaacttatttcttattatgcagcaggccagttttaaagccagcatacttgtctggtgacctatcctcagttataactatttgatgatgactttcwagggtctcctgcaacctaatgagcacaaaaaataaactcatttttttttcttgttggtgcctaagaaggcttaaagaacataacttccatgcatgggcagggtaagactcgaaaatgggtacaatttgttgtgatagtaaagctacttatggacatctattgcttttttttttttgttctgagtgttaataatttacatggtgacatgatagaaagaagctttgtgacacagggaaataaaatgccccgaggcatgtgggtttaggtttcacggggtcccttccagtctaagatctctgt

SEQ ID NO: 34370 - DNA, 601 bp, Human
gagtgggcatcacagttggcttcccaatcccagcattacggccggctggctccgcctcaccatttcccctctggcagcctccaagactcatccaaggaacagggaccatgacacttgccttgcttgtctcatggggtcctgtaacgtccaatgagaatcacgtgaaagcattgaaagtggcttcaaacacatgggttgggcccagttttattgtcaataaaatataatcttaaggttcttcttagttctaatactctaagattggaagttctagattcttctttccacatctgcatacttyccggctctgtggttttacatttgacccaaaccagggcttacatcatctttgaagatgccgtcgattttgtggttcctctggcagatggtgagtgacgccaccacacctgcttctccacatctcatgcttttcatcgaccaacagcagccttgcccctgaagctggatgcacctgttgaatattcctccattttcctattgctgtgcctttcctggagtcacttcttccatctgcaaagcctcttccactctaaaaagtctaccttcacagaagaatttttgtttgccatctcccctactt

SEQ ID NO: 34371 - DNA, 601 bp, Human
agaacatccaggggcaccctttcattccatcatgaggttaacggaggcaaagcttttctatttggaagaggtggagtgggcatcacagttggcttcccaatcccagcattacggccggctggctccgcctcaccatttcccctctggcagcctccaagactcatccaaggaacagggaccatgacacttgccttgcttgtctcatggggtcctgtaacgtccaatgagaatcacgtgaaagcattgaaagtggcttcaaacacatgggttgggcccagttttattgtcaataaaatataawcttaaggttcttcttagttctaatactctaagattggaagttctagattcttctttccacatctgcatactttccggctctgtggttttacatttgacccaaaccagggcttacatcatctttgaagatgccgtcgattttgtggttcctctggcagatggtgagtgacgccaccacacctgcttctccacatctcatgcttttcatcgaccaacagcagccttgcccctgaagctggatgcacctgttgaatattcctccattttcctattgctgtgcctttcctggagtcacttcttc

SEQ ID NO: 34372 - DNA, 601 bp, Human
aggtgtttttctgctttcctttatgaagtgccattatcccagtttcttctcattctgtacttgtgaaattgattttttaaagataattcaggtgcttcccttgatatcaggtttttttttttcccctgagacgaggtctttccctgtcatccaggctggagtgcagtggcatgatgtcagttcactgcagcctcaacctcttgagcaagcagtcctcccacctcagactcttgaccacatgtgtgccatcgccatgcctggctaatttttaaaattttttgtagagacaaggtctcactaygttgccaaggctggtcatgaactcctgacattaagcaatccttctgcctcagactcaaaatgctgggattataggcgtgagccactgcgcctggccagctctgagggatctaggtcaatatgggaaaggttctgaaaggctgccatgtgaagccagccccccatgggggtgaggaaggagtgccaaggaagaccagtgaggacccctggagccagctggagagggcagagaacccagaggcccagggtattctgaggcatgtcatgcttacaccctatggggcatcaggacccaggggag

SEQ ID NO: 34373 - DNA, 601 bp, Human
aaactaaaaccttcaggtgtttttctgctttcctttatgaagtgccattatcccagtttcttctcattctgtacttgtgaaattgattttttaaagataattcaggtgcttcccttgatatcaggtttttttttttcccctgagacgaggtctttccctgtcatccaggctggagtgcagtggcatgatgtcagttcactgcagcctcaacctcttgagcaagcagtcctcccacctcagactcttgaccacatgtgtgccatcgccatgcctggctaatttttaaaattttttgtagagrcaaggtctcactatgttgccaaggctggtcatgaactcctgacattaagcaatccttctgcctcagactcaaaatgctgggattataggcgtgagccactgcgcctggccagctctgagggatctaggtcaatatgggaaaggttctgaaaggctgccatgtgaagccagccccccatgggggtgaggaaggagtgccaaggaagaccagtgaggacccctggagccagctggagagggcagagaacccagaggcccagggtattctgaggcatgtcatgcttacaccctatggggcatc

SEQ ID NO: 34374 - DNA, 601 bp, Human
tattgtaaactaaaaccttcaggtgtttttctgctttcctttatgaagtgccattatcccagtttcttctcattctgtacttgtgaaattgattttttaaagataattcaggtgcttcccttgatatcaggtttttttttttcccctgagacgaggtctttccctgtcatccaggctggagtgcagtggcatgatgtcagttcactgcagcctcaacctcttgagcaagcagtcctcccacctcagactcttgaccacatgtgtgccatcgccatgcctggctaatttttaaaattttttktagagacaaggtctcactatgttgccaaggctggtcatgaactcctgacattaagcaatccttctgcctcagactcaaaatgctgggattataggcgtgagccactgcgcctggccagctctgagggatctaggtcaatatgggaaaggttctgaaaggctgccatgtgaagccagccccccatgggggtgaggaaggagtgccaaggaagaccagtgaggacccctggagccagctggagagggcagagaacccagaggcccagggtattctgaggcatgtcatgcttacaccctatgg

SEQ ID NO: 34375 - DNA, 601 bp, Human
tttatgagatacttaagaaaacaggtacaaatcttgaatgaagatatttaaaaccttctgattttcaggggctaaagaagcaatggcatgtggccagggcatggtgaggtgggagcagcctgtcactgcattcctacctctggggcgatgtagtcaggtgtcccacagaaggtattcgtcttggcatctcctaacatgttctccttgcacattccaaaatccgcgatcttgatatgtccatctttgtctaacaggatgttatctagcttcaggtccctgaaaaacaaaagtgaagcaaatstcacattaatcaatataatttggttaacataaaattccataggaggcgagggagtttgtctcattgcagcctgagaggggctcacgagaggcgcttatgtatctatccacttgcacaccaagtggggtgtagacaaagcagattctgcaagggcacgctggctgctatggattctttctctgatttaccaaggggtgcagctcagtataaggaggacagagcacccatacccattggagacccttgatcccaggactttcctgagggtaatgacgaaggaggaaaacctaaaaaatatac

SEQ ID NO: 34376 - DNA, 601 bp, Human
gccaggattataggcgcccgcaaccatgcccagctaatttttgtatttttagtagagacaaggtttcaccatgttggccaggctgatctcgaactcctgacctcaggtgatccacccgcctcggctttccaaagtgctgggattacaggcgtgagccaccatgcccagcccaaccttgctttatttttgacttcactttatggtggcccgtctcgcaggtgagccaggtcattctgcctttgctgatgtagcttaatgacttttgccagtgaggacataaatggaaatgtacagacctatmttttttaaagcacggatttagttagtttctcccttaaaccaaagaacacctaacaattacccttaggaaatgtcgttatatgagcactttacagatactttaataaacatcatggaaaaaacagctccaaaattcctgacgtaggatgcagggtttatgtccaagtttgggttacccagactggaccattaagtacgtatgtgtcatgtgcacaacccccatcttgtttaatagtcaccctcacaaattcatattcaacctaaggcgtggacacacagcaatccattcttcatgcaggcg

SEQ ID NO: 34377 - DNA, 601 bp, Human
aaatttactttcttaatgacttttttttgttgtttttctaaaaagttttatttttggagacagtctctcgctctgtcaccaggctggagtgcagtggtgtgaacccagctcactgcatcctcttgggctcaagtaatcctcctgtcttggcctaccgaggagtttgaactacaggcatgcaccaccaagcccacttaattttgtagagatggggtttcactatgttgcctaggctagtctcaaacttctgggctcaggcaatcctcccacctcagcctcccgagtagccaggattataggygcccgcaaccatgcccagctaatttttgtatttttagtagagacaaggtttcaccatgttggccaggctgatctcgaactcctgacctcaggtgatccacccgcctcggctttccaaagtgctgggattacaggcgtgagccaccatgcccagcccaaccttgctttatttttgacttcactttatggtggcccgtctcgcaggtgagccaggtcattctgcctttgctgatgtagcttaatgacttttgccagtgaggacataaatggaaatgtacagacctatcttttttaaagcacg

SEQ ID NO: 34378 - DNA, 601 bp, Human
aacacagagaagcgaaatgaagaaccaggcccctcccaccctccaaggggccctggggctgtgaggtcaatggcagctcagaccacaggtcagggaaagtttcctactggcagaactgggaatgtcctttagggtaagcttagatcaaagttttgatttttatgtgcaaaatattaagtcaattttaatctgcagtggaaggtgagacatggtttaatagttctgatagctaaaaacaaggtaaaatttttattttatcacaaatgactaacccatgtattagatgtggttctgtcacaartaattagagtgcttgaggctggcctgttgggtccttggaacatcactggagcttgggacagatgttgagaacaactattcttgccctgggaatgagatgcacctgcttcttctggccattcgctatcatgactaatagcctgtgcgttctctggggtggaatctgttgggaagtccatgagcctggcccccttcagcgcggatatggcccatgtctatccaggcaatcacagggaatggttaaggctggcaaacccacaactttgctctactcttttaaaaatcattatttttagaaatt

SEQ ID NO: 34379 - DNA, 601 bp, Human
caatggggccgtttcagtcttgagacgtctgtactccgtttgcccctgattcaacaagcatttcattgatcagcagttggcgcccaggtgaagagccataatttattgcagtatcaagtcttgaaacctttccaagtgcggagacccatctttcaagtaaataactatggttagtaatgacctaacttcaggagcgtctgtgagacatgtcaggagacgagacacacggcatcgtcattagtgaagtagacttggtttctgctacagataaaagtcacatgggggcgaacgggtctcagtmtttattgttgagtgtttctttctttttccaagttgaaaaaggaacccaagcagtgtctcttgaaccagttcccagggagaaggcaaattctttcctgtctctggaggggcaagattcaggatatcagccgctccatcccggggttcatgaaggaaaagttcctgaacatattctggtccatgctgttgatcagtgctctgtcggcaaatgacagccggggcttctcgtttaagaattctttgtcgaaattgctgcagtcaaatggtgatttcttagtcagagtttaagggaagaaagaaa

SEQ ID NO: 34380 - DNA, 601 bp, Human
ctagcaaaccttccctctcactttccacttgtcctcttgaccatggatttcatgcccaatcaggatgaatggatttgtagatctcaagttacaagctatgtttattgtaaagaattcccataaaaacctatccagggctggccccccagccatttacacatccacagataggaatagaataaaacgggttagtgattacttgtctgcggctgagtgagatccgctactagaccaggcaatggggccgtttcagtcttgagacgtctgtactccgtttgcccctgattcaacaagcatttcrttgatcagcagttggcgcccaggtgaagagccataatttattgcagtatcaagtcttgaaacctttccaagtgcggagacccatctttcaagtaaataactatggttagtaatgacctaacttcaggagcgtctgtgagacatgtcaggagacgagacacacggcatcgtcattagtgaagtagacttggtttctgctacagataaaagtcacatgggggcgaacgggtctcagtctttattgttgagtgtttctttctttttccaagttgaaaaaggaacccaagcagtgtctcttgaa

SEQ ID NO: 34381 - DNA, 601 bp, Human
tactggcaagggtgaaatgatactatcttttctatcttgacaagataacaagcgaaggtgtctagcaaaccttccctctcactttccacttgtcctcttgaccatggatttcatgcccaatcaggatgaatggatttgtagatctcaagttacaagctatgtttattgtaaagaattcccataaaaacctatccagggctggccccccagccatttacacatccacagataggaatagaataaaacgggttagtgattacttgtctgcggctgagtgagatccgctactagaccaggcaayggggccgtttcagtcttgagacgtctgtactccgtttgcccctgattcaacaagcatttcattgatcagcagttggcgcccaggtgaagagccataatttattgcagtatcaagtcttgaaacctttccaagtgcggagacccatctttcaagtaaataactatggttagtaatgacctaacttcaggagcgtctgtgagacatgtcaggagacgagacacacggcatcgtcattagtgaagtagacttggtttctgctacagataaaagtcacatgggggcgaacgggtctcagtcttt

SEQ ID NO: 34382 - DNA, 601 bp, Human
gtggtaaaggcagccttcaggactttgaggagtagagcacagcagaaattccactgctcctacccccatgccattccagagattttaaagctagcatcccaggaaatgagaaaggcaggaggaacaagggaagagggaaaaagggaaaggaaaaccacaagtctgaaaagttgagagagctacctctctggggcgctttcgaggtatgcttttgtttgaaactatctgaaagacagaaagaaaagtcatgagaagaaggccttgatacacttgagacaggagcagcagcagcaggaaagcrgagcaaacgagagagaaaccccagcggcgatggtgctcccagggtggagggacagaagtggggcaaggcagacagaaagaaaaagagaacagacgttgaaaaactcagtgtcagacccctggggccctggcttaactgaggccaggagacctgcaggccatctgttgagaggccaaccctgcctgctgtggcccccacaagcaaccctaccccagaggatggcagaaatctttcccagagcatgcaggtcccacccgtcatatagcagggacccaggcctcccaggggtctcagacggaa

SEQ ID NO: 34383 - DNA, 601 bp, Human
cattgtactccagcctggatgacaagagtaaaactccatcttgaaataaataaataaatataaaataaaatataagacaaggccagacatggtgggttcatgcctgtaatcccagcactttgagaggccaaggtgggaggactgcttgagctcaggagtttgagaccagctcagcaatatggcaagaccctgtctctaccaaaaatataaaaaagtagccagacatggtggtgtgcatctgtggtcccagctacccgggaggctgaggtgggaggattgtactgcttgagcctgaagggaraggttttagtgagctaagatcgcgtcactgcactccagcctggatgacagagagactctgtctcaaaataaataaataaatacataaagaataaataaatagctgggtgcagtggctcacgcctataatcccagcactttgggaggctgaggcaggcggatcaccggaggtcaggagttcgataccagcctggcaaacatggagaaaccccatctctactaaaaatacaaaattagccgggtgtggtggcacgtgtctgtaatcccagctacttgggaggctgaggcaggagaatcactt

SEQ ID NO: 34384 - DNA, 601 bp, Human
agtacatgtggtagccacgatcgcagtcatcacagaagagcaactggtcctgaagtaggcaagagggaagaggatggggactgaataactgatgtgcctcaggccactacaggacactgctatttccaagaggggtaggtagcaggtaagaacagatgtgagaatcttatgtgggaaaccatgctgcccctctccaccgcagatccagtcactgtcatttctcacttgggtcctttcagagctcctaattgatcaaatcacctccacttttttttttttttttttttccctaaagcccaarctctatggtatatttttttgagacagggtattgctgtcactcaggctggagtgcagtggtgcaatcacggctcactgcagccttgacctcctgggcccaagtgatcctcctacctcagcctctcaagtagctgggactataggcacacaccaccacacctagctaatttttcaatgtttttggagagacaagatctccttacgttgcccaggctggtcctgaaatcccaggctcaagcaatcctcccacctcagcctcccaaagtgcttggattacaggtgtgagacgccgtgcccagtg

SEQ ID NO: 34385 - DNA, 601 bp, Human
ggacggggtgagacagtacatgtggtagccacgatcgcagtcatcacagaagagcaactggtcctgaagtaggcaagagggaagaggatggggactgaataactgatgtgcctcaggccactacaggacactgctatttccaagaggggtaggtagcaggtaagaacagatgtgagaatcttatgtgggaaaccatgctgcccctctccaccgcagatccagtcactgtcatttctcacttgggtcctttcagagctcctaattgatcaaatcacctccactttttttttttttttttttyccctaaagcccaagctctatggtatatttttttgagacagggtattgctgtcactcaggctggagtgcagtggtgcaatcacggctcactgcagccttgacctcctgggcccaagtgatcctcctacctcagcctctcaagtagctgggactataggcacacaccaccacacctagctaatttttcaatgtttttggagagacaagatctccttacgttgcccaggctggtcctgaaatcccaggctcaagcaatcctcccacctcagcctcccaaagtgcttggattacaggtgtgaga

SEQ ID NO: 34386 - DNA, 601 bp, Human
cttcagggggctcagacatggacggggtgagacagtacatgtggtagccacgatcgcagtcatcacagaagagcaactggtcctgaagtaggcaagagggaagaggatggggactgaataactgatgtgcctcaggccactacaggacactgctatttccaagaggggtaggtagcaggtaagaacagatgtgagaatcttatgtgggaaaccatgctgcccctctccaccgcagatccagtcactgtcatttctcacttgggtcctttcagagctcctaattgatcaaatcacctccacttttttttttttttttttttccctaaagcccaagctctatggtatatttttttgagacagggtattgctgtcactcaggctggagtgcagtggtgcaatcacggctcactgcagccttgacctcctgggcccaagtgatcctcctacctcagcctctcaagtagctgggactataggcacacaccaccacacctagctaatttttcaatgtttttggagagacaagatctccttacgttgcccaggctggtcctgaaatcccaggctcaagcaatcctcccacctcagcctcccaaagtgc

SEQ ID NO: 34387 - DNA, 601 bp, Human
aaaacagcttcattgttctttataacaaagaattgttataaacttgaatttatgtaacaaaacaaaataaccaattttatattcgctttacatattggggttccacaaaaaaattttaatttggggggaaaaaagctgtatttcaaaacattaaaaaaaaaaaccaccatcatggaaatcttaggatgaaatggccttcttaatggagaaaggcaggagataaaccatccagcagagggctctgtgtaaaaacatttatttttactaatgtttagaatacaggaactaaagaaagaaaaaraaaagacacctcaactccaaagcgacagtgagttagggcctgcccacggccaagggggaaggctactccagggtgtcctggcatggactgtccccccactacttaatgtcagtgccactaagcagaaaacttgaggaatcagggtgtgaagaccttaccagctgctagcgagcgtgcaagggaagaaagggatgtctatgtggcttccccatgagctgagagccaggatacacggggcaggtggcagaggctcccaattcagttaagagcaggaggctgaatgcccaggtccaggaagaa

SEQ ID NO: 34388 - DNA, 601 bp, Human
tatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagg

SEQ ID NO: 34389 - DNA, 601 bp, Human
aaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacayttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttc

SEQ ID NO: 34390 - DNA, 601 bp, Human
ccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaastgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgt

SEQ ID NO: 34391 - DNA, 601 bp, Human
cggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcrgcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgac

SEQ ID NO: 34392 - DNA, 601 bp, Human
ccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaragccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgtgagtgacagtgggcgctgggtgtcgtgctctgtgtcttgtctgttgagtttggcagccagctacttttggctttggt

SEQ ID NO: 34393 - DNA, 601 bp, Human
gtcgtgctctgtgtcttgtctgttgagtttggcagccagctacttttggctttggtgaactgaatttacctttgaggtgcaccgaggttcatacaaagcttataatgttatcctgcagtcttcactgtttggcttaactgttgtgtggaatcagaaataccagaggtttccttttcagattgttgtcttttttctgaatccttagcttaatcagctaagctcttttcccttgaccctagagacttttttatgtttaaaaaaaatagaccagtcacggtggctcacacctgtaatcccagcrctttgggaggccgaggcaggtggatcacttgaggtccagagtttgagaccagtctgaccaacatggtgaaacctgtctctactaaaaatgcaaaaattagctgggcgtggtggtgcacacctgtagtcccagccacccgggaggctgagacatgagaattgcttgaacccaggaggcagaggttgcagtgagccgagatcacgccgctgctctccagcctgggtgacagcaagactccatctcaaaaaaaaaaaaagaatggcatgagatagacaggtagagatttgatggttttcagaa

SEQ ID NO: 34394 - DNA, 601 bp, Human
ttagttggtttagtcaatcccccatctctcctgggaaattatctgacttttgcaaggtccttggtgttttcagtgtaattacctaaggtcctattccatatcaagtttcagtttaactttgctacaggattactttatcacaaaacttgagtagatgataatacaatcatacatcacttagccacagggtaagccacagggaaatgcatccttaggtgattttgttgtgtgaacatcgtcaagtgaacttactcaaacctaggtggtgaaacctactacacacctaggctatatggtacakcctgttactcctaggctacaaccctgtacagcacattattgtactgaataggtgctaggtgtggtggcttacacctgtaatcccaacactttgggaggccaaggtgggaggatcccttgaggccaggagttcaagaccagcctgggcaacatagtgagacacccccccacacacaccgattccctgtctcttaaaaaaattttttttaattagctgggagtggtggtgcatgcctgtagacccagctactcaggaggttgaggcaggaggattgcttgagcccaggaggttgaggttgct

SEQ ID NO: 34395 - DNA, 601 bp, Human
atcccaacactttgggaggccaaggtgggaggatcccttgaggccaggagttcaagaccagcctgggcaacatagtgagacacccccccacacacaccgattccctgtctcttaaaaaaattttttttaattagctgggagtggtggtgcatgcctgtagacccagctactcaggaggttgaggcaggaggattgcttgagcccaggaggttgaggttgctgtgagccatgattatgccattgtactccagcctggctggcagagcaagaccctgtctttaaaaaaaaaaaaaaaaaaaarctactataggcagtgtaacacaatggtaagtatttgtgtatctaaacatatctaagcatagaaaaggtacagtaaaaatatagtataaaagataaaaaataatacacctgtatagggcccttaccatgaatggagcttgcagaactggaagttgctctgagtgagtcagtgagtggtgagtgaatgagaaggccttggacattactgtacactactgtagcttctataaacacggtacacttcagctatgctaaatttatttaagtttttttccttcaataatagattaagtttagctta

SEQ ID NO: 34396 - DNA, 601 bp, Human
gttctttgattatatataagcagttaaatggttgttggaaaatattattgattgggtgccctcttttgtggcttttaaggttggttactcctctctagacagcacttagggtatgtactgggcacgtcactgcctaggtacttcctcccctaaatgtgggatgcttctgcatactgaagttgataaggagtcatttgtgagtctttgagttgcatgcaaccaatgcattaaataagatgaaatctgggccaaagaaagggtaatttattctacactttatattcggcagcaagaagcaccrtctctcgagtcctgccaccctcacccagtagcctttttcccctattctgtttttgttgaatgaacttcttgatctaatacacttaatagggctttttttaaggccttatgcaatcaaaaatcttgtcgtcttgttctttttagaagaaaggagtgctagacctcttggaagtttatttttcatctgtaaatttgaatttgtggcatttctgagtgtttctaccagtctcctttgtagttgaggtctgttcatcattcactcactggtgataacattcatgaatacgacatttttaatttg

SEQ ID NO: 34397 - DNA, 601 bp, Human
tttgtgcagcgtgtgacattcatcttccatcttactacttaataggaatggtaacagtttactcacatatttttacttttatactttttattgatgacagttcttctctgtgagcacacaagtctaactggaactgttttatgagacgtctatggcttttagtgcaataaagaatttttaaagaatttggtccagcgtgatgatttttctaatgaatgtcaaagccaagcgagtgaggctcagaggaactgaatgtctccagctgctaaggctctactgtctgcaaagcttttggtggcgygtaattaaaaaccatagacatcagagtgctactgtttgacaactcatagaagcaagctgagggggtcttttcagagaatgagccccgcttgtaggtctttgcttaccccgtctctctggagaaaactcagaggcataaaaggtgtccctgcctctctcctgcggcgatgtatgatttgtgtggtgctgtatgctttggcttctatccgcacacactgctgtctgctccatttcataccttgacaattgtcagtgtgattgcaaactggcttgtttgtgtttcttctctttccaggagtgg

SEQ ID NO: 34398 - DNA, 601 bp, Human
actgtccctgaagagaaggcccctgaagacaagggaaccctttcacaatgactcttttttttttttggtaaaattcccactttaaatgctacaaagatgcatcaccacagggtgtgaaagtctccagggcaccgaagggaagatctgaaatactggtgtaggttctaataagataattgactctaataactggatggtatttttcttaagtcagatggttttctaattcattgctttcaacaatagaggaaaacctgagttgtcagctgataggtctaaaaataatgtttgatggtagatktttttgggcacataacttggaaaggggttcaaagaattgaaaggcacttatgttacagaactactttctgtttcatctattgtttatataaataaggtttcttaatgattatattgataaaaatagaaaccaggaataaaattgatgttgacctttgttacattctagcaataaataatatccatccatgaccgtataaactaattgcaaaacaaagcgaagcccaggcccatctgattgcaatgagatccttttgttctttttaaaactttctcagtatacttattacagaaatacatt

SEQ ID NO: 34399 - DNA, 601 bp, Human
gattatattgataaaaatagaaaccaggaataaaattgatgttgacctttgttacattctagcaataaataatatccatccatgaccgtataaactaattgcaaaacaaagcgaagcccaggcccatctgattgcaatgagatccttttgttctttttaaaactttctcagtatacttattacagaaatacattcattggttaatagagttcaatttaacataacttttcctctacaatttggatcagaaacttggtatatggtgtaagatgtaaaaaaggggtgtgatgggggaaatttrcaatctgagttatttttcatctgttaacaaatgtgtaacattctccctcagattttgctaaagtaggcagcaagaactatgagaaatttatctttggttttctttaaaaaacaaaaacaaaaacccaaaacccatatatttagtgcactgtaaaagtttttaagaattagtgcaataaaacattttgtaattgatataacaacttacttttgtgtctgataatacttatcaaaacttgcaatattttgaaaataagttgtgcattaataaatgtgataagtctccagcagaaaaaatttt

SEQ ID NO: 34400 - DNA, 601 bp, Human
tcttgatggaagtgggatggaaatacagatttagagaggaaaaggaataacataaatttctgacttattcaggaacttgttcatttaaatttacatatggtatcaaatcactaaggtaactagatagcattaagtaaattcaatatttagaatattccagatattacattctttgcaattatttaaacttatgccaaaaagtttttagatgtcacttgaaaatgcaatgggggacatagattttcaaaaaaaaattaggtatatgagcaaaaaaattgaaaaccattgtcttaaaccactkaaactgcttgcttataaacttaacctagagaagatcattttttaaaacctcagactcaagttacagaaactaggttctataaaacagcatctcacaattgaaagactccaacttcctccttgctttgtacccaggtctgtggttaacctctcacatatctgtatggagttgtgtctactttgttccattcatgggatgtcacttttccccattgcttgccctcctaaagggtagcatcttctctgttgtgtttctcaggatgaaggggcagtgatctcccagatttcagacatttctaat

SEQ ID NO: 34401 - DNA, 601 bp, Human
tgtacccaggtctgtggttaacctctcacatatctgtatggagttgtgtctactttgttccattcatgggatgtcacttttccccattgcttgccctcctaaagggtagcatcttctctgttgtgtttctcaggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttccygtgtctaccataaatcatgcgttttcatcctcagaagcaggtatggaagcatatcttcatctttctaatgtacataagcatggaaatgcctgaaagcctaataaagcaggaggagccttacagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataatt

SEQ ID NO: 34402 - DNA, 601 bp, Human
cagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgttgctgtaaaggaatacctgagaatggctaatttataggaaaaagaggtttatttggttcatggttckgcagactgtagaataagcatggcaccagtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagattta

SEQ ID NO: 34403 - DNA, 601 bp, Human
tgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgttgctgtaaaggaatacctgagaatggctaatttataggaaaaagaggtttatttggttcatggttctgcagactgtagaataagcatggcrccagtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatc

SEQ ID NO: 34404 - DNA, 601 bp, Human
agtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatcaartggcctataaatatgtcatatgtttgacttttttgtgattgttatactcattgtttaacttagagaaataacaactgacatgtatggtgccttaccatgtacaggcattgttttaagtgctttgcatatactcattcatagcaaggtgttacccttttctcacttcttcagagaaacaaagtaagtcaaagaagttaagtgacttgattaaagtcacttggctagggtaggacagaaaagtggtatctttttcctcaccacaaggttcatggctgagacatctctaacaaaagatcaaca

SEQ ID NO: 34405 - DNA, 601 bp, Human
gctattgacaacaatagtagttagtgattgccatgtggaggattgtaactttaaacttttgtatgcttttctgtatttttatgtttactttaatgagtgcatcttctggttattttattttttatttttcttatttttgagactgagtttcgctcttgttgcccaggctggagtgtggtggcgctatctcaactcactgcaacctccagctcccgggttcaagcgattctcctgcttcagcctcccaagtagctgagattataggcatgcgccaccacgcccagctaatttttgtattttyagtagatgaggcttcgccatgttggctaggctggtctcctgacctcagatgatccacccaccttggcctcccaaagtgctgggattacaggcatgagccactgtgcccagccatcttctggttattttaaatgtcatcctctaccctagtagagtagaggatagacctgagacaaggaagcccatttgaaggggtggaggggagaatgagtttagtttcgctgccttgaattttaaagcttattatcttatctgctgcattaattagatcaaggccacccttctgggctggaatttaaat

SEQ ID NO: 34406 - DNA, 601 bp, Human
ccgggtggactcaggtttctttcagtatttgttttgaagcccatgtgaatttgttaaattctggtcagtgttaggtgatgaggataaaatgtaaatgagatagtttcttcacttgaggaacacatagtctctgcattgtaaccctagccgcaggtagctgtggagcacttgaactgtagctactcagaaaaagaagaagcataaatgtctcaactttttatattaactacatgttgagatgataatattttggatgtcttgggttaactaaggtttattattatcattattattgttgttrttattattattatttgagacagtctcactctgttccccaggctggagtacagtggtgcaatcttggctaactgcaaccttcacctcctgggctcaagtgatccttctaccacagcctcccaagtagctggaactagaggcacgtgccaccgcacccagctagtttttgtattttttgcagaaatggggtcttgccatgttacctaggctggtctcaaactcctgggctcaagcaatctgcccacctccgcctcccaaagtgctgggattacaggcatgagcccctgcacctggctggttt

SEQ ID NO: 34407 - DNA, 601 bp, Human
tctcactctgttccccaggctggagtacagtggtgcaatcttggctaactgcaaccttcacctcctgggctcaagtgatccttctaccacagcctcccaagtagctggaactagaggcacgtgccaccgcacccagctagtttttgtattttttgcagaaatggggtcttgccatgttacctaggctggtctcaaactcctgggctcaagcaatctgcccacctccgcctcccaaagtgctgggattacaggcatgagcccctgcacctggctggtttactcagttcttttttttttttttgagacagagtttcactcttgtcacccaggttggagtacagtgacgcaatctcggctcactacaacctccacctactgggttcaagcagttctcctccctcagcctcctcagtagctgggattacaggcatgcgccaccacgcccagctaatttttgtattattagtagagatggggtttcaccatgttggccaagctggtctcaaactcctgacctcaggtgatccacctgccttggcctcctgaagtgctgggattacaggcatgagccactgcgcccagcccatttactcagttctta

SEQ ID NO: 34408 - DNA, 601 bp, Human
caatcagtggtaggagtcagtctctccttgcttttcagctgttgttccacagcatttttcacgtaagaagttaacttttctttttaagttttaaatgttttaaaaggtgagttcatttggcttttttgggcacgtctctgttagagtacggcaggggctgatactgctctcttgtgattgaggacaaatgagcacagtcagcacactgccacagattagtgatgcgaattctccacagccacgggaatcagtggcatctgtgctcactgtaaatttgcaaccgggagtccattgagttctrttgtctatagactggtctttgttggtcctcaattgtgaatgttttgagggactgggagaagcactggcaaacatgaaataaagcccttttggaaggatatgattgattgatttagcgtcttcattaaagacatattagatggcccaggcctaaaacagatcttctggccaattctctgtgatggtagattctataacaagcttgtccaacttgcttaattttgttgttgttgttctgattggttttgttttaggcttttagcagcctgaagccatagtttttagtttctgtctctagtga

SEQ ID NO: 34409 - DNA, 601 bp, Human
ccttggacacccctgtgaaatgttctgcactttttgataagcaacttaaaggactaaggaatgtaaaaagttaaatcctaggagactggaaaagatggctaaagtaggcaagggcatacattcctgccctgacacctgtaagagttgttgcattttgagtagtgaggtttgtaaatgtggccaggcagagaggagagtggctggggagagtcggcaggctgaagagcccactcacctggagacattaaacaccatctaaggtttgatctcctaccgcctgctcaggatgctgcctcttccrgaccccacatgtgttagcattgagttgttaagcaggcagactgaattcatttaccctctcaacaaatgaatgagatgctgaactctgtaatggatgttgatgttttcctggctatgaagatttttagggggcgtatttcccatattctcacgaacttggtagccatggaaagcactgagagtctgtttcctaaagttgacttaacctggggactctggcttaaactaagaactcagaagagactgacccatgaaatgttgttaatttagaatcagaagtttaacagtgaggtgaatcaag

SEQ ID NO: 34410 - DNA, 601 bp, Human
ccctctcctgtcatatatctatgctgtattttgtgtgtttggtttgtgtgtttcttgacaattccacctgttcttaaaggaaggtgtggcaattttatttttatagtttttagttttatagttttttttagttttaatttttatagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatctttttttttttttttttttgagataaaatcttggcgcagtagctcatgcctgtaatcccagtgctttgggaggccaaggcgggcggatcacctgagttcaggaattcgagaccagactgaccaacgtggagaaaccccatctctactaaaaaaaaaaaaaatacaaaattagctgggcgtggtggtgcatgcctgtaatcccagctacttgggaggctgaggtgggagaatcgcttgaacctgggagacgaaggttgtggtgagccgagatcgcaccattgcactccaacctgggcaacaagagcgaaactccatctca

SEQ ID NO: 34411 - DNA, 601 bp, Human
atagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatctttttttttttttttttttgagataaaatcttggcgcagtagctcatgcctgtaatcccagtgctttgggaggccaaggcgggcggatcacctgagttcaggaattcgagaccagactgaccaacgtggagaaaccccatctctactaaaaaaaaaaaaaatacaaaattagctgggcgtggtggtgcatgcctgtaatcccagctacttgggaggctgaggtgggagaatcgcttgaacctgggagacgaaggttgtggtgagccgagatcgcaccattgcactccaacctgggcaacaagagcgaaactccatctcagaaaaataaaaataaaataaaagacaagatctcactctgtcacccaggctgagtgcagtggcacaattatagctcattgcagcctcgaactcctagggtcaagcgatcctcttgcctcagctgcctgagtagctgggactgc

SEQ ID NO: 34412 - DNA, 601 bp, Human
ccatgcctgcataattttttttagagatgaggtctcgctctgttgcccaggctggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaartgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcaca

SEQ ID NO: 34413 - DNA, 601 bp, Human
tcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaagataaygagagccccaaagcagataaatggattacatacattgtcagtgtacgttaatgtgtttaattgtttgggacagcatttctccaactttcattgtctgaaaatcctcctctggtaataagttctttttttctcatttaggaaaattgtagctgaatatgaaaagactattgctcaaatgattggtaaggagaacattttgttttttgagggtatgagccataggatctgtcttagtctgttcagcctggtataacaaaatatgtaagctaggtagcttataaacaacaaacatttttcata

SEQ ID NO: 34414 - DNA, 601 bp, Human
tcactttttaaacccttttcccattgttaaaacattaaaaagtaaaaaaaggtatatctgctcctgcctccttccactgggttcccatctttctctatgccaggtaatcaccattgttggtttctgttttttcttcctattacaatttttttcttttttatatgattatagcatacttcgctatttttgcttagcaatataattttgagaatctttccatgtcagtgcaagaagagcttcctcttttttttctaatagccacatggtattccattgttggaatgtatcatttatttaacartcccctcctgttagacattaaagttaattcaaatgtcttgctgccacagacagtgctgtaataagtgacctggtaggtgatcgttttgcatgcctgtgagttatctttatgatctgtatgttagaaaaggaattgctagaccaaagcatatatgaatttataattataagtgttgtcagattggccccattagacttttatcatttgatagccctagataatatatgagagcatctcttttttctacaactgtgccaataggtcaacgtttttattttctgcaaatcaaataggtgaaaa

SEQ ID NO: 34415 - DNA, 601 bp, Human
gtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaayggcaatatgggactccctccaagctagggtttggcaagtctgccctagagtcatttactctcctctgcctccatttgttaatacagaatcaacatttagtcttcattatcttttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttc

SEQ ID NO: 34416 - DNA, 601 bp, Human
gaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaatggcaatatgggactccctccaagctagsgtttggcaagtctgccctagagtcatttactctcctctgcctccatttgttaatacagaatcaacatttagtcttcattatcttttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaat

SEQ ID NO: 34417 - DNA, 601 bp, Human
tgcccatctctttccatctgattgtggcaggcactgtagccacaggtttggtgttgtgggattgcaaggggcaggtattgaaagacctggctcctaggcaaaactttgcccctgaatggctgtgggatctgagcagtacctgtaactccattgccttagctgcagactaaggtggtagtgtaatttcagggaagggaataaggtcatctttgacttttagtcccatcatcaagcatggtgattggccttcagtaggtggtcaggtagtgcttgttgggtggatgggtggatggatggatagatggatggatggatggatggatggatggatggatggatggacggacggacggacggacggatagatgatattgtgaaagagacttttgctgtgccacaaaggaaaggtatatgtgttatttttatcctgctatgattttgcccaattccacctgtagaggacgtctgacatcaaaagagagcaccatctgatccagagaatgactcccactatgcctttcccagcaatcagattaagaatcccaatctaaaactatcaccagaaaactcctcaggagaaaccatgggtcatctagtccaa

SEQ ID NO: 34418 - DNA, 601 bp, Human
caggtttggtgttgtgggattgcaaggggcaggtattgaaagacctggctcctaggcaaaactttgcccctgaatggctgtgggatctgagcagtacctgtaactccattgccttagctgcagactaaggtggtagtgtaatttcagggaagggaataaggtcatctttgacttttagtcccatcatcaagcatggtgattggccttcagtaggtggtcaggtagtgcttgttgggtggatgggtggatggatggatagatggatggatggatggatggatggatggatggatggatggayggacggacggacggacggatagatgatattgtgaaagagacttttgctgtgccacaaaggaaaggtatatgtgttatttttatcctgctatgattttgcccaattccacctgtagaggacgtctgacatcaaaagagagcaccatctgatccagagaatgactcccactatgcctttcccagcaatcagattaagaatcccaatctaaaactatcaccagaaaactcctcaggagaaaccatgggtcatctagtccaacctctctcctttgagtgggccacaagaattatctcaacacct

SEQ ID NO: 34419 - DNA, 601 bp, Human
caataaagaactgaaagtaagcacaagaagaaaaaaagccttatctttgctctagattttgcaaaggggaaatttcaacagaacgcaatcattgctacacgtctgccaagacacaaggcttgggcgatcttttttgttcatttgtttgaatacttagctagtttttctaaatgtatacattgaaggaatactggctgtggaagtatatttgagggttttttggtttctttacagtttgactgtaattacaatttgataaaatttcaaatagctctattgccctacttatagagtaatgtargaaacaatgtaacttttcattataaaaattattttgcacttgccaaaggagattaaggagttaactttttttgttttaaacattcccccaaaatatttatcgtttgggggttgaaaaaaatgcagcccattgaattgtgagttttaaactggaaaggtcacagattaatggcatacaattaaacctgtttttttgtttgtttttcttctcaaaatgttagccctaaacactgaattattttcaaatttagacacccaggtgctttttaacttttgtactttacagttactaacaagcagg

SEQ ID NO: 34420 - DNA, 601 bp, Human
acacaaggcttgggcgatcttttttgttcatttgtttgaatacttagctagtttttctaaatgtatacattgaaggaatactggctgtggaagtatatttgagggttttttggtttctttacagtttgactgtaattacaatttgataaaatttcaaatagctctattgccctacttatagagtaatgtaggaaacaatgtaacttttcattataaaaattattttgcacttgccaaaggagattaaggagttaactttttttgttttaaacattcccccaaaatatttatcgtttggggkttgaaaaaaatgcagcccattgaattgtgagttttaaactggaaaggtcacagattaatggcatacaattaaacctgtttttttgtttgtttttcttctcaaaatgttagccctaaacactgaattattttcaaatttagacacccaggtgctttttaacttttgtactttacagttactaacaagcaggtttgcataaggcatttttgagagccggactagcaggccataggtaattccgtgttgtcaacacgactttccacaccaggagaggaaactcccagggcccaaaggctaaag

SEQ ID NO: 34421 - DNA, 601 bp, Human
gtgtcattcattaaaaagaagaataaaaagaactctttttttcttaaagctgtcatcatcttgtgaaatatcagtttgcccttgactaggaaattacatcaaattaaaccattcagtcccctagaatagcagtagggctggtttattctgaaaacctttgctgggtcttacatgcagataacttgactttccttctcttctcctttctgtcctcaggtgacggcaattgcctcatgcatgccacttctcagtacatgtggggcgttcaggacacagacttggtactgaggaaggcgctgtkcagcacgctcaaggaaacagacacacgcaactttaaattccgctggcaactggagtctctcaaatctcaggaatttgttgaaacggggctttgctatgatactcgggtaggtttttccccctaattatctactaacagagctccatggtgggcatagggtacccctgggcgagtccctgccctctggtagcatctgatggactaggtcacatgaatttggctaagcgaagcatactcaatggaaaacaccagaaacctccagtgggactcacccaaggcttttgccctgcttttggttag

SEQ ID NO: 34422 - DNA, 601 bp, Human
tccgtgcctggggagggaatgcggcacccttggaagcaccatgtttgaaggatactgccagaagtgtttcattgaagctcagaatcagagatttcatgaggccaaaaggacagaagagcaactggtgagacacttggaggagctttccctccctcccgtgtgttcgatgctttttgctggagcgttttctaccgacagtgacaagcaggctttcctctctgccaggttctgtctcctcatgataaaggattaattcagaacctgaaggggaatgtccatgtcactgtggctccccaggtcsgaaatgctacctccaattttcatgctccaagtatgctttcaaatttattttaaaaacaaagaaacacagccattgcataaaacttcttcaagcctccaaaaagccagatggtgatcagaggcttctttgatttgtaagagaagcacagacatctaaaaagcagcccttcttaaataatcctttatcataaggagcgaacagacagagcttcccaggggcctccacctaatggcgcgtcagaaaagccagctttgacagataggtgtgtcgcctgttgctcacagaatggtagggaagcta

SEQ ID NO: 34423 - DNA, 601 bp, Human
tgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcratgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttc

SEQ ID NO: 34424 - DNA, 601 bp, Human
tttgtggctggtccaggccgcagctgaggactggcctgaggggtccggagaggggcctgtgcggtgttcggcgccgcggaccgattctgacgccttagttgctgttgcaggcagagtacgtccccacgaattgcccttgaactttttgcgagggaaccttttatgaagctttcttcatagataatcgtgttgtggtatgtttttgtagtcgatcttgtttatcttaaaatggggaacgccccccccatgttattttttatccaactatttccagagtctgaattgttttcacttagcgctyttttgcgtttaggtcacaacaaaattctcagtttttaaaaaagacatattttgcttttggaagccccgtttatccatggaaaccaatttttgctgttactcttctttctttagtgtattcagaaactggtggtgtgttgactagataattgtacgaaagttttttttttttttaatttcagggtaattcagaattcaacattatcagaatgcctatttcatttgttaaagcaaactgaagttagccaacgaggaactctgggagggccccatttccaaaactctggttagtcatgagtaa

SEQ ID NO: 34425 - DNA, 601 bp, Human
aaaccaatttttgctgttactcttctttctttagtgtattcagaaactggtggtgtgttgactagataattgtacgaaagttttttttttttttaatttcagggtaattcagaattcaacattatcagaatgcctatttcatttgttaaagcaaactgaagttagccaacgaggaactctgggagggccccatttccaaaactctggttagtcatgagtaatttttgtcaggctactttgactgccaccaccacctttaaaaacatatttctgttgtttgttagttccgttgagtatatttacgtagcaatcattgttttagcaaatacatacatgttttgaatttctgttgtttaaatgtaaaatgtgatagatgttaattaaaactttcagctaatgcaatttgagataacaaagcatagtattggcttcacctactttttcttggattttaaatcctggaaaatgtcttttttgttttgttttcagttcccaaacatttctcaaattagacatagtctgaaggaagaatacattccttccacaactattgaaaaaataatactgttaaaattgagttgtgccttcagcatctcacagg

SEQ ID NO: 34426 - DNA, 601 bp, Human
ttcagcatctcacaggattacagtatttaaaatccagaggaagctttaaagattgccttttaaactcatgtaaacttgactaggtgttctttaaggagactatgtaaaaatcagtctgtatccacaaagtgctcaccaacttaatacagacatgtacgcacaaaactgagaggaaggtacatactggagtaattttgcactcagttatttataggttgtaattctcaaaaaccagctgatcagagagggaagagacttaaaaaaatggaaaattagccactaaatagaataatcaagatgrgcaatgggcaagacctgttggctgatttggtataaaaaatgaacaaacctgataattagctggttttcatcagtgttgttattgagactttttaataccacatcaacaatataaagttcttgaatgctgcgcacttcacattaaaatattttatagcctcctgtactggtaagtagtgggattgcacctgtgaatagactctgcactcaagcctgagcaacatagtgagaccctgtccctaaataataataataatattttatagccattatggatgaggattgctcagtaatagatggc

SEQ ID NO: 34427 - DNA, 601 bp, Human
gaatgctgcgcacttcacattaaaatattttatagcctcctgtactggtaagtagtgggattgcacctgtgaatagactctgcactcaagcctgagcaacatagtgagaccctgtccctaaataataataataatattttatagccattatggatgaggattgctcagtaatagatggccagttgttcagtagttaaaaatgaaccttggctttaaggaaatttataagaaaacatggtaagactaccactatataacatcacattctaaacagaatttatgtcccatgtattgacctttwagtttttaacattaaaccataagtagctattttaagaaaatttaagagtttgttttgatttgaaaaattaaattattttaaaattagctaagaccattttaaaataaattatcttaaaattatagataatttattcaaacaaaaacaaattgtcaaaaccaaattgattaccctttctcaacaaaatctcagcatcttcctcaaattcactcttcccccaaatctcactattctagcaaattcctccactttcctgtaaagtcataatcaatgaactatacccccaatgttaattgatat

SEQ ID NO: 34428 - DNA, 601 bp, Human
tttgaaccactgagctagagtaaagaactctgtagtagaatggaagtatgagaaagccacagcccagaaaggctttatgtaagtgagtttaaagtagatatagccagccaggtttacattcataaagggccttgcataccatgctaaaaaatttggtccctattgaaatattttcaggaggtgagtcatgttagtcatattacatatttttaaaaaatctctggcagtacagggctactgtaaaaaaaaaaagtatcataaacctggtagtttaatagaatagacacttactgtctcatarttaggaaggctagatgtccaaaatcagagtgtcgccagacccatgctcttctagcttcttgtttttactgacaaactttggcattccttggcttgcagctgcacaactccatctctgcttctgtagtcacttagctctcattcatctgtgtgtgtgtgtcttcacatgaccttctcctttctcagagtctgtctctgtgtcttttttccttttaaaagtgtgccagtcatattggtttaatggcctacccattccagtataacttcatcttaacttgattacatctgcaaagccccattt

SEQ ID NO: 34429 - DNA, 601 bp, Human
tattggtgaaagaatagatgtataggtcaataaacagaacagagattccagaaatagacccttacatatacatacatatagtgaactgatatttgacaaatatacaaagacagttaagtagataaaggagaatccttaaaatgaacctccatccatacctcaaattctatataaaaattaactcaaaatggatcataggcctaaatgtaaaacctaaaactataaaacttttagtaaaaaacaggagaaaatatttgtaaccttggattaagcaaagatttcttagatatgacatcaaaakcacagtcaattaaaaaaatgaactttttttcttcaaaaggccctatgaaaaggatgaaaaagagggaatacttgcaaattacatatctcataaaggacttgtgtccagaggatgtaagaaactcaaaacttaattttaaaataactaaatttaaaaatgggcagaagttttgaacaaatacttcactaaagaagatatatagatgttaaataagcacataaaaagatgctcaacattattagtcagtagagaaatgcatactaaagccatatgagatattaaaaccataatgagttgcca

SEQ ID NO: 34430 - DNA, 601 bp, Human
ataaaaagatgctcaacattattagtcagtagagaaatgcatactaaagccatatgagatattaaaaccataatgagttgccactacacatacacctattagaatatctaaaattaaaaacaaaaacaatatcaagtgctagtcagattggaaaacagttttgcagtttcttataaagttatacatatatgtattttatgacacagcaattttacctctgaatatttgcccaaataaaatgaaaactatattcacaccaaaactcatgcagatgttcatagtggctttattcatagtgatwaaaaaacaaaaacaactcagatattgttcaactgggaaatggataaacatttaaacattcccactccagaatctcacataaataaaatcatatagtatgtagccttttgagtgtgggagtagacttttgggttgtagttgtcaatagggcatccaggttccttggagtgctccatagagagtttctgagttggaggtcacgtccatagtagaggaagttaaccttgagataggaggaaagatgaggggcacaggtaggataaggaatgttaggtggagaagagcaaagtgttaggaaagt

SEQ ID NO: 34431 - DNA, 601 bp, Human
gagaaatgcatactaaagccatatgagatattaaaaccataatgagttgccactacacatacacctattagaatatctaaaattaaaaacaaaaacaatatcaagtgctagtcagattggaaaacagttttgcagtttcttataaagttatacatatatgtattttatgacacagcaattttacctctgaatatttgcccaaataaaatgaaaactatattcacaccaaaactcatgcagatgttcatagtggctttattcatagtgattaaaaaacaaaaacaactcagatattgttcarctgggaaatggataaacatttaaacattcccactccagaatctcacataaataaaatcatatagtatgtagccttttgagtgtgggagtagacttttgggttgtagttgtcaatagggcatccaggttccttggagtgctccatagagagtttctgagttggaggtcacgtccatagtagaggaagttaaccttgagataggaggaaagatgaggggcacaggtaggataaggaatgttaggtggagaagagcaaagtgttaggaaagtttttgacaataccttgaattagattatgtag

SEQ ID NO: 34432 - DNA, 601 bp, Human
aaagtgttaggaaagtttttgacaataccttgaattagattatgtagaaattagtctcatctgttaagagtaagggaaaggttgagagctgaagcgtgtagaaccagattagtacagctggtgtatcaaagactaaaaggggttaaatgagcagccctgaaggccagctgagattaaacacaaaatttcaactagacccagtctacatggtttcctgactttgcttagccatgttccacatccccaaacagggtgatgaaagcagaaggaaggggtttttctatggatgggtttggcatgrctggcatgacagaaagttaaggaagtaagaagttatttctggaacagtggggaggatcatttaattggccgagccatgaagtccgtgtcatactaaggaacttgttaagataccatagttagttacaatgacttttgacttgccttaacactatcatattttcttcatgaagaagtacccttagaaagaggccctcagaagagtcttctcttaagaagataaagaaggtagtggaaacgaacttcctgagcttttcaggctctaatggctgaagaatcaagaaagccttcagccccatcc

SEQ ID NO: 34433 - DNA, 601 bp, Human
gattctgctgcttccttccccaagcatatatccctgtagatgtgttcgtggtcctctttcattgttcattacatttcgcaaagggattccttattatccaactgtctgttgtttccaggtctcagctcgcgtacatggacatagggtactctgggaggaggtagtacattcagcatctgcaccagagcctccaaatactcagctccaatctgaggcaacccaacataaatctccagtgccccaagagtcacaagagagaggtgagtagccagatttcattgatgataagggggggaagtasaaataaaagtccatttgggatacctatctagttcctgaagaaccaggaactaaaatcctgtttacagaccagtcccaaagtctgtgtttaaatgtttaggcttcaaatatagattattctttctagtggtaaactcatgaacaaattaaataatttgacttttttttttttaattttttttccttttattattatactttaagttttagggtacatgtgcacattgtgcaggttagttacatatgtatacatgtgccatatttctgttaccacagtacatttacaacatacatttttgag

SEQ ID NO: 34434 - DNA, 601 bp, Human
tttgggatacctatctagttcctgaagaaccaggaactaaaatcctgtttacagaccagtcccaaagtctgtgtttaaatgtttaggcttcaaatatagattattctttctagtggtaaactcatgaacaaattaaataatttgacttttttttttttaattttttttccttttattattatactttaagttttagggtacatgtgcacattgtgcaggttagttacatatgtatacatgtgccatatttctgttaccacagtacatttacaacatacatttttgaggttatgctggtatwgtcatgccactttatttggaaatatttcagtatgtatttcctcagacaagagcatttcttaggtaacttaaataaataaattcctaaatttatcacaattaagaaatgtagtattgctacaatactaacctaggccatagttcatattttgacagttgccccaattatgttctttctggttcagagtctagtctggcgtcacactttgtggttagttgtcatggctgtttagtctcctttactttggaatagttcctcaacctttctttttttttgaagagtacaggtgtgttattttgt

SEQ ID NO: 34435 - DNA, 601 bp, Human
tgtctttattttgtttttgttttgtctttgagacagagtctcactctgtcatccaggctggagtacagtggcacgatctcagctcactgcagcttctgcctcccgggttccagcgattcttaatcctcagcttccccagtagctgggattacaggtgcacgccaccatgcctggctaatttttgtatttttgtagagacgaggtttcactgtgttggccaggctggtctcgaactcctagcctcaagcgatctgcccacttcagcctcccaaagtgctgggattacagccatgagccactktgctcggccactgtctttattttgctaaatcatctcagatttggccatagaaggccccttcagtctggctcttgtatcctcttgacattttcccattgtttttttgagaatttttttactttattgcagaatgaggtgttccagtctcatcttcccctgcatttcatattttttcattaatgtgatttagagtagtttataaatatgaatttttaatatttctaaagaagcattaaaacacttaatacttcttgtctaaagtcctaaagcttgttacctgagatacagtaatctatattt

SEQ ID NO: 34436 - DNA, 601 bp, Human
aagattgaagacatggctgtgtcccttattcgagaggagtggcttcttgatccatcacagaaggatctgtgtagagataacaggccagaaaatttcagaaacatgttctccctgggtaaggagaggtgtggttattattgtcattttagattttttgtttgtttgttgtttatgtgtatagtagctacagcctttctgaaagacatagttaagtttaactcaggatccagcagagggatatgatgttgagatttcttgaaatcttacgtgaaacttttgttctcctgtccagaacttcctwacattttgtaccagggtactggcgtttttgccagttggaaattgacatctcacaggtgctctctgagttcatatatttcttctccaagttgtcatgggattcctacatatatttttctcacataaattaattgtatctcctcccttttgatgactgggcattttcccatttctgtcctgctcattagttcttttagtagttccatattcctctccccaactttcacctcacttcagttcatcctttcctgactttagttccccttccaattaactctctttttttaatggtacctctttc

SEQ ID NO: 34437 - DNA, 601 bp, Human
agattgaagacatggctgtgtcccttattcgagaggagtggcttcttgatccatcacagaaggatctgtgtagagataacaggccagaaaatttcagaaacatgttctccctgggtaaggagaggtgtggttattattgtcattttagattttttgtttgtttgttgtttatgtgtatagtagctacagcctttctgaaagacatagttaagtttaactcaggatccagcagagggatatgatgttgagatttcttgaaatcttacgtgaaacttttgttctcctgtccagaacttccttacattttgtaccagggtactggcgtttttgccagttggaaattgacatctcacaggtgctctctgagttcatatatttcttctccaagttgtcatgggattcctacatatatttttctcacataaattaattgtatctcctcccttttgatgactgggcattttcccatttctgtcctgctcattagttcttttagtagttccatattcctctccccaactttcacctcacttcagttcatcctttcctgactttagttccccttccaattaactctctttttttaatggtacctctttcc

SEQ ID NO: 34438 - DNA, 601 bp, Human
ggtactggcgtttttgccagttggaaattgacatctcacaggtgctctctgagttcatatatttcttctccaagttgtcatgggattcctacatatatttttctcacataaattaattgtatctcctcccttttgatgactgggcattttcccatttctgtcctgctcattagttcttttagtagttccatattcctctccccaactttcacctcacttcagttcatcctttcctgactttagttccccttccaattaactctctttttttaatggtacctctttcccagttgactagctsatattaagcaaggtcactattaagaagctattttggagacagaagttttgtgtttacttatagctgttcatgtgtactttccttttcccctatcttcagttcctttctcctagcataaagaataggttgtgacattggcttgatgtttgtttattacatttttatttcaggtggtgagaccaggagtgagaacagggaattagcttcaaaacaggtaatatctactggaatccagccacatggagagacagctgccaaatgcaacggggatgttatcaggggtcttgagcatgaagaagc

SEQ ID NO: 34439 - DNA, 601 bp, Human
gactttagttccccttccaattaactctctttttttaatggtacctctttcccagttgactagctcatattaagcaaggtcactattaagaagctattttggagacagaagttttgtgtttacttatagctgttcatgtgtactttccttttcccctatcttcagttcctttctcctagcataaagaataggttgtgacattggcttgatgtttgtttattacatttttatttcaggtggtgagaccaggagtgagaacagggaattagcttcaaaacaggtaatatctactggaatccarccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgt

SEQ ID NO: 34440 - DNA, 601 bp, Human
agcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaataytccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccact

SEQ ID NO: 34441 - DNA, 601 bp, Human
cctctagattctgaaagcaaattaaggggcgttgaatggactggttttcaagcgcagaatgtagcagttcccgattcccttttccttagttcattgattctcaaaccttataatacatacaaatcactgaggagcccgttaaagggcatattctgggtctccctgtacttctctccacctcccaattcagattccccagatgtctgccatagggcctttcaagctggaattcagctgctgcgctgtgcttcctggcattttggagacacacattttgggaacacccccatgggtttcaggkgcttcctgcgtctgtggagaaaacttttcccttgggcttctttggcttcttaggattgtcctcaaaaagaagttgaccttgggcaatctacttaactttccctggcttccatttcttatctagtgaaataattattataataaaacctcagtgggtaattgtgaggatgaaatatagtcttgtatctgaaagcatattgtagacttgtgcagtgttgactgttattcttcagtagcagcagggcggtgtggaaagctccaggacttggaatccacctaagcctttctttctgtaaattta

SEQ ID NO: 34442 - DNA, 601 bp, Human
ttcttcacataaagaaatcaagattgaaagaagatttaaaaacttggcacaaggtcacacaactagtaaatattaggatcagaataaaacctaggtctgggtcagctgtggtggctgacgtaatcccagcactttgggaagccaaggtgggaggatcacttaaacccaggagtttgaggttgcagtgagctgtgattatgccactgcactccagcctgggaaacagagtgaaattccccatttaaaaaaaaaagaaagaaagaaaacccatatctgggtaacttaaaagcttatgctcttwgcacattatgaatatatatatttccattatttccatcctttggtcaccaaatcacttttcagagaagagctttagggcctatgataattgcttgtattatcagtttctgtcatcagctattatcatttttctatataaataatttatttttactgcttaggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttc

SEQ ID NO: 34443 - DNA, 601 bp, Human
ggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgaggtaggaagggagatttgctagagaaaaatgtgtatttyggcatgccaagaatccttgtcacttctgctttgtgtctccttgacattggtgataaaatactctcttcctgtttccttctttcttggaagtgtttatttcagacagttaatttcttcaaaagtcaaatcttgtctttttgtccccagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgag

SEQ ID NO: 34444 - DNA, 601 bp, Human
gtttatttcatttaccctagcaattatggatttctattacatggaactcatctcttgatttaaattaaagtgtatgtgttgagtaaattctgtgcagaccttcttatagcttctgtgactttatcagattaaaattgcttctgatatcattttccctctttatgagcatctttccagtcaatttgtttctttcttcttcctctctctatgaacttggaccttttattttctagccacttcctttcttctaccttccaaactgcatctagaaccctgctgagtatccccttttccaagaagyacatctatattttccacctatccacttatctatccatctatcattcaacaagtgtttattaagcatctactatggctgtaggagaatatccagagggcatctggagactggagtgttctccttgtaggatatcagcgcaggtatgtgttacaaatttagataaagccaatattataaaacaacatagtgtttgaaattacaaggaccaaattcaagttccagcttttcaaattcttagccaagcaatatttaataggtaagcttgagtttctttttaagttatgctgattatttaaaaat

SEQ ID NO: 34445 - DNA, 601 bp, Human
tccttgtaggatatcagcgcaggtatgtgttacaaatttagataaagccaatattataaaacaacatagtgtttgaaattacaaggaccaaattcaagttccagcttttcaaattcttagccaagcaatatttaataggtaagcttgagtttctttttaagttatgctgattatttaaaaatccaaataatacaaaagtttatatagtaaaaaatggaagttttccaaatcctactccctagaggtagctactcttgtcactttgctgcatattttgcagacgtttctctatatagtctgyctacccatatatatgtatcttcccatatttttctttttttttttttttgagacagagtctcgctctgtcgcccaggctggaatgcagtggcacgatctcggctcactgcaagctccgcctcccgggttcatgccattcttctgtctgagcctcccaagtagctgggactacaggcacccgccaccatgcccggctaatgttttgtatttttaatagagacagggtttcactgtgttagccaggatggtctcgatctcctgacctcgtgattcgcccgcctcggcctcccgaagtgctggg

SEQ ID NO: 34446 - DNA, 601 bp, Human
agtttctttttaagttatgctgattatttaaaaatccaaataatacaaaagtttatatagtaaaaaatggaagttttccaaatcctactccctagaggtagctactcttgtcactttgctgcatattttgcagacgtttctctatatagtctgtctacccatatatatgtatcttcccatatttttctttttttttttttttgagacagagtctcgctctgtcgcccaggctggaatgcagtggcacgatctcggctcactgcaagctccgcctcccgggttcatgccattcttctgtctsagcctcccaagtagctgggactacaggcacccgccaccatgcccggctaatgttttgtatttttaatagagacagggtttcactgtgttagccaggatggtctcgatctcctgacctcgtgattcgcccgcctcggcctcccgaagtgctgggattacaggcgtgagtcacagcgcctggcccatatttttctatagttctttaaagagatgggataataacatcgagttttgtggtgagtcagtttgataatatatctgaaagtgcttcataagtcatgaaagttgtataaatggtaat

SEQ ID NO: 34447 - DNA, 601 bp, Human
cgtttctctatatagtctgtctacccatatatatgtatcttcccatatttttctttttttttttttttgagacagagtctcgctctgtcgcccaggctggaatgcagtggcacgatctcggctcactgcaagctccgcctcccgggttcatgccattcttctgtctgagcctcccaagtagctgggactacaggcacccgccaccatgcccggctaatgttttgtatttttaatagagacagggtttcactgtgttagccaggatggtctcgatctcctgacctcgtgattcgcccgcctyggcctcccgaagtgctgggattacaggcgtgagtcacagcgcctggcccatatttttctatagttctttaaagagatgggataataacatcgagttttgtggtgagtcagtttgataatatatctgaaagtgcttcataagtcatgaaagttgtataaatggtaatcattaaaaggtgggaaatgtctgaatttttatattctacccagctcccttatggatttcagatttaatacgaagtttgaggagaagggcagtactgatcccacttggggcccatctgttctctacagacacatt

SEQ ID NO: 34448 - DNA, 601 bp, Human
ttttgtggtgagtcagtttgataatatatctgaaagtgcttcataagtcatgaaagttgtataaatggtaatcattaaaaggtgggaaatgtctgaatttttatattctacccagctcccttatggatttcagatttaatacgaagtttgaggagaagggcagtactgatcccacttggggcccatctgttctctacagacacatttttattttccaaacctgttgtgatcccccagctaaaaggaggaggagaaacatggcctaacaacagaggagtcctaagaggtacctattcttgtrtgtgagagacaggacagttagatatgggagaaagaggcaaatattttggtcaaaagaggaggcctgggtctgttgtcctcggcctttttctgggttgcaaagtgaaatcagactatgtgccaggcatgtttctcaggaataaaacagaaggttcctcctctcgtagagattagattgtagcaagagggagataataataaatataaaagtaaagaaatgatacagtgtgttaaaaggtgatgaggctatggaataaggcaaaaatagaacaggataagggagattaagagtgctacggat

SEQ ID NO: 34449 - DNA, 601 bp, Human
ttggggcccatctgttctctacagacacatttttattttccaaacctgttgtgatcccccagctaaaaggaggaggagaaacatggcctaacaacagaggagtcctaagaggtacctattcttgtatgtgagagacaggacagttagatatgggagaaagaggcaaatattttggtcaaaagaggaggcctgggtctgttgtcctcggcctttttctgggttgcaaagtgaaatcagactatgtgccaggcatgtttctcaggaataaaacagaaggttcctcctctcgtagagattagaytgtagcaagagggagataataataaatataaaagtaaagaaatgatacagtgtgttaaaaggtgatgaggctatggaataaggcaaaaatagaacaggataagggagattaagagtgctacggatgaggcaaacagattgtgatattaaatagaagaattaagatagacctcattgagaaggtgagttgaacaaagacttaaaggaagcgagagagtgggccttgctttcatttgaggtgagaagtttccaggaagagagaagcactagagcaaaggtcttatgatgggaatgcaccttg

SEQ ID NO: 34450 - DNA, 601 bp, Human
ggaataaggcaaaaatagaacaggataagggagattaagagtgctacggatgaggcaaacagattgtgatattaaatagaagaattaagatagacctcattgagaaggtgagttgaacaaagacttaaaggaagcgagagagtgggccttgctttcatttgaggtgagaagtttccaggaagagagaagcactagagcaaaggtcttatgatgggaatgcaccttggataattgtggatttgaaattcataaagtatagtagtcctcactattcaagggggatacattccaagacccccartagatgcctgaaaccaagggtaatactgaaccctgtatatactatttttttcctatacatacctaagataaagtttaatttataaattaggcatagtaagagattaacaacaataactaataataaaatggaacaattacaattataataatatgccagcctcactacttttgcactttggggccattattaagtaaaataaggggtatgtaaacacaagcactgagacactgcaacagtcaatctcataaccaagatggctactatgtgtgcaacaggcaggcagcatgtacagtgtgg

SEQ ID NO: 34451 - DNA, 601 bp, Human
ggagattacagtgagccaaggggcaacagagtgagactccgtctcaaaaaaaaaaaaaaaaaattgtttgcctctggaatcttccatgtagtatatttgaactgtgattgactgtgggtagctgaaactttgtaaaggcaaaaccacagataagtggggactactggactgcctgaagcacctaagtagtagaagtttaatacttgttctgaaaatgaatgaatgaatacatgaagtaactttccttggaaagggtcactttgaggttatctcagaaaggagagagaggtgtaagggaatrctccagagaagccaccctaatctttaaccatccctccctatgaagtataaaaaaggtactgccagctgggtgcagtggctcacacctgtaatcgcagcattttgggaggccgaggtgggtggatcacctgaggtcaggagttcaagaccaggatggccaacatggcgaaaccgcgtctgtactaaaaatacaaaattagttgggcgtgggggtgcgtgcctgtagtttcaactacttgggagactgaggcaggagaatcgcttgaacctgggaaatggaggctgcagtgagctgagatca

SEQ ID NO: 34452 - DNA, 601 bp, Human
tgaagcacctaagtagtagaagtttaatacttgttctgaaaatgaatgaatgaatacatgaagtaactttccttggaaagggtcactttgaggttatctcagaaaggagagagaggtgtaagggaatactccagagaagccaccctaatctttaaccatccctccctatgaagtataaaaaaggtactgccagctgggtgcagtggctcacacctgtaatcgcagcattttgggaggccgaggtgggtggatcacctgaggtcaggagttcaagaccaggatggccaacatggcgaaaccscgtctgtactaaaaatacaaaattagttgggcgtgggggtgcgtgcctgtagtttcaactacttgggagactgaggcaggagaatcgcttgaacctgggaaatggaggctgcagtgagctgagatcacaccattgcactccagcctgggctacagagtgacactctggctcaaaaaacaaaacaaaaaacaacgactcaggccaagtctacatggggatggactgacctgcattatgccaaagagggcaaacgttcctccctacgtaggggaaagtgttaccacactagcccttctgttt

SEQ ID NO: 34453 - DNA, 601 bp, Human
atcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcrttttacctctttcttactcttactagctgtgtccctcttatttataatttatttatttttttgagatggctgctaaacccttctaataatataataaatggcactgccacagccaacatgcctgaaagatttggtatctgtgtttaactacaaaggataacagagttctactgatggtttataacaattgggtctttggtgttccctgtgaccagggtctacactataaacaccttttctaccttactgcttctctctgacacctacgtgactctcccttggaaagtgaccagcattggc

SEQ ID NO: 34454 - DNA, 601 bp, Human
acaggaggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccaggcctgcgtgttggatgaacttgacatggagctagccttcctgaccattgtctgcatggaagagtttgaggacatggagagaagtctgccactagtgagtgacgcccctcactccacccaaggagggggacawgggtggtaaccttccctgcatccaggcagacccaaattcaagtcctagccctgaccactgctgtctgtgcagcccaggaaaacaactacccttctttattttatttatttttttattttttcttgagacagagtctcgctctgtcgcccaggctggaatgcagtggcgcaatcccagctcactgcaacctccacctccagggttcaagtgattctccagcctcagcctcctgagtagctgggattacagttgtgtgccaccatgcccagctaatttttgtgtttttagtagagacagggt

SEQ ID NO: 34455 - DNA, 601 bp, Human
gctttgtgcagaaacccttggaagatcagacccagctccttacccttgtctgccagttgtaccaggtaagctgggaggggagcagtgggattcaggtggtgggggtagggtctccttccaggaccccaactcatggccttcacctccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctrcttaccaactggaaaattttatgcatcccatgaagcccagatacacaaaattccaccccatgatcaagaatcctgctccactaagaatggtgctaaagtaaaactagtttaataagcccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtg

SEQ ID NO: 34456 - DNA, 601 bp, Human
gattcaggtggtgggggtagggtctccttccaggaccccaactcatggccttcacctccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaayggtgctaaagtaaaactagtttaataagcccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaattttaaaaaagtgactggttgtggccgg

SEQ ID NO: 34457 - DNA, 601 bp, Human
gttttacagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcartgtacctaatatataccaggacaccacaatttcttggtggaaagatgggaaggaattgcttggggcacatcatgcaattacacagttttatccagatgatgaagttacagcaataatcgcttccttcaggtatgtgttctttcttccttttttatttttttagttttaatatttatttatttatttatttatttatttatttatttacttattgagacagagtatcattctgtagcccaggctggagtgcagtggcacgatctcagctcattgcaacctccacctcctgagttcaaacga

SEQ ID NO: 34458 - DNA, 601 bp, Human
tgtgaaaagtaccttcacagcaacatctaggctagggtttgaccaaacaactgcgtacaatggcctagccaagctgacatataaaattaactatcacagcatatgacaaagaagttgaagaagtttccatcctataataggaactcaaagggtagtcactgtaaatatcttcatgtgtttttctttgcagcataaccagtgtgcagcgttcagacaatgggtcgtatatctgtaagatgaaaataaacaatgaagagatcgtgtctgatcccatctacatcgaagtacaaggtaagtccayagaccagagtcccattgccagagaactgtttgttttagggcctgtgttaaatgttttgtgtataatactctagagttttgcctgcctatttataactctgtatgcaaaccttgcaaatctatcagcactgaaattttacaaggtactccactttgtagtctataagtaataatgaaatgaattcaattcctgaagtttgagctctattataggcattacaggtgagataaaaagagattttggacttccttgtccacagattattgacaataaaaataagctgaagacttctttttaaga

SEQ ID NO: 34459 - DNA, 601 bp, Human
ctttgttttactctgcgtttattttggtaagaaatactgaaaacctgccaactagtcagtcccaggagtttgagcaacacctgatgtaagaactgcctgtggcctgccttctggtaaaaccagttctgagtcactatttatagcccctttggcaaagcatcctagaaagctggcttaaagtagactggcaggaattagcctctgtgctccttcttatccaacttaaggaggtgaaaactgattaatacagacctgcctgaggctgtagataaagaactcttgtttgccaaggctgggcgcrgtggcacgcctgtaatcccagcactttgggaggccaaggggcaaggatcacttgaggtcaggagttcgaggccagcctggccaacatggtgaaaccccatttctactaaaaatacaaaaattagccagacctggtggtgtgcgcctgtaatcccagctacttaggaggctgaggcaggagaatcacttgaacccaggaggtagagattgcagtgagccgacatcaggccactgcactccagcctgggtgacagagcaagactccatccccacccgccccccacaaaaaaagaaatctatt

SEQ ID NO: 34460 - DNA, 601 bp, Human
tttgccaaggctgggcgcggtggcacgcctgtaatcccagcactttgggaggccaaggggcaaggatcacttgaggtcaggagttcgaggccagcctggccaacatggtgaaaccccatttctactaaaaatacaaaaattagccagacctggtggtgtgcgcctgtaatcccagctacttaggaggctgaggcaggagaatcacttgaacccaggaggtagagattgcagtgagccgacatcaggccactgcactccagcctgggtgacagagcaagactccatccccacccgccccccrcaaaaaaagaaatctattgccaagttctagtccagtttccattcccctttgggctctgtctctgttttcagatctgaaacattcttttgtgtaacgttttctccgcaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggtaagtccgagccgtggg

SEQ ID NO: 34461 - DNA, 601 bp, Human
aaaatgtaatcgaatcattcaaatggataggtttaattgcatcgtattttctatttgttctatctgtaatttgttctccttttcttctttttcttcatttaaaaatattatttttatatttttaatattaatatttttatgattctatgtttaatatttttatgattcttattttttattctttgtttggcttattagccatagctctttttctgttcttttagtggttgctttaggattcacagtgtacatatttaacttatcacagtgtaccttcaagtgatttataccatttcacatrtattccattttctccttcagatatttttggctactgttgtcaaatattttactttaatgtatcttaaaataccattgctacactgttgttatttttgttcagtcagtaatcttttacaaagagatttatataaccaggaaaaacacatgtttatgcattatagttaccatttctagtggtcttcattttttggtctttatattttatctgacatcattctccttcttcctgaagaacttttttaaaaatcatttcttctagtgtggatctgctggtatggtattcagctcctgtagtctg

SEQ ID NO: 34462 - DNA, 601 bp, Human
tagtgggaaaccgtttaatcctgtagggtcttgcttttaagatttattaggcagaacctgataagggctcagtctcaggtcggttattacccactgctgacacaagaccattctgtgtgccctactcagtgcttcttgaatcattagattttccagtctgattgatgggaacaggcactattcttcccccgtgtgaagcctggataccattacctttaactgtttcgtgtggttctttttctattttcctttagaggcatcctaaggattctggtgccttctcctgggtatttgcctttcktagtttatgccctcgtttttatggagcccattctcaattagcttccacaaaatgtatacataaaaagtaaagattgtgggaacttgcatatccttatgtaatactggcttagtaatttttccaaatatagaaatttaggttgaaattattttccctcagaagtttaaaggcgtttttgtatcattttttagcttcatgggttgctgtggaaaattctgatacttaagttttctatgtgaactgtttttcagttttagtttttaaaatatcttttctctttaatcctggttctgtgataag

SEQ ID NO: 34463 - DNA, 601 bp, Human
gtttaaaggcgtttttgtatcattttttagcttcatgggttgctgtggaaaattctgatacttaagttttctatgtgaactgtttttcagttttagtttttaaaatatcttttctctttaatcctggttctgtgataagctgtgatgtgcaatttgttttggtcatcaagggcattcagtggcccctttgatctggaaatgcaagtcttttggtccttaaacttttttttttcctttggaaatgttccactctctgttttttccaggaattgtgttagacgattgttaattagacctcttygattgcttcctcaattttcttttttcaaattggcctattttctttgcctttttattctaccttcttggagatttacttgatttatcttccaattcttctattaaatattttattttacttatcatgttgctaatttcaagtttttttcattgaaaatttttttctggttctcaatcataagagtcttttctggatatctcaattattttttgtttgtttgtctttagtctccctagttccctacactagctttgtctcctctaagccctctgttctgtgtggttttttttggtccctgat

SEQ ID NO: 34464 - DNA, 601 bp, Human
cttgttatttagtatataaactttcacttattttcccagttttcagcctggctccttatcatgcctccattctacaggtgccctaagtttagtggctttctgcttcagagaataaatcaccctgtgtcctatggatatttgagggcatacttgccaggtgtgtaggcatggagaagacagactttgagacgcaactatttcttttttttttttttttttttttttgagacggagtctcgctctttcgcccaggccggactgcagtggcacaatctcggctcactgcaagctctgcctcccrggttcatgccattctcctgcctcagcctcctgagtagctgggactacaggcgcccgccaccacgcccggctaattttttgtatttttagtagagacggggtttcaccgtgttggccaggatggtctcgatctcctgacctcgtgacccacccgcctcggcctcccaaaatgctgggattacaggcgtgacccactgcgcccggcagagacacaactatttgttaatcagacttccaatcattctttccagttttagtccccattttactacctgggcccacagcttctgagctgctctgt

SEQ ID NO: 34465 - DNA, 601 bp, Human
tgggattacaggcgtgacccactgcgcccggcagagacacaactatttgttaatcagacttccaatcattctttccagttttagtccccattttactacctgggcccacagcttctgagctgctctgtgattctttgggagaatattggcttgctgagttaattataccttcttcatctctttttcagctttcaaatatgtgttgaaatctctcttctactgttgactcctctttgccttgtgagtttatatctttttaaattctttattgccatcatagaggggttttgggaggaggcaracatacagacatgttgtgttggccatatttatccacaaattctacaacaggtttgaaagtgtgcgactgatttcataggcagctttagttgtgtgatgttttctaagctgaaattcattttaacttcatgattactgtttctggaatcagcagagaaaaagagggttatagtatcctttcacacatatctgaaatatagaatttaacctcccctcattcaactacaggcaacagtttggtgtatattattctaattgttattattctttctagatatagaaggtttattgttttaatttc

SEQ ID NO: 34466 - DNA, 601 bp, Human
aatttaacctcccctcattcaactacaggcaacagtttggtgtatattattctaattgttattattctttctagatatagaaggtttattgttttaatttctaaaatggatctatatactttttacaatctgatttttcccccattggatttttttatatcaatacacatgacctaattctttccagtgacgaggtagtaagtattccattggaaaatgtatcaaaatttgtattattattattatttgagacagagtctcactctgttgcccaggctgaagtgcagtggcatgatcttgrctcactgcaacctccatctcccagattatatcataattattgaccaagcattgcatttatttctatttgtcactattatgctgcaatgaatataacatcacctacagattaaattcctggaaataaaatatttggtcagagagcatattattttcaattttaatagatatagttaagttattctctcccaaaaaagactgtagtaatgatcttgacttgtttcccaaattattttatacacgtacactcgtgtacacacacacacacacacacacacacactttttaaatgtgttgacag

SEQ ID NO: 34467 - DNA, 601 bp, Human
gaaataaaatatttggtcagagagcatattattttcaattttaatagatatagttaagttattctctcccaaaaaagactgtagtaatgatcttgacttgtttcccaaattattttatacacgtacactcgtgtacacacacacacacacacacacacacactttttaaatgtgttgacagattagctctgttcagactgtcagtaacttgcctctggactttaaaatggtggctgcattctgagctcagcagtgtttcctaccttgtgcatctcaaatgccaccaagctgatctctagcyggccatgttaactttctgccccacaggtttatgctggagaacattgttcaagttgtgtctgcttcacttccccaggagtccagagcaccacccaccctaccttccctgccttcttcttctttgctattttactttaggtgctcatgaaatttcctttttttttttttcttttgagatagggtcttgccctgtcacccaggctagagtgcagtggtgcaattacggctcactgtggccttgactttccagggtcaagtgatctttcctcagccactcaagtagctgggactacacacctgt

SEQ ID NO: 34468 - DNA, 601 bp, Human
ttttctttctctttctctttctttccttcttttcttccttgcttgctttttctgcccaggctgaagtgcagtggtatgatcatgtctcactgtagcctcaatctcctgggctcaaggaatcctcctgcctgtctcctgagggactggaactacagatgtgcaccaagtagtcagctaattttttagttttttgttttgttttgtagaaagggtctcactatgttctggctgatattttcaacttaagaaatgaatttctaggcttcagtaacctaaaagggctcacttatttaaaactcaytgatatctcagtgaaaatcttagttgaaaaggtgaaaatgtgctataagtcttggtctcatttgagtgcttttcatagagcatttgaaaaccaaacacttgaaaacccagatgagaatacatctgtgtgtgctttgtggttcttcattcttctctccttttttcttttgtagccccatcagtagcacctttaaatgtcactgtgtttctgaatgaatctagtgataatgtggacatcagatggatgaagcctccgactaagcagcaggatggagaactggtgggctaccggatatcccac

SEQ ID NO: 34469 - DNA, 601 bp, Human
cctgtctcctgagggactggaactacagatgtgcaccaagtagtcagctaattttttagttttttgttttgttttgtagaaagggtctcactatgttctggctgatattttcaacttaagaaatgaatttctaggcttcagtaacctaaaagggctcacttatttaaaactcactgatatctcagtgaaaatcttagttgaaaaggtgaaaatgtgctataagtcttggtctcatttgagtgcttttcatagagcatttgaaaaccaaacacttgaaaacccagatgagaatacatctgtrtgtgctttgtggttcttcattcttctctccttttttcttttgtagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccgtaagtctaaaccctagaagagcacgattagtcatctcctttcaacttgctggtttacttcagttttagaagctttcatttggttttgaaaagacctggtgtg

SEQ ID NO: 34470 - DNA, 601 bp, Human
ccctttttggcaaaagttaaaatagttgagaacaaagaaggatcaatagacagatttctaacaaaagccaaagatgtcgaagaagaatggatatttttaatgtacaaaatgtctttaaaagcagcaagtagatagccagacattgccatgcacagctctgtgggctaatttactgcaatcaggagcttgacctggggttaaaaggactcacaatgtcatgaaatgtggcagaaaagaggaaccttctagggtgacagaagatgggtagaggccagggatttaaagaaaacttctaactagygaacataatctcaagcctcatttcctgttttcctggcaaccaactccgaggatgatttgccaacatgctttatagtaattatggtttgagctttgctgaatcagagagtgggggcttctggtttaaacagcggaaataaacagacactagtgttcctgaataatttcagaaaaagtatagaaaggacatgcaaatattaacaaattcatgcttctggatgtttgcccccaataaagaaaatagataagaatgacagaatacaggttgctatgaaatagaaacttgcttggtgtagaatat

SEQ ID NO: 34471 - DNA, 601 bp, Human
acatactatgttactcctttttcagtacatagcttgggagtcagtgaggaactacaaaataaactagaagatgttgtgattgacaggaatcttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcamatgaaaagattctcttcaatgcctagcacatacaggtccttgaaaaatattaattttctttcttcattgaaaagcatgtaattcattgattagtttcctatgtactttaagtttattcctctagttcttaagttcattgttcttggcacctttctaattaggaacaaaaatgaaaatacgtatttaacttgttaagttgttcttaggatgaatgataatggtattaaaagtttgtgctttaaaaacttcaataatatttttcatgttctcttctaagtgtcttggattggttataatgct

SEQ ID NO: 34472 - DNA, 601 bp, Human
cttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcacatgaaaagattctcttcaatgcctagcacatacaggtccttgaaaaatattaattttctttcttcattgaaaagcatgtaattcattgaktagtttcctatgtactttaagtttattcctctagttcttaagttcattgttcttggcacctttctaattaggaacaaaaatgaaaatacgtatttaacttgttaagttgttcttaggatgaatgataatggtattaaaagtttgtgctttaaaaacttcaataatatttttcatgttctcttctaagtgtcttggattggttataatgcttaataaagtgatgagcaaaggtaggcccaagccacccaagctcgtgacaagcaggagactagagcgtggcgcatcaccctggtttgcgat

SEQ ID NO: 34473 - DNA, 601 bp, Human
aacataacttataacattgaggttttcacccagacttttcttcataatgatgttttctgaggctaatagtaataatgagtttgcattttctggacgctgatgggctcaggaatgatttgagttttccacagaattctaggagagtgtgaattaaattgtcctcagttactcaaaggcaagacacagaggtggttgtgttataatttttattaatttaaggttatgcatgagttagatagcagtgggataaaggtgaaaaagtaggcaaattccgtaggtttatctttgagaaataatttattaacctgtttgaaagtactgatttcttaagatcatgatacattgatgatttcatggaatatgatttaacagttccatagaacatgatttaacgtaatttggctttgcagctccattagccaaaaattacaaaagaggagattaagtatggagtggatgctgtgtaagtggctctgtcccaagagagaagagtaacctggaaataattgaattttctgctgaccttggtgttttgtttttgctttgccatcctgtgactgcatacatgctaagttcttttgggatctttcaaagtttcata

SEQ ID NO: 34474 - DNA, 601 bp, Human
cctagttcaatactagttcagtattgactttgagggttgtagcgttaaggaatcatagccactggggacattgtgtctttcatttcctaggcctccttatctgaaacaaaaatcttatggggtcactacccctcagactcagtggaacagaaattcctaggtttctagatggctatacttgttacagtttaatttgtgacagccctcatgccctcattaatctgaaagggggaaaaataccagtagtggaccctgtgtgtgttccattttctagaacagagtgtgagttaggcgctcttgrttttttcaaactgttaacttggtaacacacggcttcagtttttccagtggtccacgagggcttttctggtcacagtaacaaggactctttgtaattgatgctgtgtttgtaatttcaggtgtgtgtatagaaatgagctctcaaggcatcccaaagcccatggtaattttacccttcatgaaatacggggacctgcatacttacttactttattcccgattggagacaggaccaaaggtaatgatctccttgtgttacccctgaacacttctcagggcttatgtgacttagccaggacaa

SEQ ID NO: 34475 - DNA, 601 bp, Human
tttcatttcctaggcctccttatctgaaacaaaaatcttatggggtcactacccctcagactcagtggaacagaaattcctaggtttctagatggctatacttgttacagtttaatttgtgacagccctcatgccctcattaatctgaaagggggaaaaataccagtagtggaccctgtgtgtgttccattttctagaacagagtgtgagttaggcgctcttgattttttcaaactgttaacttggtaacacacggcttcagtttttccagtggtccacgagggcttttctggtcacagtracaaggactctttgtaattgatgctgtgtttgtaatttcaggtgtgtgtatagaaatgagctctcaaggcatcccaaagcccatggtaattttacccttcatgaaatacggggacctgcatacttacttactttattcccgattggagacaggaccaaaggtaatgatctccttgtgttacccctgaacacttctcagggcttatgtgacttagccaggacaaccaaatcatctaatcttgaaagtgaagccaggaaggagaggacgttgacttttgttcagtgctccctgtgtgtccag

SEQ ID NO: 34476 - DNA, 601 bp, Human
taagttctgcccaggtgcggtggctcatgcctgtaatcccagcacattgggaggctgaggcgggggaatcacttgaggtcagttcgagaccagcctgaccaacatggtgaaaccccatctctcatgaaaaaatacaaaaattagccaggtgtggtggcaggcaccagtaatcccagctacttgggaggctgaagcaggagaatcatttgaactaggaaggctgaggttgcagtgagccaagatcacgccactgcaatccagcctgggcgacagagtgagactccatctgaaaaaaataaaraaaacaaggtttattaagttcattagttcactctgtgaacaagtgctgactctaaggtgggcactgagctctggggacactggagggaacatgacagatgtggttcctgccccatggagctgagctgctggtggtgagtgagaggagaacaggagacagacaattggttattcacagtgagggagctatgggcaccaggagcacaggggctcaaatgcccagtgggccaggcagagcccagtgggggcataggggcaggaagtgtgcaaggtaactagactggggggtgtggtgtctgcg

SEQ ID NO: 34477 - DNA, 601 bp, Human
tgtgcaaggtaactagactggggggtgtggtgtctgcgcacagatgcagaacctcatggtggcagggccaggacttcttcgtttcagtaacctggagaatgttggcagatagatcagaggtggtgattggaatatgaagccccatatgctgtggggtctgctgtttagaaggagggattgtgcagagaaatgtgcattcccttccccccgccccccacatcagtcactgagcatcctcatgtcagggaagccacacacagaaatgtgcattcacttcccccccacccccacacccagtcaytgagcatcttcatgtcagggaagccacattccttctaaaagatgtttgggccccatgtgctgtcagagaagcttcttgtttttggagtcccctcttcttggcttgttcattataacatctctggatgcagggtgcctttcagttccccggtggaggctgcatggagttgctttctagttgttcactgagggtgaacatgctccctccattcatcttctctttgtcatgagcctatccatcctcaggatcagaagatgtgttgggaattggtaggccagcttgcttgcctcagcagtgccc

SEQ ID NO: 34478 - DNA, 601 bp, Human
atcctcatgtcagggaagccacacacagaaatgtgcattcacttcccccccacccccacacccagtcattgagcatcttcatgtcagggaagccacattccttctaaaagatgtttgggccccatgtgctgtcagagaagcttcttgtttttggagtcccctcttcttggcttgttcattataacatctctggatgcagggtgcctttcagttccccggtggaggctgcatggagttgctttctagttgttcactgagggtgaacatgctccctccattcatcttctctttgtcatgagcstatccatcctcaggatcagaagatgtgttgggaattggtaggccagcttgcttgcctcagcagtgcccctaagaggggcagcaacccctgccctgaatccttccagcatggagaaactagagagaagcggaacctcagactgaagtgccccgacctccggtaacttatgaacttaataaccacaagtcacaggtgactgatagagttacagtgaaccatgatgacaagaatgacaactgagggccttcatgggggaagtcggcttagaaaaacactagtcctcatcccaagagacaggtc

SEQ ID NO: 34479 - DNA, 601 bp, Human
caagtgattctcctgcctcagcttcctgagtagctgggattacaggcatgcgctatcatgcctggcttattttttttttttttttttgagacagagtctcgctctgtcgcccaggctggagtgcagtggcgtgatctcagctcactgcaagctccacctcctgggttcacgccattctcctgcctcagcctcccgagtacctgggattaaaggtgcccgccaccacacccagctaattttttgtatttttagtagagacggggtttcactgttttagccaggatggtctcgatctcctgascttgtgatctgcccacttcggcctcccaaagtgctgggattacaggcatgagccaccgtgcccggccatgcctggctaattttgtatttttagtagagacagggtttctccatgttggtcaggctggtctcaaactcccgacctcaagtgatcagccgcctcggcctcccgaagtgctgggatgacaggcgtgagccaccgtgcctagctgttacgttgtataatttttctaataatttcttgggggtgtggaaatttcatgttattgtacaagagtgcattttgtagcaaaaagattaa

SEQ ID NO: 34480 - DNA, 601 bp, Human
gatctcctgagcttgtgatctgcccacttcggcctcccaaagtgctgggattacaggcatgagccaccgtgcccggccatgcctggctaattttgtatttttagtagagacagggtttctccatgttggtcaggctggtctcaaactcccgacctcaagtgatcagccgcctcggcctcccgaagtgctgggatgacaggcgtgagccaccgtgcctagctgttacgttgtataatttttctaataatttcttgggggtgtggaaatttcatgttattgtacaagagtgcattttgtagcaaaaagattaaaaatacacagggctatttggtggcccaaatagttttgtctattcaagaatgttacataaatggagtcatacgtttataaccttttttttttttctttttgagacagagtctcactctgtcacccaggctggagtgcaggggcacaatcttggctcactgccacctatgcctcccgggttctagcaattctcctgccttagcctcctgagtagctgggactacaggcgcctgccaccacgcctggctaattttttttgtatttgtactagagacggggtttcaccatgttg

SEQ ID NO: 34481 - DNA, 601 bp, Human
ctggctaattttgtatttttagtagagacagggtttctccatgttggtcaggctggtctcaaactcccgacctcaagtgatcagccgcctcggcctcccgaagtgctgggatgacaggcgtgagccaccgtgcctagctgttacgttgtataatttttctaataatttcttgggggtgtggaaatttcatgttattgtacaagagtgcattttgtagcaaaaagattaaaaatacacagggctatttggtggcccaaatagttttgtctattcaagaatgttacataaatggagtcatacrtttataaccttttttttttttctttttgagacagagtctcactctgtcacccaggctggagtgcaggggcacaatcttggctcactgccacctatgcctcccgggttctagcaattctcctgccttagcctcctgagtagctgggactacaggcgcctgccaccacgcctggctaattttttttgtatttgtactagagacggggtttcaccatgttggtcaggctggtctcaaacttctgaccttaaatgatccacccgctttggcctcccaaaatgctgggattacaggtgtgagcca

SEQ ID NO: 34482 - DNA, 601 bp, Human
gtgtgagccactgcacccggccattttataaccttttgagactggcttccttcactcagcattatgtctttgagatccaaccaagctgtgtatatcaatagttcattccttctttattgctgtgtagtattccattgtatgcttctaccacagtttatcttttcacctgtttagggacatatgggttgtttctaggttttagcaatcatgaatgagactgctataaaattcatgtacagatttgtggatgaagtcttcatttttctaaagtaaatgcccaagagtaggatgctgggtcatrtggtaagtgcatatttaaccttataagaactgttttccagagaggccattccattttacattctcaccagcagtgtgtgagaaatgcagtgctccccattcttattaggacttaatattgttgctggcttttctggtttttccttatagctgtcctgattgatgtagagtgatatctcatcatggtttttatttgcatttcccgaatgactaatgatgttgagcatcttgccatgtgcttatttgccatccttacatccgctttgatgagtgtctgttgttcaagtattttgtttatttt

SEQ ID NO: 34483 - DNA, 601 bp, Human
tgtagcttgtcattgcattctcttaacacgggcaaaaatattttaattttgataaagcccaatttatcagtttttttttaatgagtcatgcttttgctctcatgtctaagaactctttgcctaacccctagtaaaaagattttctcctatttcttttctaaagattgtgttcttttacattttacatttaagtatatgaccaattctgagttattttttgtatagggtttgagatttagtttaaggtttgctttttttgcgtatagatgaccaatagcaaaagactatcttaatccatgaraagactgtccttaatccattgagttgctctttgtctaaaagcagttggttgtacatttctgagtcctctgttctgtttcattaaactctgtgcccatcctttgcccctatcacattgtcttgattactgaagcttgttataaatcttaaaatcacccagtgtgattcttcctactttgttctactttttcagaattgttttaactattctggtttcattgcccttccactgaaactttagaatcagcttatctgtgtctggcaaaagttctgctgtaatcttatatccttttgaacaaaa

SEQ ID NO: 34484 - DNA, 601 bp, Human
cgatggcccaatatcaatgtatttaaacatgcttctccaggagggctagggtgctggacccatagtgccactctgcccagggcagacatcgtctctggagctgtgcagggcagacaggtagatgatgagacatgacccccagttctcatggagatcgatagtacaaagggagataggctgtaataacatatgcatcacacagtgatgtgagcagcctgctagagcttcagggaagaaatgagttctgactggagaaatgtttaaaatattctacactgctgactgggtgtggtggctcacrcctgtaatcccagcagtttgggaggccaaggcgggtggatcacctgaggtcaggatgtgtccggagttggttccttctggtgggttcttggtctcgctgacttcaagaatgaagccgcggacctttgcagtgagtgttacagctcttaaagatggcatggacccaaagagtgagcagcagcaagatttattgtgaagagtgaaagaacaaagcttctacagtgtggaaggggactcaagcgggttgccactgctggctgggggtggccagcttttattcccttatttgtccccacccaca

SEQ ID NO: 34485 - DNA, 601 bp, Human
acttgtggtgctttggtcctgtgataattggtgaagactctcctaatttctgtttagaagaaacgagtatctttcaaaacatttcgtagtaaaatggtagcagataggggtgcctaattggaaacagctcatcctaagtggacttttcccctccgaaacattagacccctgacacacacacacacacctcgccgctgctgaagccagaccacctgtccctttccctcctctgtgcaatgcgtgtgctctgtcccactctgaaggatacacggaaggatcacgtttgacctcataccttctraaaagaaacaatgtcattcactgtaaatacttttaaagatggggaaaagagaatatgatgtttgccaagaagtttaaggtttttctcattcctttttaaaaaccttatttgtgatattagtgatatggaaataaaagatttgtttccttatttcatcactacactgtaataaattaaagcatcctttccccccccggcagaaactgcttgcaagttttcctttttaaaagatagtctttcttcttgtttcctctatcatctagcatattcctctgcagacactattgaagttcatggtgg

SEQ ID NO: 34486 - DNA, 601 bp, Human
cactctgaaggatacacggaaggatcacgtttgacctcataccttctgaaaagaaacaatgtcattcactgtaaatacttttaaagatggggaaaagagaatatgatgtttgccaagaagtttaaggtttttctcattcctttttaaaaaccttatttgtgatattagtgatatggaaataaaagatttgtttccttatttcatcactacactgtaataaattaaagcatcctttccccccccggcagaaactgcttgcaagttttcctttttaaaagatagtctttcttcttgtttcctmtatcatctagcatattcctctgcagacactattgaagttcatggtggatattgccctgggaatggagtatctgagcaacaggaattttcttcatcgagatttagctgctcgaaactgcatgtaagagtcctcggctatcctggaagggtttggacctcatggtgtttggtctttgcagggttagtgagaggacctgttcctgtttagataggcaaggaagctgcagtcagcgggggatggtgtggcttgctccgaagatggaaatatggctgggtgtttgggagttttcactgcctctgt

SEQ ID NO: 34487 - DNA, 601 bp, Human
attatacaagaaatgtggacttaggttctccctatttcttcaacctgcttcagcagagccattgtctgctgtaaatcttcaaaaacaataactatgtcttgattttaagttttttattgcaagaagagggagtggtccttcaatgtattttgtcatttgtttttcttggtcagagatgtgacaatggggcctgccccctcccgcctcccagccgaccctgcccctagggctcctacctctttcacctcatttttgaaaacactaaaggggttttggttttgttattgttattatttaaatratttttcgaccatggagggagaatcatgaaaactctttttcccttactgtttccttcatgttttcccagcaggtagggtgaccagctttgcagtttaccctggcctgaggggtttctcaggacaagggattttgagtgtaaaaaggcagtgtcaagcaaacagggacaagttagtcaccttccccagactactttatatctatttcttctccttctcttccttttattctttcttctcctcttccttcttcttgtgtaggagctgttttagtagcttgggctacaaatgcagttgtagcc

SEQ ID NO: 34488 - DNA, 601 bp, Human
tgcagttgtagccctttaatttctcatttaattcctcaagcacccacctggccatcttagcaagaagcccagcatcttgctcttactgcaggtaattccccatcttccccaaactctcagggggcttacttagtcctcagggccagtgctgcttccagacctctgggaggaaggctgctggggtcctggatcagtccaccagagggctctggttttgagctgctgctctttctgctcctgctatgctgcgtctccatgttctccagctgtttctatccactgtgcacaggtgcccttgctrgtccacatcccacacagatcagagcgatgcaagactgcatcacttgaggctaggcgtggtagctcatacctgtaatcccagcactttggaatgccaaggcgggcagatcacttgagatcaggagtccgagaccagcctggccaacatggtgacactccatgtctactaaaaaaaaaaaaaaaaaaattagccggctgtggtagtgtgtacctgtaatcccagctactcgggagactgaggcaggaaaattgcttgaacccgggaagcagaggttgctgtgagccgagatcatgccactgc

SEQ ID NO: 34489 - DNA, 601 bp, Human
ccagcatcttgctcttactgcaggtaattccccatcttccccaaactctcagggggcttacttagtcctcagggccagtgctgcttccagacctctgggaggaaggctgctggggtcctggatcagtccaccagagggctctggttttgagctgctgctctttctgctcctgctatgctgcgtctccatgttctccagctgtttctatccactgtgcacaggtgcccttgctggtccacatcccacacagatcagagcgatgcaagactgcatcacttgaggctaggcgtggtagctcatrcctgtaatcccagcactttggaatgccaaggcgggcagatcacttgagatcaggagtccgagaccagcctggccaacatggtgacactccatgtctactaaaaaaaaaaaaaaaaaaattagccggctgtggtagtgtgtacctgtaatcccagctactcgggagactgaggcaggaaaattgcttgaacccgggaagcagaggttgctgtgagccgagatcatgccactgcacaccagcctgggtgacagggtgagactctatctcaaaagtctcaaaaaaaaaattgcatcacttgct

SEQ ID NO: 34490 - DNA, 601 bp, Human
ctatccactgtgcacaggtgcccttgctggtccacatcccacacagatcagagcgatgcaagactgcatcacttgaggctaggcgtggtagctcatacctgtaatcccagcactttggaatgccaaggcgggcagatcacttgagatcaggagtccgagaccagcctggccaacatggtgacactccatgtctactaaaaaaaaaaaaaaaaaaattagccggctgtggtagtgtgtacctgtaatcccagctactcgggagactgaggcaggaaaattgcttgaacccgggaagcagagkttgctgtgagccgagatcatgccactgcacaccagcctgggtgacagggtgagactctatctcaaaagtctcaaaaaaaaaattgcatcacttgctcttgctcttgctctgctgttggtcctcacttgctctgccattggtcccaatgcagcatgctcacaggctggtggtgtctctgtgttcttttggtcaattatcataagtgttttcacctgtgtctgatacagaccagtaatttaaggcattgcctctgacgctgctgaagacgtaacctgctctctgtaggttgcgagatgacat

SEQ ID NO: 34491 - DNA, 601 bp, Human
tgctctctgtaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtggtatgtacacagctttgattcaggggtcccacagcacaaagaggagggcatattgaaagaaatgacctcagctggtatggcaagacattttactctttgataaactgagggttggcagcttgctcagacctcttttatatcttaccatcagatactttaattcaagtggaacagtagattctgatgaagtgtcctgacattcagaagatgtgtgctttgcaaaagcccttaatttcttcccatttttccttgccgtcaaaggatgactcattgcccacaactaggatatttcatagtcacattaaattgaatgagttcatccactggctcttggaacctagatgctatatgaaaggtgctgtgtaattacgcccttgacccgagataaggaaaaaaaagcacctcacagcaacagtggaggagagcact

SEQ ID NO: 34492 - DNA, 601 bp, Human
cacaactaggatatttcatagtcacattaaattgaatgagttcatccactggctcttggaacctagatgctatatgaaaggtgctgtgtaattacgcccttgacccgagataaggaaaaaaaagcacctcacagcaacagtggaggagagcactaagcagatgtgtgacgaggctgtttctgcctttgccagatttcccagaacagcttttgtagaagtggggaactgtgacactccaaccccacgttattgccgcgttgggagagcagtgcgtctcacacataattgccagctttgtgcrtgatcatcagtgtttaaggaaatgacctttcccagtgaaaaagtccattcaggctttgtggaaaggcttgcatcctaacttgttgttgctttgttcccagtgggcatttggcgtgaccatgtgggaaatagctacgcggggaatgactccctatcctggggtccagaaccatgagatgtatgactatcttctccatggccacaggttgaagcagcccgaagactgcctggatgaactgtgagtgggcttctctgtctcccttccatactctgcatggggcagccacctggctctgcactg

SEQ ID NO: 34493 - DNA, 601 bp, Human
ttacattggctaatattaattaagtttatagatttatgaaagcagttgtttaatgtaaacttcttttaataaactttacagcagaaggtataggcgcagaactcaaagctccacttaagcaagaacctctccaagtaagaggtaaatatattttatcctatttttgtattataaagatgttttgaattaaatatataacattggtttatgtagagctctttatagttatattattctaagagtatagtttattttttacttttatttaaatagattgaccataaggatttattctcttacrtataaactaattttctattaaatttattttgcatttttgtcacaaattttttcaaaagcccaagaaaggaataatggcaaataagaatcatcaattgcattatcatttttagaagagtaaggcaattaaagaacaagaggcccacacttttcagctactgcttattcaaatccaggtagagtttggccgttattgtctgactttattttctaggagaaattgaaggaattcctgtttgtagctctcttctgtataacaagctgtggttcccatctccaaagcagctgtttcatggaggca

SEQ ID NO: 34494 - DNA, 601 bp, Human
ggcatcagataaaactggattaaatttgtggctccagtgcttaccagctggctgaccttgggcaatttacttgacttctctgaggcttagttttctcccctataacgtggtgctgaaaatgagacttcttttctagggtaactttgattaacacatggtagacaattaataacaattaatgttgttatagcagccatcattatcattatcatcctcaccttcatcattaataacctgggccagggttttttagctatttggaagaaatttttttaaaaattttttaaaaatttaaaaggcrgtttagagacatgaaactcacgcaaaaaaaaaatctgtatttccttatattttttttcagataaggttttgattttttaattgaactttatttttcaaatattcttattacataatatttgtgcatttaatgtaagtatgtattattttaggaatctttttacccactgtagtgataggtaatcttaggctgaatttgctctttcaacttggaagtagaacagaaaattgtgaaataataaatatgagaatagaacatgaagtgaatagatgacaattcgaaatagaacacataagtttg

SEQ ID NO: 34495 - DNA, 601 bp, Human
tttgattactttatatttctactttgtatgaaatgctgatttcacctcacagtttgaaaagcactcaactactctgttattttatttatttatttatttattattttttttggacagagtctgactttgtagcccaggctggagtgcagtggcatgatctggctcactgcaacctctgcctcccaagttcaagtggttctcatgcctcagcctcctgagaagctgggattacaggcacccaccaccacacctggccaattttttgtattttttttttagtagagacagggtttcaccatgytggccaggctggtctcaaactcttgacctcaagtgatccacctgccttggcctcccaatactctgtaattttttatcaaaacttcagttcattttcatttagaccctaagcaatttaaattataccaatatgatttagacagaccagtaatacctgttcaaggtgttcattagacaaaggttgacattttgggatcagttatagatgacatatagagacaaaagctagatggctacaaatgcaatttcatcctattctgcacttggataattttttctctgatgtcattcagtgaaaaag

SEQ ID NO: 34496 - DNA, 601 bp, Human
agaagctgggattacaggcacccaccaccacacctggccaattttttgtattttttttttagtagagacagggtttcaccatgttggccaggctggtctcaaactcttgacctcaagtgatccacctgccttggcctcccaatactctgtaattttttatcaaaacttcagttcattttcatttagaccctaagcaatttaaattataccaatatgatttagacagaccagtaatacctgttcaaggtgttcattagacaaaggttgacattttgggatcagttatagatgacatatagakacaaaagctagatggctacaaatgcaatttcatcctattctgcacttggataattttttctctgatgtcattcagtgaaaaagatcagttttctgtgaaattcattagtgaagcctcttaagtatcagcctatattcatcttcacatgtgactttcaatgtgcatatttattatgttttcctgttttttgtttagttaaagcagtccttaagaaaagggagtatggatcaaagtacactcagaataatttcatcactggagtcagagcgataaatgagttctgcctcaaatccaggtaat

SEQ ID NO: 34497 - DNA, 601 bp, Human
ccagtaatacctgttcaaggtgttcattagacaaaggttgacattttgggatcagttatagatgacatatagagacaaaagctagatggctacaaatgcaatttcatcctattctgcacttggataattttttctctgatgtcattcagtgaaaaagatcagttttctgtgaaattcattagtgaagcctcttaagtatcagcctatattcatcttcacatgtgactttcaatgtgcatatttattatgttttcctgttttttgtttagttaaagcagtccttaagaaaagggagtatggmtcaaagtacactcagaataatttcatcactggagtcagagcgataaatgagttctgcctcaaatccaggtaatttttttaaaaaatgtagccgtgtgtcatatctaaataatctaaataactattcctttcttagagtgtgttacctgctaccatccatatatggaaaatttgctactggctccttaaaatgaagagatatttttattcagtcaaaaatgttaaaaattgttagcaaactaaactgaatcctgccccagcattagcaattctagtctttcttagtttcttaaacccacaa

SEQ ID NO: 34498 - DNA, 601 bp, Human
aaaaatattaagagaatacagagatttcttgggaaataccaaggtatggatatctttgtaataatgtgtgtgtttgtgttgcacagcaaaattctaatatcagtccattgtaaaattctagcatgtctgtgatctcaatctaagattttcttgagtacattgtagttcactgaattatagtcaattcattcatttccgtctgattttcctttttttttttttttgagacagagttttgctcttgttgcccaggctggagtgcagtagtgtaatctcggctcactgcaatctccgcctcccrggtttgagcaattctcctgcctcagcctcccgagcagctgggaccacaggcatgccaccatgcccagttaatttttgtgtttttagtagagacagagtttcaccatgttggctaggcgggtcttgaactcctgacctcaggtgatgcgcctgcctcggcctcccaaagtgttgggattacaagcgtgagccaccgtgcccggcctgattttcttgaaatttaaaacatttgtacataagttttctttaaagtcataaccatgttatgaaccttaagcatgtagatatagatgaggaagac

SEQ ID NO: 34499 - DNA, 601 bp, Human
atttaaacttggctgggaggaatctcctatcaagaagttaatgtcatatttggataaaaggctacctatgcacattttcttctctctggtggcatttgagacattgcacccattttgcaaagtttagacattggcagtgatgataattttagccaaatcttatttgatatgctttccttttccatttattatcttcaagacctcttaatttccatttcccctttgatcactgcatttctggcaccccagtactgccctgaagatgtggactctcctctggtagagccttcatatgtcttaygagccagcattttcactctcatgcctcaagggctattgccattgcctcttgtgctgggataacttaggctggtgagacctgcctcctgggaagattcactcctcgccttcacatctgtttcacatggagaatcatcctcaccagattttctaatagtagctgttgacttatgaaatctttgttacttcagaagattaatactggtcaacttttgaatattccatgttttgaaatgattttttttgctattacaacgtttttttgctgggacattaggataaaactagtatttcatttccc

SEQ ID NO: 34500 - DNA, 601 bp, Human
ggtcaatacagaattttgggtgtctgatttcacacattcttagagcatatgaatttcagcacagtgcatttttctactttattactagtttttatgtagccagctcagatcctttctggaagtaggcaggacatgaattacaaggaaacaaaacaaacaagtttctggaaagagacccagatatgctttcggttttaatctttccactttctaaacaagaacttctagagaaaaataagtaaatctaattcagaagttttgatagaggaaaatgttctggtctgtcaaagccaccagttayagtgcttctctgcaaaattttggaggtattaaaaaaagtttttgtttttttacagccacgctccagaacagcatcagtgttttttaagggaccaggaaaagtggtgatggttgcaatttgcatgtaagtactgaaaaataagctttgtgaaatagaatatattcttttaaatatgtatatccttaaatatgtaaatttattacatggtagctagctatagagtttgaggtttattttgttttaggaggaaattgaataagtctttattattgtcagtaaagtggtggggaaagagcatga

SEQ ID NO: 34501 - DNA, 601 bp, Human
agcacatattttgatcttagaggtctgttttatttggtccaaggaaacatatattctagatttagactcataggctgcccaatctaaaattttgatgataacttctattagatacacacttattttaatcctcctgttgtgatttggaaatgtattttgttaatatttcagaattatttatttgtaaaatgagtatactttttagaatgtattattttgaatcatagccattatttgatacagagatttttttctattgcttctattaacataaccatctaacacttttgaattccacaarcatcattttaagactagcttcagtaatataatttgataaatcttaagaccaaaaaaagtgcacttttatttctgtaaaggagtctacctctattctttagaaatgcctttctttacttgaaagcaatactactgttttcccataaataacatatttgaatgttttgtaactgtcaagctagtatagagaatagctctctagtgtgttaattacccatcattacagtgttttaccatcttaagaaaaatttttttttcatggccagttttatgtacaaaagatttaaaaacagaaggtaca

SEQ ID NO: 34502 - DNA, 601 bp, Human
agtctacctctattctttagaaatgcctttctttacttgaaagcaatactactgttttcccataaataacatatttgaatgttttgtaactgtcaagctagtatagagaatagctctctagtgtgttaattacccatcattacagtgttttaccatcttaagaaaaatttttttttcatggccagttttatgtacaaaagatttaaaaacagaaggtacaaattttaaattttaggttgtgaagatttcttctcaaggtatttttatagtctactttagtgctgcccaacagaattttctrcaatgatggaaatattttatatctgtccagtatggtagtagctaactacatgtagctattgagcacttgaaatgtggccagtgcaactgaagaactagattttaaactatatttagttttaatttatttaaatttaaattgccacatgtggctagtggctcatcatattgggcagtttagacctacataatcaaaattttcaataagttaataattccttgaaatcacctgaagtaataccatttattttagatcttaatttactttaacgtgaatatatattcatgttactttagaaga

SEQ ID NO: 34503 - DNA, 601 bp, Human
ctacataatcaaaattttcaataagttaataattccttgaaatcacctgaagtaataccatttattttagatcttaatttactttaacgtgaatatatattcatgttactttagaagaaagtaaatttttctgagtgagctgattgtcacattgtcacatctataaactgggaattccccatggcaggattactctttgcaaaaaggaattccaagagcagcttgattaagaattcttgttgaaagccgggtgcagtggctcatgcctgtaatcccagcactttgggaggctgaggcaggyagatcacctaaggtcgggagttcgagaccagcctgaccaacatggagaaaccccatctctactgacaaaacaaaaaaattagccgggtgtggtggcgcatgcctgtaatcccagctactcgggaagctgaggcaggagagtcgcttgaactcaggaggcggaggttgtggtgagccaagatcacgccattgcactccagcctgttcaacaagagcgaaactccgtttcaaaaaaaaaaaatgtcgggcgcggtggcccacgcctgtaatcccagcactttgggaggccgaggcaggcaga

SEQ ID NO: 34504 - DNA, 601 bp, Human
tacataatcaaaattttcaataagttaataattccttgaaatcacctgaagtaataccatttattttagatcttaatttactttaacgtgaatatatattcatgttactttagaagaaagtaaatttttctgagtgagctgattgtcacattgtcacatctataaactgggaattccccatggcaggattactctttgcaaaaaggaattccaagagcagcttgattaagaattcttgttgaaagccgggtgcagtggctcatgcctgtaatcccagcactttgggaggctgaggcaggcrgatcacctaaggtcgggagttcgagaccagcctgaccaacatggagaaaccccatctctactgacaaaacaaaaaaattagccgggtgtggtggcgcatgcctgtaatcccagctactcgggaagctgaggcaggagagtcgcttgaactcaggaggcggaggttgtggtgagccaagatcacgccattgcactccagcctgttcaacaagagcgaaactccgtttcaaaaaaaaaaaatgtcgggcgcggtggcccacgcctgtaatcccagcactttgggaggccgaggcaggcagat

SEQ ID NO: 34505 - DNA, 601 bp, Human
aggcaggcagatcacctaaggtcgggagttcgagaccagcctgaccaacatggagaaaccccatctctactgacaaaacaaaaaaattagccgggtgtggtggcgcatgcctgtaatcccagctactcgggaagctgaggcaggagagtcgcttgaactcaggaggcggaggttgtggtgagccaagatcacgccattgcactccagcctgttcaacaagagcgaaactccgtttcaaaaaaaaaaaatgtcgggcgcggtggcccacgcctgtaatcccagcactttgggaggccgaggmaggcagatcacctgaggttgagagttcgagaccagcctgaccaacgtggagaagccccgtctctactaaaaatacaaaattagctgggtgtggtggtgcatgcctataatcctagctacttgggaggctgaggcaggagaatcgtttgtactcgggaggtggaggttgcagtgagccaagatcctgccattgcactccagcctgagcaacgagcaaaactccgtctcaaaaaaaaaaaaaaagaattcttgtttaaatttgtatttctcagaagagtgccactgagtttgggtttgggac

SEQ ID NO: 34506 - DNA, 601 bp, Human
agagtcgcttgaactcaggaggcggaggttgtggtgagccaagatcacgccattgcactccagcctgttcaacaagagcgaaactccgtttcaaaaaaaaaaaatgtcgggcgcggtggcccacgcctgtaatcccagcactttgggaggccgaggcaggcagatcacctgaggttgagagttcgagaccagcctgaccaacgtggagaagccccgtctctactaaaaatacaaaattagctgggtgtggtggtgcatgcctataatcctagctacttgggaggctgaggcaggagaatcrtttgtactcgggaggtggaggttgcagtgagccaagatcctgccattgcactccagcctgagcaacgagcaaaactccgtctcaaaaaaaaaaaaaaagaattcttgtttaaatttgtatttctcagaagagtgccactgagtttgggtttgggactaaattttccaggaaatatttttattaatgagtgattcttttcctcctctagtatgttattaatatatttttgagcacctttaatactaagtattgtgtcagtactaacaataatacaaaataatgtacatattgatgaagcat

SEQ ID NO: 34507 - DNA, 601 bp, Human
gaattcttgtttaaatttgtatttctcagaagagtgccactgagtttgggtttgggactaaattttccaggaaatatttttattaatgagtgattcttttcctcctctagtatgttattaatatatttttgagcacctttaatactaagtattgtgtcagtactaacaataatacaaaataatgtacatattgatgaagcatgcttgaaaaataattgagattttagcaccatgaaaacacccagaaaactgaaggtcttagttctagtaatagttgaaagttgctgtgtgctaacctatwcagaaccagcaataaattatgtgttgtaaacttctgtatccagcatcaaattataggtattataaataatagactggctgcacacaaagatgaaaatattcaattagaagctgcattacaaggaaatttaaatgttatcctgttcattaaacatctgaatgcattttttaaaagattaattttaccaggatctgtggtacataatagtaaagtagctctctaaatcaaaataggctatttggaaaagagatcagaaaatacctgaattaaatggtattcactttatgtattttcaaaatt

SEQ ID NO: 34508 - DNA, 601 bp, Human
tttcttgcgaactatattcttttctatttttcaggtacggattttcaaatatgcgctatatttcttcgctaattagtggtgttggtattttcatgatgggtgcaggactatcttggtaccatggagtcatgggattgcttcatcctcaaccaatagaatcccttctatgggtaatcctctttttttctcctcagttttgatgtcttatgacatagtgattgtgtacagtagaaggcctttgtcatattggtgttaaaggagaatgacatacaccttcttgactgtgtattgtagggttatrtatctatagtttaatttttagaatgtgactggacataacctctaaatccataagattcaatgatgttgaacaagatctctgtaggtaccaattatcaagccctgctccttggttaaaatcttgggcagttccactaatttctccagttactgttgaagaacaagaaaacctctgttcacttttggtcccaagaatagtctcatttcagtaattaaaatattcagacccatgtaatagtcataagttggaactatatttgaagttaaagcttctcttttcccgcatcctgggcttccttca

SEQ ID NO: 34509 - DNA, 601 bp, Human
tatttttcaggtacggattttcaaatatgcgctatatttcttcgctaattagtggtgttggtattttcatgatgggtgcaggactatcttggtaccatggagtcatgggattgcttcatcctcaaccaatagaatcccttctatgggtaatcctctttttttctcctcagttttgatgtcttatgacatagtgattgtgtacagtagaaggcctttgtcatattggtgttaaaggagaatgacatacaccttcttgactgtgtattgtagggttatgtatctatagtttaatttttagaaygtgactggacataacctctaaatccataagattcaatgatgttgaacaagatctctgtaggtaccaattatcaagccctgctccttggttaaaatcttgggcagttccactaatttctccagttactgttgaagaacaagaaaacctctgttcacttttggtcccaagaatagtctcatttcagtaattaaaatattcagacccatgtaatagtcataagttggaactatatttgaagttaaagcttctcttttcccgcatcctgggcttccttcaggtaggaagcctgcactgggggaa

SEQ ID NO: 34510 - DNA, 601 bp, Human
atggatgtatcactcaggtatgcatcagacagtttgctgtgatatccaatatcccgggggacacacatcaaggctactgaacaatcttagtagctcaacagctttcaccaaagaaatcttcatttttggcctcctcaatttcagctcttcttatgtggtctagaggatgtggagctagcatgtagtctagtgggtagaggccccaggtttgggctaccttctgtgcaaggcctgaatagatggtataacacctccttttggaatgtggggatacttgtacctattttcttctctattttgrgttgtagtcagaactagacagaatcaatctgtctacttttttaatatcctgttatatcatacaaatctacttaataacaagcacattaaactaggcttatttgttattctctagttttctatagttttgattgactagtttcttaccataatacatttcatataattaaaacaaacaaatgtgtttcctccattctgaaaagatttggccactttatgggtacttcattgttctagcgttcttctaatttgtatagtgtcactttataggggcaaagcactctctgtagttagagattag

SEQ ID NO: 34511 - DNA, 601 bp, Human
cacacatcaaggctactgaacaatcttagtagctcaacagctttcaccaaagaaatcttcatttttggcctcctcaatttcagctcttcttatgtggtctagaggatgtggagctagcatgtagtctagtgggtagaggccccaggtttgggctaccttctgtgcaaggcctgaatagatggtataacacctccttttggaatgtggggatacttgtacctattttcttctctattttgggttgtagtcagaactagacagaatcaatctgtctacttttttaatatcctgttatatcatrcaaatctacttaataacaagcacattaaactaggcttatttgttattctctagttttctatagttttgattgactagtttcttaccataatacatttcatataattaaaacaaacaaatgtgtttcctccattctgaaaagatttggccactttatgggtacttcattgttctagcgttcttctaatttgtatagtgtcactttataggggcaaagcactctctgtagttagagattaggtaattagttaaattttcagttgtgtataagttttaaaacttctaaaagctcttgtgtctt

SEQ ID NO: 34512 - DNA, 601 bp, Human
ggagtataaaaaacataattaaactgaacttttaaaattagagtttaataatattcaccagaagaatattatttactggctcttgtgagacaaatatttcaaagtttttgaaatacacagctatagcagtatgatgacagagaactgctaatatcagtataaaactgcctgattcactgctgtgctcatgtttacttctgaaacattgtaactttctatgtataatgttcccttcatctatttttaaaattaacattttttattgacagatcctaattgtatatgtttatggggcccctcrtctttgaaagtctatgaaatggttataacacaacctgcttcaaaagattgggaggctcagaaatgaatgtggttagtgtggtgctgccaaatagcagctcttcaataaactaaagctgttgttattagtaattatatttaattattatggtttagaactatggggttcattttattataatgattaattgataacaactaattaacatagaacttgtccttattgccaaccctagttttaaaatgttgtgcttatttgtttatcttttgagatgccatctttaaagtttggaggcatgaa

SEQ ID NO: 34513 - DNA, 601 bp, Human
gaaggctatttgtaaaggatttctgtaatgctgtaagtctttctagctgtgacttaaaaaattgtgcaatcactctgaactttttatttacctataaaagtgtggataatatttaccttggtaacctcttaggtttattaagaaaatatgagagttttaataaactctaaagttccaaataaatatacataggtcctcaaataacattgttttgttcaacttgattttgttataacattgttgcgaaaaatatcaattcctaactggagctaccatctctgtggagtttgctcattctccytttatctacataggttttctttgggcaccccaacttcctcccacatcacaatgccgtacatggtcagtgaattggggtgtctaaatagtcccaatctgagtgagtgtgggggtgtgtgtaagtgtgccctgccatgggatggcatcctggccaggtctggttccttcctgtgtcctgaactgctaggataggctcaagtagatgataatcagacaaatgcaggacaataactgatgtatgaaagcgctcagcaagcctacatatttgtggttgtttatttttgaattatgtggtgatagg

SEQ ID NO: 34514 - DNA, 601 bp, Human
ttttgggtcttagaagttgagtgatgtttttgtgaccagaaatatgccataggaacttaactcttttttttttttttttgagacagagttttgctcttgttgcccaggctggaatgcaatggtgccatgtcggctcactgcaacctccacctcccaggttcaagcaattctcctgcctcagcctcccgagtagctgggattacaggcatgcgccaccacgcccggctagttttgtattttcattagagacggggtttctccatattggtcaggctgatctcaaactcccgacctcgggggwgatcctcccaccttggcctcccaaagtgctgggattacaggcatgagccaccacgcccggccggaacttaactcttgtttgtatcagttagcttatggtaaaattggttttgttatatgttgttccctataaagtcgcagtttctaagaacctattgacaacatgaatgaggacttaaccgtatattgtggctcttgttcatttgtctttttccacacttaatgccaataataactactgttgccttcctatttctttaattctaagttgtttgtgtccttattttggtagctaattaaa

SEQ ID NO: 34515 - DNA, 601 bp, Human
agatcctcccaccttggcctcccaaagtgctgggattacaggcatgagccaccacgcccggccggaacttaactcttgtttgtatcagttagcttatggtaaaattggttttgttatatgttgttccctataaagtcgcagtttctaagaacctattgacaacatgaatgaggacttaaccgtatattgtggctcttgttcatttgtctttttccacacttaatgccaataataactactgttgccttcctatttctttaattctaagttgtttgtgtccttattttggtagctaattaaagtgttttgagggccaataaaatacaagtaaatgaaaagacaattctattttatttttattttcgaaaacaaccatttagcatgaaaagactcaatttatgaagttggaattctcttggaaaggaacttcttccatacttctctatttgtccttacatatttaaaataattttaggtgacgagcttccacagttctgcagtgtttcttcaaatagtctgaaatatgaatacttctttctcattctgagtgtgcattttaataccaaactagcattctctgatgtttattgtgatccaaaat

SEQ ID NO: 34516 - DNA, 601 bp, Human
tttaggtgacgagcttccacagttctgcagtgtttcttcaaatagtctgaaatatgaatacttctttctcattctgagtgtgcattttaataccaaactagcattctctgatgtttattgtgatccaaaatatttgtaaaaatgttgattgtttttctggttgaccatatagttttagactgtttttgaacataaattactagcaaaattttaggcttaagaaaagtgtgacttgatgcagatgtcaactttgaataatttattttcttttacataataatagaaaccaatcaaatcaaayttacaaaaatatgtaatgtgttttacatgaattaaatttttcttaattagctaatttattcaaattaaattaaataacatgccaagaaataaaagttttcttaaaaaaggtattttctttcagctaatattcctgtgatttctttaagagtacatgaatgtatatatttaaataaaaataactcctcacatttggatttctaaagagcagtatttgattttgagctctataattacaaaacttctaatggataatgttttacaagcggatcatttttaacacttagtatagattaacaag

SEQ ID NO: 34517 - DNA, 601 bp, Human
cccacatccagaattttttattcaggggcctgaaatgaggtctgagaatttgcttttctaccaagttttcaagtgatggctgctggtccaggaaccacactttgagaagcaccaccttgaggcacctatggcatgtaatgaattaagttctctcctttttatctagaatgatactagctatatatcatccttggttggatgagaagagagtcacccatattattttctgtagggcttaattctcttacagaacattagtaggaagaagatacggaaaaaggtttctttcagcttttgattycactgttattttgtctatctggtgtaggaaaagtgctatggatatagctaaaagaaatggactcttcattatgtcatttttttgtattggtgtctctaatctaaatgtgctcagaaacttcacatatgtaatgacaggtacaagtaagagatcttaattatgtcacatagtactcttatgaaagcaagttgtagcatcctcattttgtggtatattaaaactattaggagttgttaaaggaagtaattaaagaaattaggaataaatttcaagtgccttgatttactcgttctggttctt

SEQ ID NO: 34518 - DNA, 601 bp, Human
atttgcttttctaccaagttttcaagtgatggctgctggtccaggaaccacactttgagaagcaccaccttgaggcacctatggcatgtaatgaattaagttctctcctttttatctagaatgatactagctatatatcatccttggttggatgagaagagagtcacccatattattttctgtagggcttaattctcttacagaacattagtaggaagaagatacggaaaaaggtttctttcagcttttgatttcactgttattttgtctatctggtgtaggaaaagtgctatggatatakctaaaagaaatggactcttcattatgtcatttttttgtattggtgtctctaatctaaatgtgctcagaaacttcacatatgtaatgacaggtacaagtaagagatcttaattatgtcacatagtactcttatgaaagcaagttgtagcatcctcattttgtggtatattaaaactattaggagttgttaaaggaagtaattaaagaaattaggaataaatttcaagtgccttgatttactcgttctggttctttgctctctataaagttcactgaaataatataaactgttaatttactg

SEQ ID NO: 34519 - DNA, 601 bp, Human
ctttatcttttaaattatgtaaaactaaagaactggagacttaggagataatcagcagaagagatacagaattctaatagtgcttttcagtgaaattctagcagcattgtggttttataatgaaataaaagaacaaacctttaaaaacccagttttctactaactcgctctatattttttcaaactttaaaataagatttttttgtgtattgtacttgaaatctttaagttaaatctttttaaaatgacccgtatatctgaattagtaaaatatattaatgattactagatttatattctrtgccctatatgtttaatcttgaaaagtaactatcttattggaacaagattagaaaatgagagacgggcacagtggcacatgcctatagttccagctacttgggaagctgaggcaggaggatcacttgaggccacgagtttgaggctagtgtgcaatgatcatgtctgtgaatagccactcactgtactatattctgggcagcatagcaaaaccctgtctcaaaaaaaaaaaaaaagattagaagttgagcattatgaaagtcagtattagagttattaacataatgtgagataatccaaa

SEQ ID NO: 34520 - DNA, 601 bp, Human
taatcttgaaaagtaactatcttattggaacaagattagaaaatgagagacgggcacagtggcacatgcctatagttccagctacttgggaagctgaggcaggaggatcacttgaggccacgagtttgaggctagtgtgcaatgatcatgtctgtgaatagccactcactgtactatattctgggcagcatagcaaaaccctgtctcaaaaaaaaaaaaaaagattagaagttgagcattatgaaagtcagtattagagttattaacataatgtgagataatccaaattaatatcctttcyttgtgatgtttttgtctggttttggtattaagataatactggcttcagagaatgagttgggaaatgttctctcctatttttttggaagagtttgtgaataattggtgttagcttctttaaatggtagaattcaagtatctggatatgagctttgctgtgtgggtagttttttgattagtaattatatctcttgttatggatctgttcagattgtttcttcttgacttagtttaagtagcttgtattctaggaatttgtcttttacttctaatttacctaatttgttggtatacagctatt

SEQ ID NO: 34521 - DNA, 601 bp, Human
tagttacctactgctgtgtgacaaattggcccaaaacttagtggtttaaacaacatattaccatcttacagtttctgtgagtcaggaatcagggcacagcttatctgggtcttcgacttcagggtttctcatagactgtaatcaaggtgttgactgggattatagtcatctcctggggaaggggctgcttctaaccttactcacatgattgttcgcaagatttagctccttgccaaatgggcctcttcaacatggcagcttgcttaatcaaagcgtgcaaattgataaggcaatagagagygagtgtgaacaagacaaaagtcacaggttagtcacctggtcttggaaatgacatctcatcactttgccatatttggtagttatagcccacattcagtgagaggagatcacacaagggcttgcgtataggtggcagggattgatcatatgggagccctccaaacagttttctgtctgtagttagttatatgtaagaacataaggaaaaagtatatctaaatatatttattagttgctactcacataccagccaaataatgaaatgtgttaatactctgtgaagactaaagtagaaatgatt

SEQ ID NO: 34522 - DNA, 601 bp, Human
aaagcgtgcaaattgataaggcaatagagagtgagtgtgaacaagacaaaagtcacaggttagtcacctggtcttggaaatgacatctcatcactttgccatatttggtagttatagcccacattcagtgagaggagatcacacaagggcttgcgtataggtggcagggattgatcatatgggagccctccaaacagttttctgtctgtagttagttatatgtaagaacataaggaaaaagtatatctaaatatatttattagttgctactcacataccagccaaataatgaaatgtgttwatactctgtgaagactaaagtagaaatgatttttgaaaatgaataaatatgttctgtgagttaccaggagagaaaaaaaaaagaataaatgatatagccttttgccaatctgaaaaagttttgttttaacttgagcacatgtaactataaatattaaaacattaattcttatttcatccttgatggttgattaaaatatagcttccttatatggataaaaaattttggactcagtgtttagtaacctgctcaggatccctcagaaattagggtctaatgttgtaagaatacttggagtct

SEQ ID NO: 34523 - DNA, 601 bp, Human
gctcaggatccctcagaaattagggtctaatgttgtaagaatacttggagtcttacgtaggcttgtttttctagtaaatctccatgtcctcagaattcagagtgttttgttatttcttatatgtgctgtacagaaaagatcttacagtgatcactgtagaaagaagagaatttctcagcagtttctagggaagattgtttactgagggttagagcaggaggggtgaaaagtagttatgcttgagtatctgctttcctgtctgggaggcaaaagggtatgatgcaaataccactgggcttgsatttctgaagagctgggctggggagtcctaatctgctgtttactagctaaattaccttgagcaagtcacttatgccactctaggatggttttatcatgtataaaataaagatgtcaccctatccacttatgaaagccatccattaaatgcctgccttatagttcttactgtattaaacattttatatatgtattagctcattattcctcacatcaagtcccatgtggcagttattattaacctcattctaatagagaacttcacagcattgtatgaagacttttaaagaagctagtgaac

SEQ ID NO: 34524 - DNA, 601 bp, Human
tagaaaccaaatcaatgaatgaacttctcatatgctacttgtgaaggtagggggcacagtctacaagactgtccttccttctaataccaactgtgagttcaggaggttccctagagcaccttcagatttaataactcactaggactcttagaactcaccgaatcatgttatacccatcatggtttggtttattacagggaaaggatactgcttgaaatcagccaagggcagaagaagtgcatagggcagggtccaggaaagttccaaacatgaagtttcagttgtcttttctctgtaatgyatagtattactctcctggcaatgaagtgtgacagtagcatgacgtgttgccaaccgggaagctcatctgagacttgatgaccagagattttattgaggctccatagttgactgcataagtagctgaccttttgtctctagcccttctagaggtagagcagatactgtgtggccaaaggcccccatcatatatcacattctaaagttaatgcccccagataaacaaagacactcttaggcaggacatgtcaagggcctagaaattccctcccggttatggagaacaaaagccaaacctccc

SEQ ID NO: 34525 - DNA, 601 bp, Human
ttaatgaatctgcagcattgtaaaataaattatgtaatttgggctttaactctctgcaagtattggaataaaatcctcatggtgtgtaaaatagcctaatcggtattgagcaatgcaaggaatatagattttaaagtatttgttgaataagtgggtgaaaattttaaattggataccaattattgattttcagttctgttcaataaatattagtttctactatacacatgatatcttgttaagcagtaaacattgaattttaaggatattaatcatatttattcattcagcatatattgtrtgctttgtattgtgcacatatacttttacaaatttgattagtttactctgaaaacttgattttaaaaagcagagcaaatttttaggctttttttttagataaagcttttattagtacacatatatttatatcatgctttttagacagaataatgtcaaacttttaatgaacaggtaaatttttcaagtcatattaggataggtaagggttgattggagtaggaagatacaatttagtttcatttctgtttggagaatttttttttaattctatattgagtttaaggagttctagagacag

SEQ ID NO: 34526 - DNA, 601 bp, Human
taatcggtattgagcaatgcaaggaatatagattttaaagtatttgttgaataagtgggtgaaaattttaaattggataccaattattgattttcagttctgttcaataaatattagtttctactatacacatgatatcttgttaagcagtaaacattgaattttaaggatattaatcatatttattcattcagcatatattgtatgctttgtattgtgcacatatacttttacaaatttgattagtttactctgaaaacttgattttaaaaagcagagcaaatttttaggcttttttttwagataaagcttttattagtacacatatatttatatcatgctttttagacagaataatgtcaaacttttaatgaacaggtaaatttttcaagtcatattaggataggtaagggttgattggagtaggaagatacaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaag

SEQ ID NO: 34527 - DNA, 601 bp, Human
tatagattttaaagtatttgttgaataagtgggtgaaaattttaaattggataccaattattgattttcagttctgttcaataaatattagtttctactatacacatgatatcttgttaagcagtaaacattgaattttaaggatattaatcatatttattcattcagcatatattgtatgctttgtattgtgcacatatacttttacaaatttgattagtttactctgaaaacttgattttaaaaagcagagcaaatttttaggctttttttttagataaagcttttattagtacacatwtatttatatcatgctttttagacagaataatgtcaaacttttaatgaacaggtaaatttttcaagtcatattaggataggtaagggttgattggagtaggaagatacaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgatcgacac

SEQ ID NO: 34528 - DNA, 601 bp, Human
acacatatatttatatcatgctttttagacagaataatgtcaaacttttaatgaacaggtaaatttttcaagtcatattaggataggtaagggttgattggagtaggaagatacaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgakcgacactagttataagaaaaatccctgtgtgcactcagtagagtgttcttgctggagcaaaactccaatattctgcgagattttgtttttataactggatgcctttaatacgagtaatatgcacatggtcctaggttatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttata

SEQ ID NO: 34529 - DNA, 601 bp, Human
ttaggataggtaagggttgattggagtaggaagatacaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgatcgacactagttataagaaaaatccctgtgtgcactcagtagagtgttcttgctggagcaaaactccaatattctgcsagattttgtttttataactggatgcctttaatacgagtaatatgcacatggtcctaggttatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttatattttaagagataaccatttttaatacttttcagtgtgtctttatttattgccatatttctgcataaaagtcttatac

SEQ ID NO: 34530 - DNA, 601 bp, Human
acaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgatcgacactagttataagaaaaatccctgtgtgcactcagtagagtgttcttgctggagcaaaactccaatattctgcgagattttgtttttataactggatgcctttaatacragtaatatgcacatggtcctaggttatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttatattttaagagataaccatttttaatacttttcagtgtgtctttatttattgccatatttctgcataaaagtcttatactacttctcttgatttaacagtatttcctctacgat

SEQ ID NO: 34531 - DNA, 601 bp, Human
gagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgatcgacactagttataagaaaaatccctgtgtgcactcagtagagtgttcttgctggagcaaaactccaatattctgcgagattttgtttttataactggatgcctttaatacgagtaatatgcacatggtcctaggwtatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttatattttaagagataaccatttttaatacttttcagtgtgtctttatttattgccatatttctgcataaaagtcttatactacttctcttgatttaacagtatttcctctacgataggtgtagatttagttcttttata

SEQ ID NO: 34532 - DNA, 601 bp, Human
tcagtagagtgttcttgctggagcaaaactccaatattctgcgagattttgtttttataactggatgcctttaatacgagtaatatgcacatggtcctaggttatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttatattttaagagataaccatttttaatacttttcagtrtgtctttatttattgccatatttctgcataaaagtcttatactacttctcttgatttaacagtatttcctctacgataggtgtagatttagttcttttatacactactttctgtcctcccttctcacagtattaatatgttacattttattatatttgtaattccccttaagttgatttaggtgcccttcctttattttattttattttttatttttttatttttttgagatggagtcccgctctgtcgccaggctggagtgcagtggcacaatcccggctcactgcaacctctgcctcc

SEQ ID NO: 34533 - DNA, 601 bp, Human
tttgtaattccccttaagttgatttaggtgcccttcctttattttattttattttttatttttttatttttttgagatggagtcccgctctgtcgccaggctggagtgcagtggcacaatcccggctcactgcaacctctgcctcccgggttcaagcgattctcctgcctcagcctcccgagtagctaggattacaggcatgcgccactatgcccagctaatttttgtactttttaatagagacggggtttcatcatgttggccaggatggtcttgatctcttgaccttgtgatccgcccrcctcggcctcccagagtgctgggattacaggcgtgagccaccgcgcccggccaggtgcccttcctttgtgcactcacaggaaaaagaaacccaaaatctttactttgctctgtggtagccgagtgttgtaattgcctacttaatttacctatatcacctcactaccaaacgtaagtccactgaaggcaaatactgtttgttcccagctcattgtcatatacacttcaatgcctggcacagagtaggcatgtaatagtagacagtattggttgttattgaattgaagttccttaagctagc

SEQ ID NO: 34534 - DNA, 601 bp, Human
tatcacctcactaccaaacgtaagtccactgaaggcaaatactgtttgttcccagctcattgtcatatacacttcaatgcctggcacagagtaggcatgtaatagtagacagtattggttgttattgaattgaagttccttaagctagcatataagatttttaacaacctgatttctgcctgtctttccagcctcattaccaaccctaccctttttgcagcttctgtgctagctataccatagtgccagtgcacactttgcaggctgtctgactttgctgatgttgtgttttctgtctagrcactcttcattatctacctggaaggctcatcatatgcagacctagcttagatattatatcctcagtgaaattttctagatctcatgagcaaaatggctgtctcatttttgctcccagtgttattatttagtacagtgtaataggagcttgggatctggaatcaggcctggagtcaggcctggaatcaatcctggctccatcacttactagcagtgtgacttcagacaggttagttaatttcttcatacttcagttttccctgatgtatgtataagatggaaatagtaattaggttatgag

SEQ ID NO: 34535 - DNA, 601 bp, Human
ctcatcatatgcagacctagcttagatattatatcctcagtgaaattttctagatctcatgagcaaaatggctgtctcatttttgctcccagtgttattatttagtacagtgtaataggagcttgggatctggaatcaggcctggagtcaggcctggaatcaatcctggctccatcacttactagcagtgtgacttcagacaggttagttaatttcttcatacttcagttttccctgatgtatgtataagatggaaatagtaattaggttatgaggcttttaaaacacacatacatgtgcwtatgtaacacagtacttgatacatgagtgagtgagcaataaatgttaactttttattattagctctaatactttaacttgtagatgattactgctatgctggtctccctagctaaactgagtcactcagggtcaggaacagagtcttatttaataatcatagctctgttttctagcacagggcccggcccaagaatatatggattgttgctaaagtatataaaatgagtggttgtcaatttactctttttgattattattgttttgcagtgattttcttttcaccacacaaaaatgtgta

SEQ ID NO: 34536 - DNA, 601 bp, Human
tcatcatatgcagacctagcttagatattatatcctcagtgaaattttctagatctcatgagcaaaatggctgtctcatttttgctcccagtgttattatttagtacagtgtaataggagcttgggatctggaatcaggcctggagtcaggcctggaatcaatcctggctccatcacttactagcagtgtgacttcagacaggttagttaatttcttcatacttcagttttccctgatgtatgtataagatggaaatagtaattaggttatgaggcttttaaaacacacatacatgtgcayatgtaacacagtacttgatacatgagtgagtgagcaataaatgttaactttttattattagctctaatactttaacttgtagatgattactgctatgctggtctccctagctaaactgagtcactcagggtcaggaacagagtcttatttaataatcatagctctgttttctagcacagggcccggcccaagaatatatggattgttgctaaagtatataaaatgagtggttgtcaatttactctttttgattattattgttttgcagtgattttcttttcaccacacaaaaatgtgtat

SEQ ID NO: 34537 - DNA, 601 bp, Human
tcctcagtgaaattttctagatctcatgagcaaaatggctgtctcatttttgctcccagtgttattatttagtacagtgtaataggagcttgggatctggaatcaggcctggagtcaggcctggaatcaatcctggctccatcacttactagcagtgtgacttcagacaggttagttaatttcttcatacttcagttttccctgatgtatgtataagatggaaatagtaattaggttatgaggcttttaaaacacacatacatgtgcatatgtaacacagtacttgatacatgagtgagtragcaataaatgttaactttttattattagctctaatactttaacttgtagatgattactgctatgctggtctccctagctaaactgagtcactcagggtcaggaacagagtcttatttaataatcatagctctgttttctagcacagggcccggcccaagaatatatggattgttgctaaagtatataaaatgagtggttgtcaatttactctttttgattattattgttttgcagtgattttcttttcaccacacaaaaatgtgtatttccagtgcttcgcaatgcttggcatgtacta

SEQ ID NO: 34538 - DNA, 601 bp, Human
cctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcarttacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatgga

SEQ ID NO: 34539 - DNA, 601 bp, Human
ttttctagtcctatttattgtctgttatttttcttatagctctcacaacatcatagctatcttattattattaatatattattttaaaacctttatttttcagcatgactctggggtcaaaatgggatgcctagacctctaagattcagcccactggtgatcttattcctgtgatattgggttagctacgtaaatcctggaaaatgctattaaaaataagcttttcctttatctgagaagcaggagtaaaaacagtttaaattgccaaagtggtcagtttctagattgtaatatagatcarttgctccagttacaaacacacaattgcaaagtacccacatgttttgctccttgggttagctttcttaagaagcttaaaagtgagtcactgttagtaaaagttgtcgaggtagttaaattaagtctgaaaagtgatcacgcactacactgtgcttacagatggtataaaaagcaaaatatggcagaaatatttgtattgccttaagcttaaggcatctggagtccgaggtttaaccaatgtgattcatcaataaatattgattagatgtctatgatgtatgggatatgatgagaaatacat

SEQ ID NO: 34540 - DNA, 601 bp, Human
ttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgmaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtg

SEQ ID NO: 34541 - DNA, 601 bp, Human
gtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcrtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtgaatacac

SEQ ID NO: 34542 - DNA, 601 bp, Human
tttctttgattcacaatctgacacaacttcaggggccctaagtgtgagtctgagttattgtaccatattgtgcataaagctttatgttagagtttgagttgcaattgtactggctcccagaaatccctggagctgctttctcctgtctccctcataggtttatcatgacgtttctcatgataaacggctcaatgccactttgctcatgtctctttgttttctcctacctttgctgtttgccttcacttctgtctgctacattggcaggacttgactttttttttttttttttttttttttkgacacagggttttactctgtcacccaggctggagtgtagtggcacgatctcagctctctgcaacccccgcctcccaggctcaggtgactctccaacctcagcctccttagtagctcagactacaggcacgtgccaccatacccggctaatttttgtatttttagtagagttggggtttcaccatgttgtctaggcttgtctcaaactcctggactcaggcgaaccacccacctcagcctcccagagtgctaggagtacaggcaggacttgatttttatagctacttggttgtgtttctga

SEQ ID NO: 34543 - DNA, 601 bp, Human
aaaaaaaaaaaaaaaaaaaccaaaaggctcacctctcgttatattaatttttcatgtccgcttgggtttctttagtaactgagctatgtgacttagtaattaaagttataatataacttcaatttcatctgattttctaagatttctcatataattgctttcctaaaaggaggatttattgtttttcttcttaagctggaatattctcatagttggctccttattaagacaaatccagcagctgtaattctggtcataaattttaccccaaccaaaaactaaacctatgttttcatttccyactgtctttgctaaacctttgtgcttgcaatttgtaagtcaagtacaaatgagttgtaaggcccaaagaaacaaagtttgcaacattagattcttttcataatattcttcttcattaaagattaatgactacatggtctataagaaattctgaatatattctttgtgggaaagaaatgtacaagacacgattattaacatctgcgtgaagaatgtaggccaactcagttcttcagggttactttcagccatttttaagagagagaggagaagtttgtgcaggtacacaattagaaaagaa

SEQ ID NO: 34544 - DNA, 601 bp, Human
gatttaggttgttgctttagaacataaaaaaaaattttcagtggaagtggttcctcttaacaaagtaagtcacaaatgagaatttccagacaaagcctataatctactgtgaagaaagaacctcagtataaaaggtgggaaccatccttttatgtgaacttggaatttgttgtctttataggtgtagttgcagtattgttttgtggcatcacacaagcacattatacgtataataatttgtccacggagtctcagcatagaactaaacaggtaagaggaactttatagtttgtgaataggmttttccttctttcagcaaaatagaagtcttttttactaaaaaaaaaaaatagtctttgatctgttcaagatgctatctactcattttggctcctcttcctttgactctaaaagtaggtgggattggcaaaatgaagaatgacagcatttagggtggaaatagatcagcagaatagccagagactgttactattgtggcttcaataaccagtgaagtagcttccctttttctcagtgttttcccaatttaatggcttttaaggggaatgttttggaagctcactctggttttacttgaact

SEQ ID NO: 34545 - DNA, 601 bp, Human
cagatttatccattataaagttacacattccccccccttcccccgccatgttgtactgcgtggaaggaagttgctatgagcaaggattgaggaatggggagttaggttccacctccttgaggacagagtatcagcaaaattatttggaatttttcacacaggagatttatctattcttcctcatttattgttttattcagtcattttttaattattattacttttttttttgagacagaatttcactcttgttgcccagactggagtgcaatggcatgatctcagcctactgcaacctccrcctcccgggtccaggcgattttcctgtctcatcctcctgagtagctgagattacaggcatgatctgagattacaggcatgcgccaccacgcccggctaatttttatattttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaactt

SEQ ID NO: 34546 - DNA, 601 bp, Human
attttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaacttttttattttcttgctgaaactgttccagcttggccattgagagctcttttggcaggctctcctgtgtgcctttgatatatcctcatcattgtttttaatttttatcytcatcattgtttttaattttttttttttgagtacttccttactccctggaactataagatgcttcaggctcatcttgtatctgttctggctcagcccaagaattggccatttctccaagaagtcctggttccttttattggagaatagtattagaaaccaaaatctgagcactaggtgtgctcagtgttacttggtgtctttgcttctaggccgtctcagctgacagattgcttctaggctctctcagctgacagagcaaggagttagatatgtatatatctatatatccatatatgtag

SEQ ID NO: 34547 - DNA, 601 bp, Human
ttcaatttttaatctttggagaatctgtaatgttttattttttccttttaaaaagtatgtaatatatagtacagaaaaaggaaaatatatatgcaaaagaaaaattcattgttaagactttgagggatatctttccagatcttttgctatacatgatatatatttttgacaaaaaggggcaacactgaaggtactcttgtagcctgatttttaaatgtaatatagcatggacatttacattgtaaatatatttacatcattgctttaatggctgcatatgtcctgatttacttaatcaaawccctgttgttggacttttgtattgtttctaggattttgctattaccattaccatttgaggattttgctgttactattaccgttaacgatgtgaacattcttaaatgtatacaccactgtgtacttgtttgattattttttagaatgcatgtctagaaatgaaattgcttgctcaaaaggatatgtatatatttaaggcttttgatcaatatcaccaggtcagataaaaaatttgccttccacctgcaatgtatgagacaatgcggtttactccaaccctaatcactactagatattatca

SEQ ID NO: 34548 - DNA, 601 bp, Human
gtacctacctccttgggttgttgtaaggattcagtgagctaatatctgtaaagttcttagcacagcatttcaaattaccttttattcattcattcaataaacatttactgaacaccagccatgtgccgggcactgtaggttacaactcagtggttctttttttttttttgagacagagtcttgctctgtcgcttaggctggagtgcagtggtgcaatctcagctcgttgcaacctccgcctcccaggttcaagcaattctcctgcctcagcctcccaagtagctgggattacaggcatgcrccaccacacctggctaatttttgtatttttagtagatatggggtttcaccatgttggccaggctggtctcaaactcctggcctcaagtgattcgcccgcctcagcctcccaaagtattgggattacaggcatgagccatctcacccagcctcagtgcttcttaactggggagaattttgccccccgcccaagggacatttggcactttctggagacatttttggttgtcacaactggaagagggggcctctgctggcatctagtgagtagaggccaaggatgctgctaaacatgctacaa

SEQ ID NO: 34549 - DNA, 601 bp, Human
tgcatgaatatatatcttttggtggacatagcactcatttctcttgggtatataccaaggagtgcaaagagtggaatttaggacaagtatatgtttaacgtgttttttgtttgtttgtttgtttgtttgtttgtttgcagtagtgtctggctctgtcacccaggctggaatgcagtggcacaatcttggctcactgcaacctctgcctcccaggctcaagtgatcctctaaacacagcctcctgggtagctgggactcctggtgcatgtcatcacacccagctattttttttttttttttyctcaatgtagagacatggtttcaccatgtttcccaggctggccttgaactctgggactcaagtgatccacccacctcagcctcccaaagtgctggaattataggagtgagccacttgcccagcctgtttagctttaaaacagacattgccaaccaaccagttttccagagtgattgcaaccagtttaattggttttaaccaacttggtgaatttatgattatttccatcagcaaattaagggagttctatttttcagtcttttaaattttagccattttgatgggtgtgtagtgatatct

SEQ ID NO: 34550 - DNA, 601 bp, Human
atttcttttttgtgtctttttacatcagcttttttaggggacttcttcagtgcaatggtgaatataagtgatgatacaggacattcttaccttattcctgacctcagagggaaatttttcaatatttcaccattaagtacgatgttagctatacgtttttggatatatcctttagcaggttaagagcattctcttttatttctagtctgctgagagtttttatcatgagtttttgtctgctgagaatttttagtatcagatgctttttctgcatcgagatgatcatgtgtttatatttttcttctttaatctgttattttgattttcattgattgattgtttgaatgttaaactagtcttgcattgctggaacaaattccacttggtcatgatgtgttatcctttgtgtatatctctggatttaatttgctaatattttgcatctgatttttgtgtctatttttatgaacaatattggcttgtgattttttcttatagtgtccttgtcaggtttctataacaagattaagctggcctcataaaatgaatcaggaagtattccctcattttctgttctctgaaggagtgataagattagtgt

SEQ ID NO: 34551 - DNA, 601 bp, Human
gctagcagattggtccccatttacctcattgtgtagctttaagcaggtcattgacctctctgagcctcagtttccatatctgtgaagtggagatgataaaatacccctttgctgtttcactgccatcatgtgaggaggaaatgagaccatagatgtgaaagccctttgctgtcctccgaagtggttactatactatgatggtgattattatcaaacgagttgctcttttaaatttgtaaagaaaggaccacagctcttccttaaccaccgcagctatctgaagcctctgctgacccacagygggcctccgctgacaacaacactccctgcctgctgtggacccatcgccaggtgcctcaccagcccccaggcttacgaagtaagttggttttatccaaaactaaattcttcagtaagttaaatttatctgctctgtggatgagtcactggttttattttattttggtttgtttttttgcctttgaggtataaattccatgaaagggaatttaagcatattttgctcaaccagaaaatacactgaaacctataaatataattcacagcctttgaaacagcatttgaaaacagatatagaatc

SEQ ID NO: 34552 - DNA, 601 bp, Human
atgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcrtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcag

SEQ ID NO: 34553 - DNA, 601 bp, Human
cctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctcygggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcc

SEQ ID NO: 34554 - DNA, 601 bp, Human
atggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagratcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccct

SEQ ID NO: 34555 - DNA, 601 bp, Human
ggagtcagtgacaatggccactatgccagcccttggtgaaaagtatagaggtgaagaggacccagcactttgtaaaatgcccaaccgtaaagggcttttgtgcacctcccctgctgtttagctcctccgcctttgtccactgttacagcatgaagcaagaaggcctcctaggtctgcagagcccagagcccatagggcctcctggggccataagctgaccagagccagctctgatgaggagtgaatggctgaaactcaggcctgcaaacagccaggcttgccctgaatgagacctgaagcygctggacatcagggcaattggattgcgtgttaagaggcccaaagagaggacgcctgcaggatgcacacaacatctggggtttccactgggtgccttcgggagagctgaaaaggggagagctggtgggaatttccaggccccatttggcccaacaagtctgtccttctaagctgctgctccctgggagttagactaaggatccatgctggcttcttggaaacacgaggggttctcctgggggtctcagctttgcttttgacagtggttcctctgtaggagcccagaaaggctcaggctggg

SEQ ID NO: 34556 - DNA, 601 bp, Human
tctcacctgggagcttgctcgaaaagcagaatcctgactctactccacatgtactgagcctgaattggcatttggacaagatccctggggagtttaaaattaaattttaacaggtacgttaaagtctgagaaatgatgctatggatgaccaccatgctgacctcagtgagaagccacagccagacaagggggagacagaaaagttatctaacaaagcagacacaggtctgccaactacagcaggcttggggccacttaacaaagggacaagcaaatgagcacaagcccatggcctgcagtygggtggccactgatgtacagcacccttacagagcccacatagcttatttattcagagtacagatgaggaaactgaggcacagagaggttctgtgatctgctcagagccacgcagacacaaagggtggagctgggttcagcctagacctgggggcctctgctgctggtccagaggcacagatcccctgctcgccagcaagaggtcctgcacatacccggagctctggcatctggatgatgaggctcatgggcacgtggacgatggggctcttcctgtagtccattgggacgaggttggggg

SEQ ID NO: 34557 - DNA, 601 bp, Human
gcaggagggccccggagccagactgtggacagcctgtgtgaccctggaggagtgaccaaatccctctgagcctcggtttccccatctgtaaaaagggaataataataacaccttcttaattgggttgtgatgggattaaatgagctaaagtatgtaaggtgttggtaccaggcccggcacatgtaagagctcaggaagcattctactgggtcatgtcacatcattaagatgggcacagccagggacagtggtgcacgcctgtagtcccgctatttgggagactgaggtggaggaatcactygagcccaggagtttgaggcttcagtgagccatgatcgtcccactgcactccagcctgggcgacagagcaagaccatgtctccaaaaaaaaaaaaaaaaaaaaatgctgagcacagccagtgtgttatcactggaggcactgcctcatctgaagcagaagcagaagcacagattcgtcctgttacccagaaaagcacacagaggctctgcctggatgtgtagggctctgtccccagcagaagaagatgacagcccagggcactggtggccctcagctcaggccgtgtcaggccaggatcgt

SEQ ID NO: 34558 - DNA, 601 bp, Human
gatcctttctttgaagggattctcctgaagaaaacacacacagcaatcactgtgggtgcaggataagcaggagggccccggagccagactgtggacagcctgtgtgaccctggaggagtgaccaaatccctctgagcctcggtttccccatctgtaaaaagggaataataataacaccttcttaattgggttgtgatgggattaaatgagctaaagtatgtaaggtgttggtaccaggcccggcacatgtaagagctcaggaagcattctactgggtcatgtcacatcattaagatgggcmcagccagggacagtggtgcacgcctgtagtcccgctatttgggagactgaggtggaggaatcacttgagcccaggagtttgaggcttcagtgagccatgatcgtcccactgcactccagcctgggcgacagagcaagaccatgtctccaaaaaaaaaaaaaaaaaaaaatgctgagcacagccagtgtgttatcactggaggcactgcctcatctgaagcagaagcagaagcacagattcgtcctgttacccagaaaagcacacagaggctctgcctggatgtgtagggctctgtcccca

SEQ ID NO: 34559 - DNA, 601 bp, Human
ggtgtagtggcgggcacctgtaatctcagctactcaggaggctgaggcaggagaatcgtttgaacttgggaggctgaggcaagagaatcgcttgaacccgggaggcagaggttgcagtgagccgagatcacacgattgcactccagcctgggcgacagtgggactctgtctcaaaaaaaaaaaaaaaaagaaaagaaaagaaaaaagaaagcaaaatgtcagcccctgataggccctgctgcctttgggatccagtgtctgatcaaacgtgctgaggacaggagctttgaccttgactctwcaggtccaagttgggtcccagccccttcctaggccttaggcatctcaactgaggtctatctgaggatttgacaccagtccccatgggtctgtcaggccagcagagggggtgagctcgtgggtatgaagttttctccctgtggctgtgggagaagcatgagtccttggctcatgagtgcccgccgccctctggtggctggtgagacagccagcctgagggcagagctgggcggggtgaatccaggtggccctacctcaggcagtattcgggggggctccagaggcccccctgcaggcctgg

SEQ ID NO: 34560 - DNA, 601 bp, Human
aaacgtcagtctgggcgtggtggctcacacctgtaatcacagcactttgggaggccaaggcaggcagatcacctgaggtcgggagttcgagaccagcctgaccaacatggtgaaaccccatctctactaaaattacaaaaattagccaggtgtagtggcgggcacctgtaatctcagctactcaggaggctgaggcaggagaatcgtttgaacttgggaggctgaggcaagagaatcgcttgaacccgggaggcagaggttgcagtgagccgagatcacacgattgcactccagcctgggygacagtgggactctgtctcaaaaaaaaaaaaaaaaagaaaagaaaagaaaaaagaaagcaaaatgtcagcccctgataggccctgctgcctttgggatccagtgtctgatcaaacgtgctgaggacaggagctttgaccttgactcttcaggtccaagttgggtcccagccccttcctaggccttaggcatctcaactgaggtctatctgaggatttgacaccagtccccatgggtctgtcaggccagcagagggggtgagctcgtgggtatgaagttttctccctgtggctgtgggaga

SEQ ID NO: 34561 - DNA, 601 bp, Human
ttgggcagacagcagcccgtcccaggagcaatgctatggggtccaagaccgggcggatgttgggtggaatctgagaagctttttacatgagccatgtgggcatagtttgtggagggcagactggcaggtattttctttctaatatgcaagcaaaacgtgggtgcacagacagaaaccaaagtcctctgaaataaacatgataactagaaagtgaaacgtcagtctgggcgtggtggctcacacctgtaatcacagcactttgggaggccaaggcaggcagatcacctgaggtcgggagttygagaccagcctgaccaacatggtgaaaccccatctctactaaaattacaaaaattagccaggtgtagtggcgggcacctgtaatctcagctactcaggaggctgaggcaggagaatcgtttgaacttgggaggctgaggcaagagaatcgcttgaacccgggaggcagaggttgcagtgagccgagatcacacgattgcactccagcctgggcgacagtgggactctgtctcaaaaaaaaaaaaaaaaagaaaagaaaagaaaaaagaaagcaaaatgtcagcccctgataggccctgct

SEQ ID NO: 34562 - DNA, 601 bp, Human
aaaccccagaggctgccactgctttcctggggagcttggaggccacacccatgtgactgcagggcaggatggtggacttctaggcccctacagcctcggcagtgtcctcagatccggatgtggaaagtgctagaaagagagaaagggcaagagagggtgagaggccctgggtcgggcaggtaaaggctcctcagggaaaagcacagcaggccccagccccatgctggacagtgcctcattagggaaccctgcatagtggatgcaggtaatcaacactgggggaagacggaggaacagcggygcccagggagttctgcccccacttatcactgaaggggcccccaggtcttcaaccttccccctgcaggggacaaaggccagtcacacgtctagggcaagggtggcttgaacgtgacctcctgcttcctggccgcacaccactgctcacaaatagcgagtgataggggcctcagccccaacatcccggcctgccctgctctgccctgcccaagcccggcccctgtagtggcagcacctgaggaagtcaggggccttggcaatcatgtcctcgaagtcagcaaagcccagcttgccgtcaccg

SEQ ID NO: 34563 - DNA, 601 bp, Human
acggtgttggggaggcaggcagggtggtactcatgacccagaggcagagacaggagcaagagcccttgggcccactgcacccacagcttcacattgtgaaggaggccgggagaaggggaacaggcaggggtgggaagcagcccaaccttgggttttggaaaaagattgcatagctcgttaaaaccctgacctcttttttttttttccgctctgtcctgggtgaccagggtgtctgccagcacttggacacgtcagaccccaccacctcctgttgggttatctgcttttccctcttgggggrgtggggagcatttctggagtaggaaaggactggggcatggggcggggtgcggagggcctggagagaggccatgggtcccggggctggaccacagcggggctgtgggaagggtcctaaccttcacaggcccccttcctggttaaggttttttttttgctgaaagggccacaggatatatttgtggtgtaaaccccagaggctgccactgctttcctggggagcttggaggccacacccatgtgactgcagggcaggatggtggacttctaggcccctacagcctcggcagtgtcctcagat

SEQ ID NO: 34564 - DNA, 601 bp, Human
cagggaattcacggaaggttcggggcatgaatgtgttttcctcccgatggcacacgcactgaaatcaaagttagtgcctaaagcaggaggcactgcctaatgccgagaggtgagacaccaatggtgggatttcaaggatcagaagcaaaggtaccctcaaacatttcctaacattagcatacatggagagcaaagggatgcaaaagtgttttactaccaggagttcacaaatctgtggacagcacaccagtgaggattccacggtgttggggaggcaggcagggtggtactcatgacccakaggcagagacaggagcaagagcccttgggcccactgcacccacagcttcacattgtgaaggaggccgggagaaggggaacaggcaggggtgggaagcagcccaaccttgggttttggaaaaagattgcatagctcgttaaaaccctgacctcttttttttttttccgctctgtcctgggtgaccagggtgtctgccagcacttggacacgtcagaccccaccacctcctgttgggttatctgcttttccctcttgggggggtggggagcatttctggagtaggaaaggactggggcatgg

SEQ ID NO: 34565 - DNA, 601 bp, Human
atcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacrttgctttgttttttacaataataaaagcattattatttaagctacctttatcttggcatttgattcactctttgaggtggttcaaaaacagaatcgggccctgccagctttacagagtaaacacctttggagggagagggaggtgtcatatgcctcagtgacaacagtataatggaaaaatacaactgtctttccagctttggcctaatctgaatttgaattattgcccaaggccttctaggaaatactgcaggatattatggtcttaattcgtggactggatgcaaggattttttgtgg

SEQ ID NO: 34566 - DNA, 601 bp, Human
gccgtgaggcgtcagccccagcccggtgggggtgaggacgaggggcgccggggagagggagcccggccagccggcaggggcgccccttcggcggaagagggtcgccgaagaccctctcctcacctggttgagctcgttctcggctgcaatccgcaacttcgggtcgatggtgcccttcagcgcctggatgatccggttgaggtccatctccccgggtgggggctccgcggcccccggaacagtaggccggactgcagctttagttttcttttgaccctctcagcctcctcttccgcgaccyctggattacctcacaccccaccccccgccaccgtcgccacctgcggccacttgctgcgccactctgactccgcgccccctgtcctccctttttcccccccacaactcgctctccattcaccgttttacgacagccggtgggaggcgggagaaggaagaagaggaagcagagcttcctttacggcggcctcttcccccgggcgtgatgctatgaccgcctcccgtcggcggccgccatgctgctgtacggaaaacggcctaggcttctttcccggaaaggaacccgcgctcccgaactcag

SEQ ID NO: 34567 - DNA, 601 bp, Human
actctctactcaatgccattcttcagagaatggctatacatcccaacactcttgctcgggctttactctccacagcacttatgacctgaaattatattagttacttgcctgtatccccagctccatggaaacaaactcttataccaatatctgcaacatagtaacttaataaatatttctgtgctatttacataaacaaattatcttaataaagggtaatgaaaattgcatgtacacatgcatggaaagcagagattcaaaagcttggcaatcaaagtaaaaacttatttccctaccgagsccatgtgaaggataatttattaaaagaggacacctttctggatgaattacttaagcaaggtacctacccattcctattcctctatgctgcctctaatgggacttctggtctatagaaaatgaggaagatgtatagggttcgctcaatatcctgagataaaactacaaatacattttcccacagaaacaatatcacaaatagcagtcagaaaactactcactagtaacagaaaaatgctggcctgaaaaaaatatatagctccaaatgagaatttatccattggaatataggctgtggtgc

SEQ ID NO: 34568 - DNA, 601 bp, Human
ataaattcatggtcttaatctatgggcccagaggctaggctaccagaaatcataaaacgttagagagatcagctattaaaattgagaaaaataagggcaaagttacagaggcaaggaattggtgggtaaaagggagaggaggaaaaaaaagagctagaagatatttgagagctcagtatctacctctaaatttctggggaaaaagaaagtgagttttgaagtcactggaaatacttcatgagtgctagtgcttctgaatttttcaataaattacagatatgtaaaattaaaataaaactcycattctactctcacctataaataaatttataaaggataaaaaaccaactcacctgcctgtcgtactgggaattccacatggtcagagactataatccgaagtaaactgggggcaaaattgataatcttgtaggactgaaattacaaagaaatgttttataaaatagggcaatataagtgagtagcttataagttagcaccggttactgaatacattactgtccaaataaaagaaaaacttttaaactgagacaaacccttcaaggcaaaatgaagattactaaaatacttcaagtcaaaa

SEQ ID NO: 34569 - DNA, 601 bp, Human
tcaaagctgatggcagtcatctttgggtgtattaagaacaatgtaagttataaactgtgtttttctaatgtttccatgtcattaaaggaagacattaatgtaaaaacttgttttaagatcttttaaaatgttatttcttaaatgcttcataggaactttacaatggccctataaacacttaggtttttaaaataggttccattcaacaaaatgttattccagaacagccctattttataaaacaaagatgaaacaagtgccaattgtggtttcaaaaatttacacagaagtcttgtaaacyttataaaagcaaaaaataattccaacatcagtgtttttccataggattttcttttttatcttaaccacaaagtgatctttcaggaaatcatatatagtgttataaatcttcccaaagcttaatatttctttatctttttattctatgttcaaatcaaattaaatactttcatcagcatgtagattatgacccatttctctgaaactgttcatctatccttctacgtgaacacatggaaaggctaatgttcacctaacgttaatgatgagtaatgatggccatttctgagtgatgaatgtt

SEQ ID NO: 34570 - DNA, 601 bp, Human
aaaagtacatttctgagcctaaatttacatatattagagaaattttactaaagagtctcttcagatgtaagaagtaaaaaattagaaacaaaagtgatttgaaattccagatcataactatcctaaatttaagataggcttccttcaccgcacatgataatattaataatgctattatgcttatcaacacctcaaaagaaaagcagcagaccaaacattcaaatttttttgttttgcttggcaacatcaaaatacttaattttttcctgtttcttgaaaactcacagtaaggtaagaaagsacattcaccagtgagcacgcttgatggtagcaagaacactttagattgcccacaagcaaaagagaaaaagtattttgcagatgtatttccacttaacattagcataactttttttttacagctttatacaggctttcttttaaagcaaaaatcacaacattcttttttaagtgtcatgctaaagataaattatctttctaggtgtcttggagcatccttgtattttaataatagattaaacagaacagaaaatttataaataccacttaaatttaggatttgaaatctaaattatgaaaa

SEQ ID NO: 34571 - DNA, 601 bp, Human
cctcttcaggtctaatacctctcaaccaccacttttaaatccaaactactctctccttctcgtagcaactccaaaatgcactgaaaaaagtacatttctgagcctaaatttacatatattagagaaattttactaaagagtctcttcagatgtaagaagtaaaaaattagaaacaaaagtgatttgaaattccagatcataactatcctaaatttaagataggcttccttcaccgcacatgataatattaataatgctattatgcttatcaacacctcaaaagaaaagcagcagaccaaayattcaaatttttttgttttgcttggcaacatcaaaatacttaattttttcctgtttcttgaaaactcacagtaaggtaagaaagcacattcaccagtgagcacgcttgatggtagcaagaacactttagattgcccacaagcaaaagagaaaaagtattttgcagatgtatttccacttaacattagcataactttttttttacagctttatacaggctttcttttaaagcaaaaatcacaacattcttttttaagtgtcatgctaaagataaattatctttctaggtgtcttggagcat

SEQ ID NO: 34572 - DNA, 601 bp, Human
cttatttatgatttagtcattaaatactattaatattaattttataaatgaaaagttataatttaaaaattatggtgcatcaaacgagacagcctttaaaaaaggcacactgactaatttgtatatgcctaaataaatgtacaatgaggtaaaataaaattgaaaatatattaaaaagaaaattttaattactatgatggataattatggattactaaggataaaggaaaaataccaaagataactgttaccatatcaaccaataatctgaaaacttccctttaatcatttaattcaagtrcctaaatacaaaccatttgccagaactaagaaacaaaggactaatatcatgttaatccaattcataaaggaaatattaaatttactgtatctgtctgggtgtcttagagcatccttgtattttaataatagattaaatagagcagaaaatctacaaatggcacttaaatttaggatagttataatgtagaattttataaatgtatttcagattctatgataaaaatggctgctctaagacagttttcctacaaaatccactcaccattttaagcatcataagttgaaattaactttctaa

SEQ ID NO: 34573 - DNA, 601 bp, Human
aaaatttttggaaaaaagctcagaaaatttttatatgttcacatctatcaaaatacataatctgattttgttctgttctttttaatcgtcttcaacctttaacaaaaggcttctgaaagaaacaggctgacatattgctacagcattttaagaaagaatgtgaagcttttcttttcttttttttttttttgagacggaatctttctctgtcatccaggctagagtgcagtggcaagatcttggctcactgcaacctctgtctcccgggttcaaacgattatcctgcctcagcctcccaaayacctgggattacaggcatgtgccaccacacccagctaatttttgtatttttagttagacaagatttcaccatgttggccaggttggtctcgaacacctgacctcaggtgatctgcctgcctcggcctcccaaagtgctaggattacaggtgtgagccactgcacctggccagaatgtaaagctttctaaccatcccagttgaacagtgaatgtaagtaaatacttataatgttgtgtgtgtgtgtgtgtgtgtgtgtgtgtaaagaatacagatacgtgatttgcaaagcagcataactt

SEQ ID NO: 34574 - DNA, 601 bp, Human
tcctttctcattccaagcaaaggatggttatgaaaggccatccttcatgcattactgtgtagaaccactcgaagattaagggagatctgaaaatttaagattttgaaaataaatggatacatgatggtaccacaggggtatcagtcccatgactggcatttgggcaaccaataagaataatagtgattttttctttttaaccagtacacctattttctcctcttaacaaattaattgctctaagagttcaatgtttgttctccttcctgttacccgtcgtacttccttccttttccactgyttatgtcatgatggctattagatactaagggctaacgttatattcaacctcttgatattaaaaaatttcattcctctacctctgttttcacctatttgtccctcccattttcaaaagatacctaattactatcttgtatgttgaaaagaatttgtttctcctattttaagattgcaaaatttttatgactttacagctgctctgtccaatagagcagctgctagttaaatatgcacactttaaatgaatcaaaagtaaatagaattaaaaattcagttcctcagttacaactagcaacat

SEQ ID NO: 34575 - DNA, 601 bp, Human
gaatacgaggcaggaatatctgcattgctattataagaggttctctctcttctgctttcttatatctacatgagcaaagacaaaaacagaaaagtaatttttcccacccaaagaaccatcaacaataaattataaaatattttttaaatacataaaactaacaaaacaaagtcattaacattggcttctagtttgtttgaattgctagaattaagttgaaaagaaatttaaaataacacatcctgttttaggcacaacacctaaaatctttctggaaagatttagactagtttaaaacaayccgagaccattttgcagttttcctacatgaatgtttctagtatttaaattaattttcatccagccaaaattcttactataaaatataagttgctatgctattttaaatagactatataacaaataatatggggggaattttcttattatatttctccctgaattgagtagttaaaatagtttaaaatttaggtgctcttagattgctttaattgccataaatctaaaatatgttctataaatttcataagcagagtaggaactagtcagtttaaaaggagaactacaggacttcatatac

SEQ ID NO: 34576 - DNA, 601 bp, Human
attttaaactaagtgttagtacaacagagtcaaaaagttaaaaattttaaagtttggccaggcgtggtggctcacgcctgtaatctcagcactttgggaggccaaggcaggcggaacatgaggtcaggagtttgagaccagcctggccaaaacagtgaaaccccgtctctactaagaatacaaaaaattagccaggcatggtggcaggcgcctgtaaatcgaggctgaggcaggagaactgcttgaacccgggaggcggaggtggcagtgagccgagattgtgccactgcactccagcccrggtgacagagggagactccatctcaaaaaaaaaaaaaaaaaaatttaaagtttatgaagtaaaaaagttacagtaagctaagctagggttaatttattattgcagataaattttataaatttagtgtagcctaaatgttcaacatttataagcatagactaacgtcctaggccttcacattcactcaccactacctcacccacagcaacttccagtcctgcaagttccattcatggtaagtaccctatacaggagtgctttttaaaaaatatcttatactgcatttttagcatatctttt

SEQ ID NO: 34577 - DNA, 601 bp, Human
atctgggtgataacacaagtgtatgtcaaaattcactgaactagtcattaagttctgtgcatttatgtatgtaagctaaatgtcaaaatactttgtctcacaatatggacaagagaaataatactgcacattttaagacaaactaaaattttaatagatacaagaactaatgtgataaattaaagatagtattattgcagatcaaaatgaaacacatcttttccctatcaaatggacaaacttagaattaagtgtgtacccataacaggcattctcagtcactgcttattaaagtgtaacygagggcacactttattgcagagcactctgcaagattagtgaaaagccttccatgtttctagtttatccaaagaaaataatcatatatgtgcacaaaaatttaagtacattcttaagagttaaaacactaaaaaattaaagcctaaacatccagcaagtaaaacattcaacaaaaatgacagtataggccaggcgcggtggctcacgcctgtaatcccagcactttgggaggccgaggtgggtggatcacgaggtcaggagatcgagaccatcctggccaacaccgtgaaaccctgtctct

SEQ ID NO: 34578 - DNA, 601 bp, Human
agttagattgctatacaaatgaaaattctttatagattgctaggcaggaattaaataagcaaagtaaatttcaactaaacaatgctgctgttcacatttacctcctgtcttcaaaaggcctaaataagtagaggacaaaatacaaaacaccatggttccttcaggacactctgagatgatgaaagggttctacatttttatctgggtgataacacaagtgtatgtcaaaattcactgaactagtcattaagttctgtgcatttatgtatgtaagctaaatgtcaaaatactttgtctcacratatggacaagagaaataatactgcacattttaagacaaactaaaattttaatagatacaagaactaatgtgataaattaaagatagtattattgcagatcaaaatgaaacacatcttttccctatcaaatggacaaacttagaattaagtgtgtacccataacaggcattctcagtcactgcttattaaagtgtaaccgagggcacactttattgcagagcactctgcaagattagtgaaaagccttccatgtttctagtttatccaaagaaaataatcatatatgtgcacaaaaattt

SEQ ID NO: 34579 - DNA, 601 bp, Human
gtggctcatacaaagtaggggtgatgggagatgggaaatgggagattctctccctacacaacagtgggggagagaagagtccctgataagaaaaccatttttaagtatcaggaatatatccttaaataaccatggtaccaagagtttataacacggatataatggcatttttatatgtgtatacatgtatacacacacatacatgtttatgacactgaaaaaaaaattgactcaccacacttcaagtgggaattaactttaagatactttaaggagtttaacattagtggacagcactggraggggcagaagacagatgaccagcttcctgattgtcctggttttattcactaattttccctatagattgtctcaccagccaacaaaataacttgtgagaaattcaactatataactacaactttcctgaactgttgcattgtactttttagaaagcattctactaggcaaaatgataacacataaacggaagtattccatctcaagacaacaggttctaagtacttaacattataatgctgacaataaagagctatttaaaaaaaaaaaatctagagccgggcacggtgattcacacctg

SEQ ID NO: 34580 - DNA, 601 bp, Human
tgtcatcatgtagaaaccccttctgtgatgcaagctagaaatggatgatactgaacatgattctttctaatacagatgtggctcatacaaagtaggggtgatgggagatgggaaatgggagattctctccctacacaacagtgggggagagaagagtccctgataagaaaaccatttttaagtatcaggaatatatccttaaataaccatggtaccaagagtttataacacggatataatggcatttttatatgtgtatacatgtatacacacacatacatgtttatgacactgaaaaaamaattgactcaccacacttcaagtgggaattaactttaagatactttaaggagtttaacattagtggacagcactggaaggggcagaagacagatgaccagcttcctgattgtcctggttttattcactaattttccctatagattgtctcaccagccaacaaaataacttgtgagaaattcaactatataactacaactttcctgaactgttgcattgtactttttagaaagcattctactaggcaaaatgataacacataaacggaagtattccatctcaagacaacaggttctaagta

SEQ ID NO: 34581 - DNA, 601 bp, Human
ccctgaaaaaatttaaattaactccctcaacttcacaccaaaataaacttcagatggggaactattttaacactgacaaaaaatgatagcacaggattccttaaagaaaacatgggagaattttcttttataatctcagattataaaagaaggtatttgtaaacacaacacaactgagaagttattttttaaaaactgattttttaaaaactgatttaaaaaattatttataaggaaaaagccatgccaaagcacctctgaactggctcaaggacctttaggcaactttcttcactacagyaagttgccttccaattcctggtctccagagctcttcaccatatcaagcttataagtgagttgctgaataaataaaaagcattctttcaaaataggtacagaaattataaattcagaatatggattttattcaagtttcctaaaactcaggtttaccaaatttgtcggaagtcctgtcatcatgtagaaaccccttctgtgatgcaagctagaaatggatgatactgaacatgattctttctaatacagatgtggctcatacaaagtaggggtgatgggagatgggaaatgggagattctc

SEQ ID NO: 34582 - DNA, 601 bp, Human
cggtgaaaccccgtctctactgaaaacacaaaaaaattagccgggcgtggtggcgggtgcctgtagtcccagctactggggaggctgaggcaggagaatggcgtgaaccccggaggcggagcttgcagtgagccgagatcgcgccactgcactccagccctgggtgatagagcgagactctgcctcaagaaaaaaaaaaaaaaaaaaaaaaattacaataacagatctgactaaagaaacattaaaaacttccatacaacaagagacagcacaaagatgtttctttatttcataaagactycttcaaattagaaaagttgttcaaaaaatagtattggcataactgattagccccctgaaaaaatttaaattaactccctcaacttcacaccaaaataaacttcagatggggaactattttaacactgacaaaaaatgatagcacaggattccttaaagaaaacatgggagaattttcttttataatctcagattataaaagaaggtatttgtaaacacaacacaactgagaagttattttttaaaaactgattttttaaaaactgatttaaaaaattatttataaggaaaaagccatgcc

SEQ ID NO: 34583 - DNA, 601 bp, Human
cggtgtctcattgtaacttccaggcaaagtctaaatttctattccactgctagctcttcaaagtaagttaaaactcctgtttaaaaaattacaataacaggagccgggcacggtggctcaagcctgtaatcccagcactttgggaggccgaggcgggcggatcacgaggtcaggagaacgagagcatcctggctaacacggtgaaaccccgtctctactgaaaacacaaaaaaattagccgggcgtggtggcgggtgcctgtagtcccagctactggggaggctgaggcaggagaatggcrtgaaccccggaggcggagcttgcagtgagccgagatcgcgccactgcactccagccctgggtgatagagcgagactctgcctcaagaaaaaaaaaaaaaaaaaaaaaaattacaataacagatctgactaaagaaacattaaaaacttccatacaacaagagacagcacaaagatgtttctttatttcataaagactccttcaaattagaaaagttgttcaaaaaatagtattggcataactgattagccccctgaaaaaatttaaattaactccctcaacttcacaccaaaataaactt

SEQ ID NO: 34584 - DNA, 601 bp, Human
tgtggcttcatctgcttccaggttatagaatgaaccaccccttggttgagatagttgaatgcttgctggagaacacggggagctacatattctttctgtctatattgatctaaaatttttagtagcacctataagaaaacagaaaatacagactaacataaacaattataaggttaaaagggggaggtgccatttttggcatgacctaaaattcagaatccatagaaaaataaacagatttgggagaaaaatcaatgttttgtaagaaagctcagataaacagctttaattattagacagrtccatgttatattgaactaaacggtgtctcattgtaacttccaggcaaagtctaaatttctattccactgctagctcttcaaagtaagttaaaactcctgtttaaaaaattacaataacaggagccgggcacggtggctcaagcctgtaatcccagcactttgggaggccgaggcgggcggatcacgaggtcaggagaacgagagcatcctggctaacacggtgaaaccccgtctctactgaaaacacaaaaaaattagccgggcgtggtggcgggtgcctgtagtcccagctactgggg

SEQ ID NO: 34585 - DNA, 601 bp, Human
gtgaatccaggtctcccgactcataaaacttgaaggcttcacttttctcaaatgcttaaatttctaagccctttatatctgacataggacttcactcattagaaattattaatggtaaaatgtatatatataaaatgtaaaatataggattagtaatactaactttgtctagaaaacctaatttaaccagagaataattttggagagctgctctctgacactaacctgtatgtgtggcttcatctgcttccaggttatagaatgaaccaccccttggttgagatagttgaatgcttgctgragaacacggggagctacatattctttctgtctatattgatctaaaatttttagtagcacctataagaaaacagaaaatacagactaacataaacaattataaggttaaaagggggaggtgccatttttggcatgacctaaaattcagaatccatagaaaaataaacagatttgggagaaaaatcaatgttttgtaagaaagctcagataaacagctttaattattagacaggtccatgttatattgaactaaacggtgtctcattgtaacttccaggcaaagtctaaatttctattccac

SEQ ID NO: 34586 - DNA, 601 bp, Human
acgtaacaaatgggtataggctattcaagtttgaggaatactaataatgtacttgttgacagcctttatgatgttagttttccaaactctgtgtgtgtgtaaaatgtcaagtcgaggttatatttactattatagttcttattttgaaattttttttaacatttccattttagtcgtaaatgtccatgtattaacaatattaaagggccaggcatggtgactcatgtctgtaatcctacctctttggaagcccaagggcagaaggatcgcttgaggacaggagttcaagaccagcctgggsactgtagcgagaccccatctccaaaaaaatacataaaaacgtagccaagcatggtggcgtccatcttggagggtctcttgagcctaggagctcagggctgcagtgagccatgatcatgccactgcagtccagcctgtgcaacagagtgagactccagctccaaaaaaaaaaaaaattggaattttctttacttctattcccaaaaaaactaatttcctactccacaaatgtttcagttagagaaaagtcctatctactagcctctctgtgcactgctactaatgtcctattaagcccttt

SEQ ID NO: 34587 - DNA, 601 bp, Human
taccaaatttcatccttatatactcatatggatcttcttgccacagctcttcatcctcatctttataacacatcacagaaaaaatcacatcttcagagatattctaaaatgagaaaaaaaaaaaaacgtaacaaatgggtataggctattcaagtttgaggaatactaataatgtacttgttgacagcctttatgatgttagttttccaaactctgtgtgtgtgtaaaatgtcaagtcgaggttatatttactattatagttcttattttgaaattttttttaacatttccattttagtcstaaatgtccatgtattaacaatattaaagggccaggcatggtgactcatgtctgtaatcctacctctttggaagcccaagggcagaaggatcgcttgaggacaggagttcaagaccagcctggggactgtagcgagaccccatctccaaaaaaatacataaaaacgtagccaagcatggtggcgtccatcttggagggtctcttgagcctaggagctcagggctgcagtgagccatgatcatgccactgcagtccagcctgtgcaacagagtgagactccagctccaaaaaaaaaaaaaa

SEQ ID NO: 34588 - DNA, 601 bp, Human
aatctccagttctctagttcaacaaaataacatcaaactctcaaagtttcagattatgtcatgcaaaacagaacctgggagatttaataaagtaataacatttgcttaaaaatataaatttagttatattactttacatatccaggaactgatgagaaataaaaccatctcaattaccaaatttcatccttatatactcatatggatcttcttgccacagctcttcatcctcatctttataacacatcacagaaaaaatcacatcttcagagatattctaaaatgagaaaaaaaaaaaaamgtaacaaatgggtataggctattcaagtttgaggaatactaataatgtacttgttgacagcctttatgatgttagttttccaaactctgtgtgtgtgtaaaatgtcaagtcgaggttatatttactattatagttcttattttgaaattttttttaacatttccattttagtcgtaaatgtccatgtattaacaatattaaagggccaggcatggtgactcatgtctgtaatcctacctctttggaagcccaagggcagaaggatcgcttgaggacaggagttcaagaccagcctgggga

SEQ ID NO: 34589 - DNA, 601 bp, Human
cctgtcctcagaaagcttctaagttgtgggagataggtatgcaaattaatattttgctatgttaagtgcttgagtgttccatgaagcaattaatacaaactgggaataaaagggaataaatcaggccacctacacaattcaacagtttccaggaagatccaagttaaaaggacacccaaagaattggaccacacacagtagggcccccatacgaaatttatttcccttgtggaacacttagtctctcagacaagcaagcaaaccaaattggggtacccctaaaatatgcagaaatccaaastatttcccacatgagaacaacccaatctataaatgagtctcccaaaaggcacaaaaacggatggtccctgcagatcagcatcgcaacagcataagtaacagatggctcaacttgagcacccgtaagagagatgaatgaggtggcttttcatctcccacatccgacaatctccagttctctagttcaacaaaataacatcaaactctcaaagtttcagattatgtcatgcaaaacagaacctgggagatttaataaagtaataacatttgcttaaaaatataaatttagttatattacttt

SEQ ID NO: 34590 - DNA, 601 bp, Human
aaaacaggatcctcacttactgaatcaaataatataaacacaaagctctgtaaaaacacagcccaaaaaactagcatctgtaccagtaggtttagcttacgtagctagacacacctggctcaactaaggggaaagcactgcttcattacagcactttcagcacgcagcgctagatttagcaatcatttctttcaacatgtattgaaggcatactggaggccaagcactagtggaggaatgcagaggtgtagaagagagagaaaatgcaaaattaagcaaataaggtaaaattcctgtcctsagaaagcttctaagttgtgggagataggtatgcaaattaatattttgctatgttaagtgcttgagtgttccatgaagcaattaatacaaactgggaataaaagggaataaatcaggccacctacacaattcaacagtttccaggaagatccaagttaaaaggacacccaaagaattggaccacacacagtagggcccccatacgaaatttatttcccttgtggaacacttagtctctcagacaagcaagcaaaccaaattggggtacccctaaaatatgcagaaatccaaactatttccc

SEQ ID NO: 34591 - DNA, 601 bp, Human
tgtttctcattgatttgcttttctgatactttgtctccaagagaaaacaggatcctcacttactgaatcaaataatataaacacaaagctctgtaaaaacacagcccaaaaaactagcatctgtaccagtaggtttagcttacgtagctagacacacctggctcaactaaggggaaagcactgcttcattacagcactttcagcacgcagcgctagatttagcaatcatttctttcaacatgtattgaaggcatactggaggccaagcactagtggaggaatgcagaggtgtagaagagasagaaaatgcaaaattaagcaaataaggtaaaattcctgtcctcagaaagcttctaagttgtgggagataggtatgcaaattaatattttgctatgttaagtgcttgagtgttccatgaagcaattaatacaaactgggaataaaagggaataaatcaggccacctacacaattcaacagtttccaggaagatccaagttaaaaggacacccaaagaattggaccacacacagtagggcccccatacgaaatttatttcccttgtggaacacttagtctctcagacaagcaagcaaaccaa

SEQ ID NO: 34592 - DNA, 601 bp, Human
atgtcgtgaaacaaagaaacagattatacatatatacacacataataagtcaggctaagaacaaatgtaaaatagggtaaagagacagagtgacagagtatggggtgctagtttaaatagggtgttagcaaaagcctctccaactctgttaaggtaacatttaagcagaaattgaatgaaatgagggagaaagcaatccatggataaagtactccaagcaggtgaaacagcaagtataaaagccttgaaggactgctaggaccatgcctggctctgtcgatacgtaagttcagcaggtttygttgaatatatacctatctaaaacttaacatatcacttaataccatgaacattttcacaagtttcagaataggcagttttacataagaaactgaagtcttgagaggtatctgataagtccttgtttaaatacaaaagataaaaccaaatctaagtctacctcaaaatataaaatacaaacataataagaacatttttggagtactgtacttactctgtgccaagcagtatgctacagttttagaagcatcttgtattctatgctaagcagttagttcatgtgtattatcccatttaatcc

SEQ ID NO: 34593 - DNA, 601 bp, Human
ctattatattgaagaaaacaatgcatttacacatctgtttcactgagaacagaaaaagtgctttatttctatcaaaaaacaacaaaaattcactcagctcttactatgtgccaggtaccattctagaccctggggatacaaagatcaaacaaaaaggttctcacggagcttatgtcgtgaaacaaagaaacagattatacatatatacacacataataagtcaggctaagaacaaatgtaaaatagggtaaagagacagagtgacagagtatggggtgctagtttaaatagggtgttagcraaagcctctccaactctgttaaggtaacatttaagcagaaattgaatgaaatgagggagaaagcaatccatggataaagtactccaagcaggtgaaacagcaagtataaaagccttgaaggactgctaggaccatgcctggctctgtcgatacgtaagttcagcaggtttcgttgaatatatacctatctaaaacttaacatatcacttaataccatgaacattttcacaagtttcagaataggcagttttacataagaaactgaagtcttgagaggtatctgataagtccttgtttaaa

SEQ ID NO: 34594 - DNA, 601 bp, Human
gacactgcttgacagtactaaaaaggtaaggatatacagtggcaccacaacattgctgtctcctgcacaaaacaatgttcctcaaactctacaggctgtcctttcaaactattatattgaagaaaacaatgcatttacacatctgtttcactgagaacagaaaaagtgctttatttctatcaaaaaacaacaaaaattcactcagctcttactatgtgccaggtaccattctagaccctggggatacaaagatcaaacaaaaaggttctcacggagcttatgtcgtgaaacaaagaaacasattatacatatatacacacataataagtcaggctaagaacaaatgtaaaatagggtaaagagacagagtgacagagtatggggtgctagtttaaatagggtgttagcaaaagcctctccaactctgttaaggtaacatttaagcagaaattgaatgaaatgagggagaaagcaatccatggataaagtactccaagcaggtgaaacagcaagtataaaagccttgaaggactgctaggaccatgcctggctctgtcgatacgtaagttcagcaggtttcgttgaatatatacctatctaa

SEQ ID NO: 34595 - DNA, 601 bp, Human
ttctagattttaaacctgactgaccgctattccaaaccaaaaaaataaaaccatccacatatgacactgcttgacagtactaaaaaggtaaggatatacagtggcaccacaacattgctgtctcctgcacaaaacaatgttcctcaaactctacaggctgtcctttcaaactattatattgaagaaaacaatgcatttacacatctgtttcactgagaacagaaaaagtgctttatttctatcaaaaaacaacaaaaattcactcagctcttactatgtgccaggtaccattctagacccyggggatacaaagatcaaacaaaaaggttctcacggagcttatgtcgtgaaacaaagaaacagattatacatatatacacacataataagtcaggctaagaacaaatgtaaaatagggtaaagagacagagtgacagagtatggggtgctagtttaaatagggtgttagcaaaagcctctccaactctgttaaggtaacatttaagcagaaattgaatgaaatgagggagaaagcaatccatggataaagtactccaagcaggtgaaacagcaagtataaaagccttgaaggactgctagg

SEQ ID NO: 34596 - DNA, 601 bp, Human
aaagaaaaatgaaatacctcttttcttttctttgcagcagtatataagagagtctgggctgctgtggtgggagaagcataatcttcaaaaatatctaagattttaaaaggttaaaaccatgttagtgaaaatataattacttattctagattttaaacctgactgaccgctattccaaaccaaaaaaataaaaccatccacatatgacactgcttgacagtactaaaaaggtaaggatatacagtggcaccacaacattgctgtctcctgcacaaaacaatgttcctcaaactctacaggytgtcctttcaaactattatattgaagaaaacaatgcatttacacatctgtttcactgagaacagaaaaagtgctttatttctatcaaaaaacaacaaaaattcactcagctcttactatgtgccaggtaccattctagaccctggggatacaaagatcaaacaaaaaggttctcacggagcttatgtcgtgaaacaaagaaacagattatacatatatacacacataataagtcaggctaagaacaaatgtaaaatagggtaaagagacagagtgacagagtatggggtgctagtttaaa

SEQ ID NO: 34597 - DNA, 601 bp, Human
aaaatcaaattcaagttcttagccaatctggaatttcatgtcattttatacacaaaataaatccatttgtgaatttaaattgtatcactgctataaaatcacctttctcatttcatgttttacatatgcagcaagtgaggctagggtgacaaatgaaataaaaccagcaggaaataaaatccataaatattttccttttttttttaagacagggtctcactgttgtccaggctggagtgcagtggcacgatctcagctcaccgcaacctccgcctcccgggttcaagcaattctcctggctcagcctccctagtagctgggataacaggcgcctgccatgaagcccagctaattttctgtatttttgtagagacagggtttcaccatgttggccaggctggtctcaaactcccgatctcaagtgatccgcccacctcagcctcccaaagtgctgggattacaggcatgagccactgcgcccagcctataaatctttttctttaatagtctgtcctttattcagctgatgtgaccataggcagacattctaattgactctatttcatctcaatatgtggcaaaaggtcaatttgtccaaaaa

SEQ ID NO: 34598 - DNA, 601 bp, Human
aagactgtattattaaaaaaggtaagtagggagctattaggattatagcattctgtaataatatcacagatataagaacttcttagtaaaatatcaattctatgaagaaatgtttgcttttggggtaacacagtagccttagtttctaacttctacatccccctttttacaagtaaggcattttcattacttctaaattacccatatgcaataacatttttcataggaaagagaaaaagaagccaaatatgtctttgacaaaaatctatttacgcttttaataaatattataactcataaytaatttgttatatgtaaaagcaactccaaaccagtatctgaaattcatttgtcacacttaggtaaaacattattttcccttacactaactggtttagtaagcttcctttttttcactctcataggtaccaaaaattttaaacctggtatagatgatcacattttaactattagaccacagaatcattattatattttactctctgtgtgcatcaaacacaatcaacagaaattaattctagttactaaagacttttagcaagagaatcacaattcatataacttctcaaaggtaggagcc

SEQ ID NO: 34599 - DNA, 601 bp, Human
cccaaaatactaatagcccccactgagaaattctaattatacatacacttggtcatcagaatgacttggaaaacatgaatcagttctcatgacaagttataaaaaatcatgtatgtgaagactatcccgaatactgatggggccccttccctgccccaggccatctctaccaccctcccttgccatgtgtacaatatccaatcctcccactgaaacattgctgaatagaggcaaactacgttcatgttcttcataaagctgaacttactttcaaaggtttatttgaactttgatcagaacrctctgaacaaatgagacgtctgttatcactcactagaaatactacttgctactttcaaaactaggggaatcagaatcccagaggtgaaaggaatcatgaagtcattcagtccaactcccctaaacttaaatatgtggaaacctgagccttgacagatcacacaccttgcccaggtttccatggcaagttaggagcaaaatcaaaactgggcccaggtctctttatgcccagcctatcctagggccccacaatgattaacatgtttcctaacctaaaattctgaaaactacagtcaatagg

SEQ ID NO: 34600 - DNA, 601 bp, Human
gtaatataaggataagaagtcctgcacaggagagaactgtcctgtgcagaaactatcccaaaatactaatagcccccactgagaaattctaattatacatacacttggtcatcagaatgacttggaaaacatgaatcagttctcatgacaagttataaaaaatcatgtatgtgaagactatcccgaatactgatggggccccttccctgccccaggccatctctaccaccctcccttgccatgtgtacaatatccaatcctcccactgaaacattgctgaatagaggcaaactacgttcaygttcttcataaagctgaacttactttcaaaggtttatttgaactttgatcagaacactctgaacaaatgagacgtctgttatcactcactagaaatactacttgctactttcaaaactaggggaatcagaatcccagaggtgaaaggaatcatgaagtcattcagtccaactcccctaaacttaaatatgtggaaacctgagccttgacagatcacacaccttgcccaggtttccatggcaagttaggagcaaaatcaaaactgggcccaggtctctttatgcccagcctatcctagggc

SEQ ID NO: 34601 - DNA, 601 bp, Human
ggaattaacttggtcacaaggtcaagtgacccagggtaatacctaaatcaggttctagatacacacttgctctgtggtaagttacaaagctgtacctaaataatgttcaccaatatatcagtttcccaagagtaatataaggataagaagtcctgcacaggagagaactgtcctgtgcagaaactatcccaaaatactaatagcccccactgagaaattctaattatacatacacttggtcatcagaatgacttggaaaacatgaatcagttctcatgacaagttataaaaaatcatgtaygtgaagactatcccgaatactgatggggccccttccctgccccaggccatctctaccaccctcccttgccatgtgtacaatatccaatcctcccactgaaacattgctgaatagaggcaaactacgttcatgttcttcataaagctgaacttactttcaaaggtttatttgaactttgatcagaacactctgaacaaatgagacgtctgttatcactcactagaaatactacttgctactttcaaaactaggggaatcagaatcccagaggtgaaaggaatcatgaagtcattcagtcca

SEQ ID NO: 34602 - DNA, 601 bp, Human
ttgactgaaatgttgttatgcagcacatgactgtacaaataaaactgaactccatattttggagtttatttagattactcaaggtttctaaaccaaattaacataaaactgcccggtcttaccaagtgttgggtcatatcaacagcaattgaggctacctcttgactgtattcacatatcatcttctggatgacattagtaacatcatcattttctgtctctctaacaatgtgcaacagttcctgcataataggcctcacatgtggcttcatatattccttagctaattcaataaaacaamcaaaagtaataaaaattaccatgcccagatgataaaaggaattaacttggtcacaaggtcaagtgacccagggtaatacctaaatcaggttctagatacacacttgctctgtggtaagttacaaagctgtacctaaataatgttcaccaatatatcagtttcccaagagtaatataaggataagaagtcctgcacaggagagaactgtcctgtgcagaaactatcccaaaatactaatagcccccactgagaaattctaattatacatacacttggtcatcagaatgacttggaaaacat

SEQ ID NO: 34603 - DNA, 601 bp, Human
aaagcctagcaacataactaagtagcaatttaaaagtggagacttcaaaattcatggccactgatcacataaatttcagttaaatgctactatcataaaccacaaagaaatctcacctctttatgatcttctacaactgttaagatagtatcaatggtatgtaaaattcccatagccattactgttttgtcttcaacttcttcatattcatcactttgaagaactttgccaaatatctcagcctatgaaaataacattaaagtattccgcaattagtagtactgttacgtccccgctttayaaaagttagcaaaatggcagtgtcacacatctgaagtctgcattgctcaaactttgaagtctgcactttgctgactgaatcatctctcttcttaaaataacagaacttgtcatgttttaaatatagctatttacattaactattatatccagagagctaatatttaacttctggttgtcactaagcaagtaaaatcacaatctaggacaagtgaaatcaagtaatagtaaaaagaaaaatgcaatagaagattgagaagtcgaggaatcacttagaaaatgaaacaaacaaaaaaaaaaa

SEQ ID NO: 34604 - DNA, 601 bp, Human
ggaatttctaaaagttctagcatggcactgggataaaaacagacacacagaccaatggaaccgattacaaagcccaaaagtaaatctacccatttagggtcaattaattttcaacaaagatgctaaaaacacacaatggagaaaggacagtctcttcaataaatggcactgggaaaactaaatatccatttgcagaaaatcaaattagaccctcatcttacaccacatacaaaaatctacttgaaattaattaaatacttaagctctaagatctgacatgataaaactactagaaaaaaamacaggggaaaagcttcacggaaacttggaacactggtccagggaatgattttttttttttttatatgaggatatgaccccaaagcacacacaacaaaagcaaaaacagacaaaataggattacatcaaactaaaaggcttttgcatagcaaagaaaacaattcacagaacagacaacctccaaaatgagagaaaatatttataatctatatcaaatgaagatttaatatccaaaatatataaggaactcaaaccattcagtagaaagaaaataacccaacttaaaaatgggcaaaggaac

SEQ ID NO: 34605 - DNA, 601 bp, Human
gacaataagacccactataaagtagaagagttcaaaggaaatgttcttatactcacaaatatcattatcctcagtcaaaagtaaattatatctacacgtacagccaggaaacacaaatctcaacaaaaatttcaaatagttcctaccataccactgagcaaagaagtctaacttgaaaggtttttcctcttataaaaactagtggtcaccctggaaacttgattaaggtttctctaacattacttaaaacttaatatattcaaaagctagcaaaataaaatggaaattacaaatattgatraataatttatgtaagaaaataatttgaaaaataaattatctaaatatggaatttctaaaagttctagcatggcactgggataaaaacagacacacagaccaatggaaccgattacaaagcccaaaagtaaatctacccatttagggtcaattaattttcaacaaagatgctaaaaacacacaatggagaaaggacagtctcttcaataaatggcactgggaaaactaaatatccatttgcagaaaatcaaattagaccctcatcttacaccacatacaaaaatctacttgaaattaatta

SEQ ID NO: 34606 - DNA, 601 bp, Human
tgggagggttgtacactagctatttcactcccagctctacggccaaacgttttggtttctggttatttgagctttataaaatctgcctgccagctttatgcaatatagtttcagtttcatatttatgtgtgtgtgtgtgtgtatgtatatatttacttatttatttacctaaaggagaagaaaaccgttatttagccaaagatcccaaaagataaccaatagtgggccaaacctatcttgtggcaaagacaatatggcagacaatcatgtttgtgtataaggataacagtagccattatgkagattgtagattatagattatcttgttaaatgatgcttttccaactattaaaatttttatcttatgttgtttatgctcaaattacctacatctagtgacttccaatatatacattaaattaaaaaataaaaaagatcattccatttgtcactgattaacaaaacgtgtggttaattttcctagcacttcaatcaagtagaaaattcatgtccaaaagaaaaaacaaaaagtaaaaagtacagatatagaagtggcaaacattcataagcacgacacacaatatgaaactttcaaatccca

SEQ ID NO: 34607 - DNA, 601 bp, Human
ttaattaagaaattccagataattctgacagatttaacattcccatttaatttcattctctcccaaaatgctatcaaaatgacaacagagaaattttaaagatgtacatatacaaagacagaaaaaagtagagagaacagcaatacacattttggaagctggaaaatagtgagctgaatgataagcagatatcaggcaaagccaagagtcaactgtatttacataaatttaaaatgctatctctaggacagtataccacagtctagcttctaaatgtgaatggactctggaaccaggctgyttaggttcaaaccgcagctcttccacttattagctgtgtttttagaaacgttacttaacctcttttactgtccccatctataaaatgggaataaaagaacctacttcatggggtcgtatgatacaaaaagaaaaataattactcccttttctcaaaattgcatttacttggggaccatttgttttggtttgccaaaaggaaagaaaacaaaaatgtatcttgtaattttttaaataggctctggagtcagattaggttcaaatctggctccaacacatagtagctatgtgattgcaacta

SEQ ID NO: 34608 - DNA, 601 bp, Human
agagagaactaaaagcaaattcattgaaaaaaaagacttaacgaagtaagaagctttttatataagttatttttaagaagaaaaaaaagcaaaacattaaaaatattaggaaagagacaaatacagacaaaagacagattagaaataatactataaagaacactatattctttacatttaaaaactcagattagatgattttctagaaaaataaaatttaagaaaaattaattaagaaattccagataattctgacagatttaacattcccatttaatttcattctctcccaaaatgctaycaaaatgacaacagagaaattttaaagatgtacatatacaaagacagaaaaaagtagagagaacagcaatacacattttggaagctggaaaatagtgagctgaatgataagcagatatcaggcaaagccaagagtcaactgtatttacataaatttaaaatgctatctctaggacagtataccacagtctagcttctaaatgtgaatggactctggaaccaggctgcttaggttcaaaccgcagctcttccacttattagctgtgtttttagaaacgttacttaacctcttttactgtcc

SEQ ID NO: 34609 - DNA, 601 bp, Human
tcaattctccaacatgaacttaataattaggaatatttttcatggacattgtaaccatttataactatacaatatgacagtaggtgaatataacaaagttatcagacagttcccctattattaattctgtattttcactattataaacaattccacaatgcacatgttcatacatacaatgtggaatatgactgccttataataagattcccaataatgttcctagagcatgcttatattaaaaattgtttaaggtaaaaagaataaattaatgattcaaatataagacataagaaaaagmatagacttaaagaaataagggtgggccagaaatttaaaatatagacaaaaagaggtaacagagagaactaaaagcaaattcattgaaaaaaaagacttaacgaagtaagaagctttttatataagttatttttaagaagaaaaaaaagcaaaacattaaaaatattaggaaagagacaaatacagacaaaagacagattagaaataatactataaagaacactatattctttacatttaaaaactcagattagatgattttctagaaaaataaaatttaagaaaaattaattaagaaatt

SEQ ID NO: 34610 - DNA, 601 bp, Human
tgaaactatttttctgttccttttgaatcctggtccatatgaacccatttttttcataaccaccataatttcatattacatacctttcaattctccaacatgaacttaataattaggaatatttttcatggacattgtaaccatttataactatacaatatgacagtaggtgaatataacaaagttatcagacagttcccctattattaattctgtattttcactattataaacaattccacaatgcacatgttcatacatacaatgtggaatatgactgccttataataagattcccaawaatgttcctagagcatgcttatattaaaaattgtttaaggtaaaaagaataaattaatgattcaaatataagacataagaaaaagaatagacttaaagaaataagggtgggccagaaatttaaaatatagacaaaaagaggtaacagagagaactaaaagcaaattcattgaaaaaaaagacttaacgaagtaagaagctttttatataagttatttttaagaagaaaaaaaagcaaaacattaaaaatattaggaaagagacaaatacagacaaaagacagattagaaataatactata

SEQ ID NO: 34611 - DNA, 601 bp, Human
aatcaaaaccaaaacaaaataatcttcttattaaacaatgaaactatttttctgttccttttgaatcctggtccatatgaacccatttttttcataaccaccataatttcatattacatacctttcaattctccaacatgaacttaataattaggaatatttttcatggacattgtaaccatttataactatacaatatgacagtaggtgaatataacaaagttatcagacagttcccctattattaattctgtattttcactattataaacaattccacaatgcacatgttcatacatamaatgtggaatatgactgccttataataagattcccaataatgttcctagagcatgcttatattaaaaattgtttaaggtaaaaagaataaattaatgattcaaatataagacataagaaaaagaatagacttaaagaaataagggtgggccagaaatttaaaatatagacaaaaagaggtaacagagagaactaaaagcaaattcattgaaaaaaaagacttaacgaagtaagaagctttttatataagttatttttaagaagaaaaaaaagcaaaacattaaaaatattaggaaagaga

SEQ ID NO: 34612 - DNA, 601 bp, Human
cagaaaagaaaaattcaattttactggaatatttcaacatttttcttagttattgaacataccacaatagtatcaaaaattgcattaatcttgttgaaaaaagattaaaaatttataacatgaaaaatataaagtataaaatttagccttttaaaatggtcaagaaatatttttttctatagtaccttaatttctggttagaaaaggtacctaggagtatttaaataggatacacaaaacaaagggaacatgaaatctctgagactccaactgagtagaatttatacgtttccttcattatttttttgatagccccttatattattacatatttttctgtgcatacctttttcagctacaatgcaaggtacggtttccaaactacctggctctttttgtcatttaaacagaatttgcaccagaaagcacaatctataggctgtcctttccatttttcatcataatataaatgaaaagtcaagcaggcatgtaaacttcaaatgtaaccctcaagtaaggcactttccagacatatattacctgatcaattccccttcctttgcactgaagaatgatgacttccagaagtttagctgcatga

SEQ ID NO: 34613 - DNA, 601 bp, Human
ggcgagtgactgttaatgagttttttgggagaggggtaatgacatgttctaaaattgtgtaacagttgcacaattctttgaatacactaaaaaccatgtatgtatacactttaaatggatgaaatgtatggaacgtgaattagatctcaaaactattataagaaatacataaagcaaaacttacagaaaagaaaaattcaattttactggaatatttcaacatttttcttagttattgaacataccacaatagtatcaaaaattgcattaatcttgttgaaaaaagattaaaaatttatarcatgaaaaatataaagtataaaatttagccttttaaaatggtcaagaaatatttttttctatagtaccttaatttctggttagaaaaggtacctaggagtatttaaataggatacacaaaacaaagggaacatgaaatctctgagactccaactgagtagaatttatacgtttccttcattatttttttgatagccccttatattattacatatttttctgtgcatacctttttcagctacaatgcaaggtacggtttccaaactacctggctctttttgtcatttaaacagaatttgca

SEQ ID NO: 34614 - DNA, 601 bp, Human
taagcaaacatctcaaatcaataatctaacctgttactttaaaacattggaaaaagaacaactaaacaaaaagcaagcagacgggaaaaaataaggattagagtggaaactaatgaaatggaaaacaaaaatagagaacaaaaccaaaagttagctctttgaaaaaatcaaaattgataaacttttagtcaactaagaaaaaaagagagaagactctaattactaaacccaggaacaaaacagggtcattactatggaacctacagatacaaaaagacataaggaaatactatgaaccacrtgcaatgaattagataaattacgttgaaaaattccaagatgcaaactactgaaatgaatttaaaaagaaatgtaaactacgaataaatctataacaaataaagagactgaattggccatttaaaactacccaccgaaaacaaaacaaaacaaaacacagacaaaaataggcccagatagtttcactgctaaattctaccaaacatttaaaaaagaagagcaattcttcacaactctttgaacaaagagaaaggatgaacgcttcccaactcattcaatgagtccaacaatactctgatac

SEQ ID NO: 34615 - DNA, 601 bp, Human
ctgtgcctcctagtaaaattacacaccatcacccatgaagtgcatgagccgagatcatgccatttgcactctagcctggtgagtcaaacctgaatccaagacaacactaaatgtaatcactaatttacaggaaatttagaggaatggaatgccaatcaatacagtccttcagctgtacttgagtgcattgtaatggtaacctcactaacagtagagatcaccttgtgtccttaactttctgatacacaaattcttgaatactactatggtctcgatatggtttgtcctcctgaaactcatrttgaaatttgatccccagtgtggcaggttttgggaggtggggcctagtgggaagtgtttgagtcatggtagtggtcgaccccttatgaatgccttggggccattctcctgttgtgatgtaatgagcgacttctcactatcattctggcacaactgaattactttttgtgggaatgaactagttcccatgagagtaggttgttataaagcaaggacacccctgggttttgccccttcgcatacatccacttcccctttgaccttccaccacgttgtggtacagcacaggccatagcttgcc

SEQ ID NO: 34616 - DNA, 601 bp, Human
aaatgggactgaaaataattatgatgtaatcagattgtttttgagaaagaaaattcctgttaatataagatgaaaaaggctaaagaaaaaatggtggagcctgaacattaaaataaaatctgactccaattctaaggtgcaatattgatgaactaattttactagaactatttcccaatagttattttcagttaaaggggatgagctgaaatgatttctataaaataaaatctgaggtcttactataagcccctttttaaattaaacttttaaaaaaatcaaggttttgtgtagaaagttaagttatatttattattttctttttagtaggccaaattggatatatatttgggtcagcagactattagtctggtttaggataacatattaaatcaaaatacatgactacacatacttttaagaccataaagctctctacaaagatgagataactagtttaactctacgtctacttatgctgatacaacatattctgtgttctaatttgagataacacatataagctatgttaaaaattattaccatggtcaaataattagttgtggataaacgcagccacaagaaaatataaattaagttt

SEQ ID NO: 34617 - DNA, 601 bp, Human
gtgacctgaggtgggcacataacactagttggaatctcactcttcctatttttttgagatggagtctcactctgtcgcccaggctggagtgcagtggcacgatctcagctcactgcaagctccgcctcccaggttcatgccattctcctgcctcagcctcccgagtagctgggactacaggtgcccaccaccacgccctgctagcttttttgtgtgcttttttagtagagatggggtttcaccgtgttagccagaatggtctcgatctcctgacctcgtgatccacccgcctcggcctccyaaagtgctgggattacagatgggagccaccgcgcccggcctcactcttcctatttttgaaaactaggaagagtgcttcacataaaaccaaattctcctactggggcagcacctgggctacaaataacaagccttctgactccacttttgagaacaggcatccctgagatctgcaaagagttaaacattctgtgacattacattttatctttgccagaggggtaccatccttagaaatccaactccatttagaatgtttttacccactgacacttaatcatggaacccagacagacaacta

SEQ ID NO: 34618 - DNA, 601 bp, Human
tcctaatgtgtaacagcatctattaggctccataaaaaaaaccgctgagtatattaggtgtcagaaggtgcataaatctaaatttatatagcatgatacaattaatagcaagtcaaccaagcccaaaatatttgttatatgtgtagcaggccgaagaatgtaaatctgtttaatgtctccatatagactagtattcatataaaatgcatacacaaatcaaaatcaattgtaacattaatttcaattagaagactttaccattttcttccatatcagctttctctgcttttgaacgatcttcccggtttaccagttgtctagtagcacagacctgctttaggccaaggaaaaggaaaagaattgagggaacaatctgtcccaccacagcatctactgcaggaggtcgattttgcaattccaaaaggatactcagtcctattatacacatcttccggtcatgatgcctgcaaattttgaagaaaaaaaaaatgtagacatgagaagtggaataaagaacaaattctggagaaactacaaaaagaaatgtccaaggcatactctaaggttcatctgttggtatcatacagagacattccctgtt

SEQ ID NO: 34619 - DNA, 601 bp, Human
caaaagacctacacagatttcagaaaaacaaattagaagctgtattttgtgctgtggaggggagaaaaagggtagtttataatctctggtatatgaacaaactgggatgatgccagttaaaagtgttttaaatctatccatgctaaaatcacagaatttagcatcaaaaatagagctgtatgtttaccaggaagagttctgatttttctcagctaacaaagtatctgtttttaaccaggagaggaaaaaatccacctggaataggagaatgctacttcctagtctctagcaagtagctccrcaatctcatcattaaacaaaacaaaggtctaatattcaactctaacaatcttattctgattctcaagtatatccacttcatttatgtactttaccttaatttatatttaaatcacaaatatggacgtctctcaaatgtaatttttgctaatgagtcacctaagaaccattccagaaaaagaaaaaaaagacactctctactaatctgtggtactaacacttcagctcttaatgtaatgattcatttaactcatggctactgccttgatgaggctgttagcacaaacaagaaagttagata

SEQ ID NO: 34620 - DNA, 601 bp, Human
atccagccatcccacttcaggatatatatctaaaatattttaaatcaatacgtagaacagatgtcagcagccctgtgttcatcgcagcattattcacaatagccaagttacagaatcaacctaagtgtccatcaacaacggatgaataaagaaaatgtggattctttaaaatgaaacactattcagcttttaaaaaggtaattctgtcaattccaacaacactgatgaacttggacattatgataagcgaaataagccaggcacagaaagacacatactgcctgttctcacttatacatakaatctaaaacaatcaaactcatagaagtagagaatagaatggtggttaccagaggctagaggtggtgggaatatgggaatgttggtaaaagggtacaaagtctcaggaagaattaggtttttgttttgttttgttttgttttggtatctattgtacagcatggtgaatacagttaatagtatatgtacatttcaaaattggcaagattgtaaatttcaaatgttcccaccattaaaaagggtatttaaggtgatggatatattagtttgatttaatcattccgcattatattcacaaatc

SEQ ID NO: 34621 - DNA, 601 bp, Human
ttagaaatgcccaaatgagatcatttctgctagtagaaacagtaaaaatacagatccagccatcccacttcaggatatatatctaaaatattttaaatcaatacgtagaacagatgtcagcagccctgtgttcatcgcagcattattcacaatagccaagttacagaatcaacctaagtgtccatcaacaacggatgaataaagaaaatgtggattctttaaaatgaaacactattcagcttttaaaaaggtaattctgtcaattccaacaacactgatgaacttggacattatgataagygaaataagccaggcacagaaagacacatactgcctgttctcacttatacatagaatctaaaacaatcaaactcatagaagtagagaatagaatggtggttaccagaggctagaggtggtgggaatatgggaatgttggtaaaagggtacaaagtctcaggaagaattaggtttttgttttgttttgttttgttttggtatctattgtacagcatggtgaatacagttaatagtatatgtacatttcaaaattggcaagattgtaaatttcaaatgttcccaccattaaaaagggtattta

SEQ ID NO: 34622 - DNA, 601 bp, Human
actaaattacaatgtaactatggaaatactatctaaccataaaacaaataatctatattaatgagatttaaaataatttatttgattaataattttctaaatatcctcattggcttgtttttattctgtaaattttccatttccattttctactaggttactggtcttatgtatctgaggatggcctctgtacactgtgtacattatgcctattatgcatatgtggcaaatattttctccccccgaatcatttatgagtcctgtaactgtaattatactgttctttgttgtataaaattgscaaattacttacaaagtaaaaagtcaccctcttacggcagcaatttcattctagggattgtgaataactagtaggttgttagccacaatttttaagcaatgtatgcctgaaacacttcattctttgctataaaaatgcttgcccatttatgcctaaaggatgaacaatatacacagatactccacatattacttttgcaaggataacatacaggctcaccctgctacttctcaatgatgaaagctgctaggattgggtgataggtgtttcattattttaatttctatcatttcatgtatg

SEQ ID NO: 34623 - DNA, 601 bp, Human
tatccgcataaatccattgattctgcatggcagaaacctgagacgtgcaagtctatccaatcctctaaaacaaccttgggcattcagcctttggaacatatgggttgtccttttccgtccaatgattgtttttctttcatttcatacttacagtagctgtttaaaatatatatttcagggtgacaaaggtcaaaggggaaagagtagataaaagtgctgcctaatgccagatggtaactggcacagcaggagggccctaaaagcagcccctcatttcatccccttgaccctcacactcctyttgtgaaataaaatgcagcgatgacatttggtcagctgatgttctttccttcagttgttgctgggcacagtcccaaaattaaatgcggagaggactcctttgttttcaaaggtgaagcctccctgttgttcaatcttcttctttgcctctagcatttttcaaaagaaaaggggagaagaaaaaaaaagaatgcttaaggtgacaaagttggagatgactcaaaggagccagattctttatatgcttagaactgtgaaagaatgtgactggtagtattagttatcctgccaaagaataact

SEQ ID NO: 34624 - DNA, 601 bp, Human
atgggggacctagttttatctcatttaccacaatgttttcaatcattttttggatgacataatttttagcctcttctctaaatgcttcctcaagctttccttgccttccagccactgcaaatgacttgcagtttcccctacatggcacctgacccttgtgcctccctccctctgcccatggcccagaaagccctttcctgtgccctctggcttcctgataaactcctatcatcttcaagagccagttcccatgccagctctccccaagtgctccactgaggcttccgtaacacctctgttyccacatcgggttgactgtctttgttttgtcattgcttgctctggctgtgtctccctcattagactgggatgccttcaaggtagggaccctatctgggtcagcttggcaccccaaagcgtaccacagcacctgattctgaggaggctctcagtagatatctgttgagtaaccagaatgtagggtggtcctgatggtttctgacattgaatagaaaacagctccctatttgatcttaaaataatcactataacctggacatactgtactagatgctgtttttgtctgacttctactctgtca

SEQ ID NO: 34625 - DNA, 601 bp, Human
aatggagcagcctactatatctacatatacaactatgggggacctagttttatctcatttaccacaatgttttcaatcattttttggatgacataatttttagcctcttctctaaatgcttcctcaagctttccttgccttccagccactgcaaatgacttgcagtttcccctacatggcacctgacccttgtgcctccctccctctgcccatggcccagaaagccctttcctgtgccctctggcttcctgataaactcctatcatcttcaagagccagttcccatgccagctctccccargtgctccactgaggcttccgtaacacctctgttcccacatcgggttgactgtctttgttttgtcattgcttgctctggctgtgtctccctcattagactgggatgccttcaaggtagggaccctatctgggtcagcttggcaccccaaagcgtaccacagcacctgattctgaggaggctctcagtagatatctgttgagtaaccagaatgtagggtggtcctgatggtttctgacattgaatagaaaacagctccctatttgatcttaaaataatcactataacctggacatactgtac

SEQ ID NO: 34626 - DNA, 601 bp, Human
ccagcccctcccacatttcactcaggactgagtaaaggagacactcagatgctactcagatgctggcttcagctaagtattttgcaaagcctctcgtgttcttacaagtttgtggctatcatgacaaaatggagcagcctactatatctacatatacaactatgggggacctagttttatctcatttaccacaatgttttcaatcattttttggatgacataatttttagcctcttctctaaatgcttcctcaagctttccttgccttccagccactgcaaatgacttgcagtttcccctrcatggcacctgacccttgtgcctccctccctctgcccatggcccagaaagccctttcctgtgccctctggcttcctgataaactcctatcatcttcaagagccagttcccatgccagctctccccaagtgctccactgaggcttccgtaacacctctgttcccacatcgggttgactgtctttgttttgtcattgcttgctctggctgtgtctccctcattagactgggatgccttcaaggtagggaccctatctgggtcagcttggcaccccaaagcgtaccacagcacctgattctga

SEQ ID NO: 34627 - DNA, 601 bp, Human
tatggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtayttttagtacagatggggtttcgccatgttggccaggctggtcttgaatccctgacctcaagtgatccgcccgcctcggcctcccaaagtgctgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagc

SEQ ID NO: 34628 - DNA, 601 bp, Human
tttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtacttttagtacagatggggtttcgccatgttggccaggctggtcttgaatccctgacctcaagtgatccgcccgcctcggcctcccaaagtrctgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgc

SEQ ID NO: 34629 - DNA, 601 bp, Human
gtgctgggattacaggcgtgagctgccgcccctgccccagcctcaccccctgttttttttttctattacagttgaacaaggcctgacaattcccttttttcatcacagtccctggccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgaycctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggt

SEQ ID NO: 34630 - DNA, 601 bp, Human
tagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcagtttcatcattgctggtgtggctgtaggcatcttcctgtgcacaggtggacggcgatgttaattactctccagccccstcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaag

SEQ ID NO: 34631 - DNA, 601 bp, Human
gccgaggacacccccgggaacccaagcagagaaaaatcgccttctaagcacagaggccccctgcacctcctgtgtgcaaagcctcgagacaagggctctacatgagtcacctccttttgttctgacagtaaccccccagggtaggtacgatcataacccccctcttcagatgaggaatgcgaggttcaaggttcagcaaagttaagtgacttccccaaggccacacagcagggaagccagaacaggcctgagcccccctcggaaccctgcttcggagctggcagagtcgtgctggggcggygcgggcccccagtaggactctaggagctcatcctgaggctccctccctcccccgggctccgcagtcccctcaacccctcagcagggctgggagcttgctccggcctcccccagcaggaagctcagagcagccactgtccccaggcttcccccaccagcttgcccagcccagtccctgtcctgtgccaaacaccctgcctcactcaaactcccctcccaccaaccacaggcggacgaggggctgccctgtcctttcctcaaagcctggggcaggtgtcgctgtgccagaccaggacacagt

SEQ ID NO: 34632 - DNA, 601 bp, Human
cctgggtgacagagcaagacttcatctcacacacacaaaaaaagtgtttcctcagagaggaagggactgaactaagccctgcagaggctcctgcggccgaggacacccccgggaacccaagcagagaaaaatcgccttctaagcacagaggccccctgcacctcctgtgtgcaaagcctcgagacaagggctctacatgagtcacctccttttgttctgacagtaaccccccagggtaggtacgatcataacccccctcttcagatgaggaatgcgaggttcaaggttcagcaaagttaastgacttccccaaggccacacagcagggaagccagaacaggcctgagcccccctcggaaccctgcttcggagctggcagagtcgtgctggggcggcgcgggcccccagtaggactctaggagctcatcctgaggctccctccctcccccgggctccgcagtcccctcaacccctcagcagggctgggagcttgctccggcctcccccagcaggaagctcagagcagccactgtccccaggcttcccccaccagcttgcccagcccagtccctgtcctgtgccaaacaccctgcctcactca

SEQ ID NO: 34633 - DNA, 601 bp, Human
ctgcttaggggttggatcgtgcactgatacttctctcagctgtgaaagacacggggtacaaacccccgcccagcaggcggtgctgagcaggcgctgtgtcccgccgcccaccaccggcccctggtcctcaggccagacagatggacggacggaggctgccccaggccagcgggaggctgtggctctctagaactctgcagcccacagtgtggctgggggagaaaggtataccctgggggtggaagaaagtcgaagttgatgtcctcaaggggacaaagggccatctgcaccagccacgtgwggccaccgcacttcccccgcggtgtcccgtacatagttcagagctttctgaaagctggtgggaaagtctagactcactttacaagcggttcctggatgggcgggtggctcacgcctgtaatcccaggactttgggaggccaaggcgggcagatcacctgaggtcaggagttcaagaccagcctggccaccatggtgaaatcccgtctctattaacaatacaaaaatcagccagacgtggtggcagctgcctgtaatcccagctactcgggaggctgaggcgggagaatcacccgaaccag

SEQ ID NO: 34634 - DNA, 601 bp, Human
ggccagagccctgaggaaacctggcccctcccctctcagaatcttccaggaattcgcccgatggctggagtgagaagcctgtggtgctgaagtgtgcagtgaattaggaaaacctgaaaatgcttaaatagccaccagtagaaagagggaaagtaaattagggtccatttcacagacagctggggcgcggggaaagaacaggacaggtccacactcatctcctgtgaaggacatgtgtatgatttctagcagcagccaagacacacctgcaattccaaagctagctgcctgcaggaggctygggccacatctgaaagggacattggttccctctggtagtgacattggccagttccatcttttatttacttttttatttttgagacagggtctcactctgtcacccagactggagtgcagtggtgtgatctcagctcactgcaacctctgcctcccgggttcaagcaattctcctgcctcagcctcctgagtagctgggattacaggtgcctgccaccaggcctggctagtttttgtatttttagtagagacggggtttcaccatgttggccaggctggtctcgaactcctgacctcaggt

SEQ ID NO: 34635 - DNA, 601 bp, Human
ctccccagccctggcactctgcccttccatgtgtgagcccaggcctgcggcagcaccacctcaggctgatggggcaatgctcatgaccccctgttgcagatggggaaactgagtcaaggggggcctaatggttaattctggtgatgagtccagccgtccgtccctggacttggaagcctggggcctcctcagatctgccttcctcagccaactctagatatctcctctccaggccgcgccggccaccgtcccctcccacccagaaggcacacccgggctggtagcacccgcacactcaggrgaactgcagggctgttttgcctccacactcatttgcgcaatccagcttcccggacccctgtgacgctccaagaagacgaggaggcaaaagccggcagttcaccaacaggaaacacagaactgtctggtgctagcaagacggccgtgtcgccaatcaaagaagcgcaaatggaaacaagagactgtcctcatccttccccctggcacagattaaaacgcctgataacaggaggtgccagccagggtgttgggaacaggcccagcggctggcaggagtgaggagtcgcacagacaagatact

SEQ ID NO: 34636 - DNA, 601 bp, Human
aacccctgtcccctccccagccctggcactctgcccttccatgtgtgagcccaggcctgcggcagcaccacctcaggctgatggggcaatgctcatgaccccctgttgcagatggggaaactgagtcaaggggggcctaatggttaattctggtgatgagtccagccgtccgtccctggacttggaagcctggggcctcctcagatctgccttcctcagccaactctagatatctcctctccaggccgcgccggccaccgtcccctcccacccagaaggcacacccgggctggtagcaccygcacactcaggggaactgcagggctgttttgcctccacactcatttgcgcaatccagcttcccggacccctgtgacgctccaagaagacgaggaggcaaaagccggcagttcaccaacaggaaacacagaactgtctggtgctagcaagacggccgtgtcgccaatcaaagaagcgcaaatggaaacaagagactgtcctcatccttccccctggcacagattaaaacgcctgataacaggaggtgccagccagggtgttgggaacaggcccagcggctggcaggagtgaggagtcgcac

SEQ ID NO: 34637 - DNA, 601 bp, Human
cacagggacgggcctcctgcagcctgcgcgggtcccgcacctcgaagcggagcccgtaaaagtacttgaagcttcgcacgaaccagccgatgatgctgcaggggaggccaccatgaacacgggtcccacagatcccgcagccgaggctggggcgggaaggcctgggggtggggtgtggaggaggctggggaggggccctcctggcacggggcaggagaccgggagacacaggggagggagcccctgaagcggacagagtcccgggcccggctcacccacctggacggctgccctgcctccrtctccccagcaacagaggaaaacccagagcctctggaactcggatgctaggagcatgggaaggcgcccacttccaaatccacatccagggcccacccagccctcatccaccccacaggggacccagccggaaaggaactggcactggctctcacgtccgctatgaaggacccacgtcggggagagcagcctctgcaccccagcagaggaaatggggccccacacaccctggggaaggtcactggcccctcaaggcagggccacatcaggaagaaagtgtcggcgccagtggagacctctg

SEQ ID NO: 34638 - DNA, 601 bp, Human
caggcacaggcagccctgtgtcctcgtccccgggacccagccccacacagccccagctcagccggccccactcaaaccccagaagccacccccgaggcccggcctacccatcatgtccaggatgctctggtggttggagacgatgacacagggacgggcctcctgcagcctgcgcgggtcccgcacctcgaagcggagcccgtaaaagtacttgaagcttcgcacgaaccagccgatgatgctgcaggggaggccaccatgaacacgggtcccacagatcccgcagccgaggctggggcgsgaaggcctgggggtggggtgtggaggaggctggggaggggccctcctggcacggggcaggagaccgggagacacaggggagggagcccctgaagcggacagagtcccgggcccggctcacccacctggacggctgccctgcctccatctccccagcaacagaggaaaacccagagcctctggaactcggatgctaggagcatgggaaggcgcccacttccaaatccacatccagggcccacccagccctcatccaccccacaggggacccagccggaaaggaactggcactggctctcac

SEQ ID NO: 34639 - DNA, 601 bp, Human
accaggtgcccacgttctgggaactggctggaaggggcaagaggtcatgagccccgcagcctgtgcccctgggctgcctgggttccatctaccctatgcgggcatcagcctggacacatgggctcagaggccgccctccaggcccccaagctgtgtgcacagctggggtccatccgtgtgaagtctcttggagcctcagttttctcatctgaaaaatgggcccagcaccacccatctcacagggccatgaggccatgaagcccacagctgggactccagcctgagtcactcattcgccacrtggtcaccgtgtggccacgccacgggtgccacccggaaatgggaacgatgaggggcccggggctccgtgactgtagggtcaggcggggcctacaccccgggtgcacacatgtgggggtacctgaagtgaagaacttcttcttggtgttgtagaaggaggagaaggaagagtacaccacggggacgatgggcacctgcaggcagggagacgcacagctgaggcagccctggggacaggccaggcacaccccaggctgcatgtggttggggagccctgtcctgcggcccacccacccctgcc

SEQ ID NO: 34640 - DNA, 601 bp, Human
ttgcagtaacgttgctgcagtaaaccccatggctgcctggccttcacgccgcattttcgacaagtctgcgctcccctgttactgcccccagaaagccccacttcctgatcagcccctacctcactgcctggcctctgccctccatacggggcgaggggctgtgggagagatggagctgggttcccccactgctctccaactttgaccccactgtcctgcctgggcaccaggtgcccacgttctgggaactggctggaaggggcaagaggtcatgagccccgcagcctgtgcccctgggctscctgggttccatctaccctatgcgggcatcagcctggacacatgggctcagaggccgccctccaggcccccaagctgtgtgcacagctggggtccatccgtgtgaagtctcttggagcctcagttttctcatctgaaaaatgggcccagcaccacccatctcacagggccatgaggccatgaagcccacagctgggactccagcctgagtcactcattcgccacgtggtcaccgtgtggccacgccacgggtgccacccggaaatgggaacgatgaggggcccggggctccgtgactgta

SEQ ID NO: 34641 - DNA, 601 bp, Human
ctcctctcccagagaccctgatgcagcttgtgggctggaccctggagcccagctgcaccctggtgggtcccaggcggctgagcagagggctcggacagtgtgcgtctggcctcggggtcctcccatctgctcctgggccatcgggggccttgtggctcagcccaccagcgggccacagccgcaagcctcatctttatcatcccagctcccagaggtgccgtgggcgcgagtccctgccctcgagcccggggagggtccagctgagccccctgcaggggacaccaggggcctgtgtctgagrccagtgacagaaggggcttcctgcttcccgggctgagtgagagctgggggagccggacagagtggtatttggaagccgggaggagtcccctctgcccatcctccagccatcggcttccacctgccctccccaggtcatgccctgccgtggtctgggctactgggccggctgcacgccagaccccgcagtggccccgttctcctggggggtcttggagatgtggaggaaggtggtcctcatggcccggtggcaggtgtccacgagcgcagggacgtccgccgcagtgaggccgctggtggg

SEQ ID NO: 34642 - DNA, 601 bp, Human
actcctggatagggaacacgggtgggtggcggtgcctgcaccctgggcctctaggcagggcagctgggaagacacagcgtcgcctccaccgccctggtcacctgcccgccctgtgagtgaccacagctccccagccacttccaagagtgtgtttataaaaaaacagcaacggagtacagtgctgaccccacagagtcttccaggccagcaggagcagcaggccccgattcccggctccctgtggcccagggtgcgtgagtctgggactcctggccctccaggcccctcctctcccagagascctgatgcagcttgtgggctggaccctggagcccagctgcaccctggtgggtcccaggcggctgagcagagggctcggacagtgtgcgtctggcctcggggtcctcccatctgctcctgggccatcgggggccttgtggctcagcccaccagcgggccacagccgcaagcctcatctttatcatcccagctcccagaggtgccgtgggcgcgagtccctgccctcgagcccggggagggtccagctgagccccctgcaggggacaccaggggcctgtgtctgagaccagtgacagaaggg

SEQ ID NO: 34643 - DNA, 601 bp, Human
ttcctctttttcttctttataccagctctatctgtggtcttattttttcttcctcccttttctcatttctccctatcacctaactctacttctctgttgtatttgttgtatctggtaactggtcagtagtactgtatttattctcttccttctctctgttggttttttctctgtctcagttatttattcttttagtttgtcccttttctctttccctctttaattttattccccgccgtctgtcttcctttatttatctccctaccctttcattccttttttttttttttttttttttttwggagacggactctcgccctgtcgcccaggctggaatgcaatggctggctgcagcctctgcctcccaggttcaagcgattctcctgtctcagcctcctgagtatctgagattacaggcgcgcacctccacgcccagctaatttttgtatttttagtagagatggagtttcaccatgttggccaggctggtctcgaactcctgaccttgtgatccgcccgcctcggcctcccaaagtgctgggattataggcgtgagccaccgctcccggccccatttctttccattatcaaatcaattgtc

SEQ ID NO: 34644 - DNA, 601 bp, Human
ggctggagtgcaatggtgtgaccttggctcaccgcaacctctgcctcctgggttcaagcgattctcctgcctcagcctcccgagtagctgggattataggcatgcaccaccatgcccgcctaatttttttgtatttttagtagagacgggggtttctccatgttggtcaggttggtctggaactcctgacttcaggtgatccatctgccttggctgcccaaagtattgggattacaggcgtgagccaccatgcccagccaagaggcacctctttatagacctttagagagggtttattgtrgggaagcaagagcaggtcagtggaagaaattaagtgataagaaaaaagtgtttgctcctaaaagaatatttaaagagtcaggacagcaaaaaaagtagtaataattccctctcttttgaagtttctaaaattagagtcatggtttttttctgttttttttttttttaaagtagtgcttaataaggttatttgaatacgtgcatgggtataggtcaaatttcagaaccaggggattatgaagacttcacatgttagataaagcaccataccttgcatatgtacaaggacatgctcactgct

SEQ ID NO: 34645 - DNA, 601 bp, Human
accatgcccagccaagaggcacctctttatagacctttagagagggtttattgtggggaagcaagagcaggtcagtggaagaaattaagtgataagaaaaaagtgtttgctcctaaaagaatatttaaagagtcaggacagcaaaaaaagtagtaataattccctctcttttgaagtttctaaaattagagtcatggtttttttctgttttttttttttttaaagtagtgcttaataaggttatttgaatacgtgcatgggtataggtcaaatttcagaaccaggggattatgaagacttyacatgttagataaagcaccataccttgcatatgtacaaggacatgctcactgctgagtatgtttgccaatttgtctaatatttcaacttttctcattcatttgtttaaaattttatctttgaaaagaaagggaggggcatatagatcttagctaaggtgttttttttgttttttttttttttttgagatggagttttgctctgtcgcccaggctagagtgcaatggcaccatctcagctcactgcaacctccgcctcctgggttcaagcaattctcctgcctcaaactcccgagtagctg

SEQ ID NO: 34646 - DNA, 601 bp, Human
tctttgaaaagaaagggaggggcatatagatcttagctaaggtgttttttttgttttttttttttttttgagatggagttttgctctgtcgcccaggctagagtgcaatggcaccatctcagctcactgcaacctccgcctcctgggttcaagcaattctcctgcctcaaactcccgagtagctgggactacaggcacacgccaccatgcccagctaatttttgtatttttagtggagatggggtttcaccatgttggccaggatggtctcaatctcttgaccttgtgatccacccgcctyggcctcccaaaatgctgggattacaagtgtgagccaccatgcccgaccagctaaggtgtcttagagttgagcctagtctaccgccatgccaccctgaatgcgcctgatctcagaagctaaatgagagtgggttgagcctaaatattactagaaagaatacaggaaaggatcataaaggaggaaatattactaggtaaaaaccattagagctggagacccagagtttggcaaaaataatttgagtgcaccatggatggttttgttttgctaaggtggatgcacaagttctggtaattcaca

SEQ ID NO: 34647 - DNA, 601 bp, Human
ttactgttttcctacttttcacgtcatgattctagcttaaattgttacaagaagaaattaaatgatatagtcaggctgtgcataaggacagggatactttctgaaaaatgcatcattaggtgatttgtcattgtgtgaacattgtagagtatgcgtacacagaattagatggtatagcctactacacacctaagctatatggtatagcctgttgctcctaggctatgaacctgtacagcatgttattgtactaaatactgtaggcaattgtaacataatggtaagtatttgtgtatctcarcatctctaaacatataaaagggtaatgcaatggctatgatgtcactggggctaggagtgtttcagctccattataatcttacaggatcactagcatacatttatacagtctgttgttgaccaaaacattgttatgcagcacatgactgtatttgaaaacttgcttattctttcaatgagaacttggctttagaaacgtttcaggattcttgcctaccttttaataacatcttagttgcaagtattgatagcttaaataattctaccagtggtcatcaaaggtagattataattgcttttt

SEQ ID NO: 34648 - DNA, 601 bp, Human
ctttcaatgagaacttggctttagaaacgtttcaggattcttgcctaccttttaataacatcttagttgcaagtattgatagcttaaataattctaccagtggtcatcaaaggtagattataattgctttttttcatctttcattcagaaagctctgaatcctctaactacatgtgcttatagagattttcataactgttgatctaagcttgcctctttacattagtgatagtatttggttttatagatcattaatgattcacttacattggtgccatctgctcatcagttttctagcctrgaatcagcaaagaatacagttttgaagcagtcttttaattatttccctgaacaaattaatttttttggaggtatttacaatttgtttttgatttagattaaaaaaaaaaaccccagacctccccagctcttctgtttactgaaagaaaacggaaaatattcttactcactatagttctctcaattttagttaatcaaacaccattctctaatgtcctgtcaaatggttaaacacgcatgacctattgagtttaattgtctgaggacttttggtatagtttggttttgatattatacagta

SEQ ID NO: 34649 - DNA, 601 bp, Human
tacatgtgcttatagagattttcataactgttgatctaagcttgcctctttacattagtgatagtatttggttttatagatcattaatgattcacttacattggtgccatctgctcatcagttttctagcctggaatcagcaaagaatacagttttgaagcagtcttttaattatttccctgaacaaattaatttttttggaggtatttacaatttgtttttgatttagattaaaaaaaaaaaccccagacctccccagctcttctgtttactgaaagaaaacggaaaatattcttactcrctatagttctctcaattttagttaatcaaacaccattctctaatgtcctgtcaaatggttaaacacgcatgacctattgagtttaattgtctgaggacttttggtatagtttggttttgatattatacagtacacagttgatttagtattacatttcaggaatttttctttaataagaacatttcctgttcctattgttttaattttttaaattggccttcacaatttaattctgtagaattaaacctacttttgtgtccgggcgcggttgctcacgcctgtaatcccagcactttggga

SEQ ID NO: 34650 - DNA, 601 bp, Human
ttctctcaattttagttaatcaaacaccattctctaatgtcctgtcaaatggttaaacacgcatgacctattgagtttaattgtctgaggacttttggtatagtttggttttgatattatacagtacacagttgatttagtattacatttcaggaatttttctttaataagaacatttcctgttcctattgttttaattttttaaattggccttcacaatttaattctgtagaattaaacctacttttgtgtccgggcgcggttgctcacgcctgtaatcccagcactttgggaggccgagacagacgaatcacctgaggtcaggagtttgagaccagcctggccaacatggtgaaaccccatctctactaaaaatacaaaaaattagctgggcgtagtggcgggcacctgtaatcccagctgttcaggaggctgaggcaggagaatcatttgaacccaggaggcggaagttgcagtgagccgagttcgcaccactgcactgcagcctgggtgacagagtaagactctgtctcaaaaaaacaaaacaaaacaaaacaaaacaaaaaaacctacttttgttaatatatatagactctatact

SEQ ID NO: 34651 - DNA, 601 bp, Human
ctatgttggattcatattttttcttattatttctttctttttttaagagacgggggtctcactctgtcactcaggctggtgtacagtggcactctgcagccttgacctcttgggttcaagtgatcctcctgcttcactcaagggtaggaggattagctaggactacaggcatgcaccaccatgcttagctaatttttaaaatattttgtaaagacgggtttctttatgttgcccaggctggtcttgaactcctggcctcaagcgaccttcctgccttggcctcccagagtgttgggattayaggtgtgagccaccatgcctggcttatcatttctatgatactgaagatctgattctgttttgccacttaataactagtaacaggtttaaaataggaactaatttagtctgttcatttgctatgcacatggttggcttcaccaagtaaaagtaaacgtgtcttttatttagttatctaaatgatctggatagaatatcccagtctaactacattccaactcagcaagatgttcttcggacgagagtgaagaccacaggcattgtagaaacacatttcaccttcaaagacctatacttcaag

SEQ ID NO: 34652 - DNA, 601 bp, Human
ctcagcctctcaaagtgctgggattgcaggtgtgagccaccgtgcccagcccaactgtgattgttttagagagagaaaattctagtattctaatacaaataactttctcattagcattagtaattcttttttttttgagatggagtcttgctctgttgccaggctggagtgcagtggtgcgatctcggctcgttgcaacctctgccttccgggttcaagtgattctcctgcctcagcctcctgagtagctgggagtacaggtgcgttgcaccacgcccggctaatttttttttttttttttgtacttttagtagagatgggcttttaccgtgttagccaggatggtctctatctcctgacctggtgatccgcccaccttggcctcccaaagtgctgggattacaggtgtgagccaccacacccagcaacattagtaattctaaaacaagcctcagcttgtctctgtgttaatggtcttttataaatattagaaatgtttattttggttcccattttcttcttttgtgacctttgagattaggagtaaacttttccccttcaatataccatgtgttctttagttatggcattatgcttatat

SEQ ID NO: 34653 - DNA, 601 bp, Human
gaaagacctttttgaggaaaaaataaagaggagtccgttaactatctgttatccagaatacacaggtaaggggttatgaaagattttattggaggtacacatcttacttagatcaacactttggtggcattcataaaactgcctttttttttttaatgattgattgggagagtattcagtggtagtggcattggcattaagcctgtgattaaaagcccctaagtcaagagtgccatatcagacacaattgagttttctgtgtttattttaaatttctatcttcattttttgaggaaaatayaaaaggagaaaaagtaaatttgggagctgggcatggtggctataattctagctacttggaagcttgaggcaggaggatcatttgagcccaagagtttgagatcagtctaggcaacatagtgacacccccctgcctcacaaaaaataaagtaaaatttggtatatgttgaagaaaatacaagggtaaattttaatcattgtgcccaagagactgacatgtagttgcagagagacataaataattttattatagtgtttaattgcacataaataattttattatagtgtaaaatatgcatta

SEQ ID NO: 34654 - DNA, 601 bp, Human
tacacatcttacttagatcaacactttggtggcattcataaaactgcctttttttttttaatgattgattgggagagtattcagtggtagtggcattggcattaagcctgtgattaaaagcccctaagtcaagagtgccatatcagacacaattgagttttctgtgtttattttaaatttctatcttcattttttgaggaaaatacaaaaggagaaaaagtaaatttgggagctgggcatggtggctataattctagctacttggaagcttgaggcaggaggatcatttgagcccaagagyttgagatcagtctaggcaacatagtgacacccccctgcctcacaaaaaataaagtaaaatttggtatatgttgaagaaaatacaagggtaaattttaatcattgtgcccaagagactgacatgtagttgcagagagacataaataattttattatagtgtttaattgcacataaataattttattatagtgtaaaatatgcattaatagaagtggaatagaagtggttacttctgatggggtcactgtagtctttttctagagctactaagaggatgaaatagaaatcatcaggcagacg

SEQ ID NO: 34655 - DNA, 601 bp, Human
gcagagagacataaataattttattatagtgtttaattgcacataaataattttattatagtgtaaaatatgcattaatagaagtggaatagaagtggttacttctgatggggtcactgtagtctttttctagagctactaagaggatgaaatagaaatcatcaggcagacgggaataaaagcattttagaaaagaggaattgcatatatgagaatatggaggtaggaaaatggtatgaccagttgtggaacccagaaggaatttggtattactagagtttacagtggcagggaagaagtrgttggagagatggtcagagatcaactcatggagggccttatatctcatgctgagacgatgatcagttaaaggtttaatatcctaccatgatccatatcatggggtgcatgatatagaagaaactgtgcttgagaaagattatgcaataaataataaagatagatagtaggggatttgaattagtaagaactcaggatggaaataaaaacttttgatggggattaagggatatatcatagaacccaagggcaagaatggacaggtcttagaatggaattagaactaggaaataattgtcag

SEQ ID NO: 34656 - DNA, 601 bp, Human
atatcctaccatgatccatatcatggggtgcatgatatagaagaaactgtgcttgagaaagattatgcaataaataataaagatagatagtaggggatttgaattagtaagaactcaggatggaaataaaaacttttgatggggattaagggatatatcatagaacccaagggcaagaatggacaggtcttagaatggaattagaactaggaaataattgtcaggaaccctggaagcactctttatccccatcttttttctctcctctctgtgtatcttttttattattctttctttcctwaccagctttctctgctattcagtttatgtgataacagcctagtcacagtttctgtatctctggtaaaaagatcagactaggctgggcgcggtggctcacgcctgtaatcccagcactttgggaggccgaggcgggtgaatcatgaggttaggagatcgagaccatcctggctaacacagtgaaaccccgtctccactaaaaatacaaaaaaaattagttgggcttggtggcaggcacctgtagtcccagctactcgggaggctgaggcaggagaatggcatgaacccgggaggcagagct

SEQ ID NO: 34657 - DNA, 601 bp, Human
ccaccgcacccagctccttttttcttaagctccgttttgttacctggtcttctttatatctttgttattgatatttttgttatgcttcacgttactgaaaatagcctgtagtttattggaataatgaattgtctttgttgcgtttccctggctttatagccagtttctaaggctactctaaaggttctataagtagacaagatggtgtaaaaagcaggtgatttaagggtattaattacaaatattgttgagacaggctttgcttttggttcctgtcacctttctttttgtaaaaaataakagcttcattgagatataattgggaaaccctaaaattcactcttttaaagtgtattgcttttccttatttaaattattaccttaaggctttgaagctaaacctctttaaaactgtggaatgattttgaaaagaacaatttaccttgttgaattccttttttttttgttttaatacaaacaatcccatagcgtttattgccatcttttagtaacataagggtaatcaaaacactatgaatgaatgttcatattggaaaaaggacatctaaaagcaaactgtatccttctcaacaatttctca

SEQ ID NO: 34658 - DNA, 601 bp, Human
accttgttgaattccttttttttttgttttaatacaaacaatcccatagcgtttattgccatcttttagtaacataagggtaatcaaaacactatgaatgaatgttcatattggaaaaaggacatctaaaagcaaactgtatccttctcaacaatttctcacttcattgatcctttctagttggagacactttgtagcagagtaatattatctccttttagcatgatccgacccagttgttttaaaaaatatggaacgcttcacgaatttgcgtgtcatccttgcgcggggactgtgctaatcttctctgtattgttccaattttagtacatgtgctaccaaagcaagcactaccctgttgaatttttattccaagatcactccaaggaacacagcctctctcagaccttttaagcagttgtgttccctagaaatgcaccttcctactttcctagtttccttttatactttctagatttttttagctgaaaagtctaaatgaaaaggtaaagagaaatttaacgttatgttttcctcaatctttgtgtttgatgattttattttgttaccatgagagtccactctcacgaagaacctaatt

SEQ ID NO: 34659 - DNA, 601 bp, Human
tctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaagrttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaa

SEQ ID NO: 34660 - DNA, 601 bp, Human
gttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagyttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattcagtaatataggatcctggaaatgagacctggtggaatattattttcaactgtagtctttctatactgtggactaatgaaatggtgttgttgataatctaaaataaccaataatccaaaaaagttcattttact

SEQ ID NO: 34661 - DNA, 601 bp, Human
atcttttgatgtgacttttcactagtttacaaaaaaaaggttggtggtcaacaaaaaaagcaagtcatagcagttcagtgcctttgttggtagtttttaactttttttgtgattctttttggaaaatcatagtttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattcwgtaatataggatcctggaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcaggtccccatttttctgcctctgtaccatttacatttgctctctgtttgttaacatgaagatcactcttatttcaccatcccaaataacttatct

SEQ ID NO: 34662 - DNA, 601 bp, Human
gtagagacagggtcaccctatgttgtccaaggtggtcctgaactcctcacctccagagatcctcctgccttggcctcccaaagcaccgagattacaggtgtgagctaccacacctggcccaagggtggcttttgggagaaagggctactcacggttcttctcctccttcagaggccggccattcttgtaccagatgacttgaggaatggggtacccgttcctccctacacaggtagcgacctaaagagcacagggtgtgagtctccctgcctccgagcccccttcaagccccatctcagcrgctgcgcaccagctgcccagcccacctgccacacatctcacctcctcaggctccttactgttcacagggatgcccagggggttgacctggatgtttggctcctccggagcttctacaagaaaatagaaatgagggggacatctggccacgtcccaccaccctcactaccctgctggcagacacagggtcacgcactgtagacgcggagctggatgcggtactcctgggaccgagggcgcttgccctggcacaagaagatgcgctcgtcttggggggtgacttgagtcagggccagagtag

SEQ ID NO: 34663 - DNA, 601 bp, Human
cgttgattctttattgtgggggctgtcctgtgccctataggatgttagcaacatccttggtctctctacctactagatggcagtagcaccccctctatgtgtgacaaccaaaaatatctccagacattgccaagtatctcctaggaggagggggtacaaaatcacccctggttaagaatgactgatttagataataaaacacagaagcctatatcattctagaaatatttctatatatgagcaaatacatagaaataggcttgaaagaacacaccctgatagcagagattatttctgggagggggggtctcaggcaagaagaaacttctagattttttgtcagtttaaattctcatgaaaatattttcaagtaccatttgtataatttttttaagttaaaagcttaatgaaaatataaggcagttcctgtgtagtaccatagggacagctctttttaagagatggggtctcgctctgtcacccaggccggagtgtggtggtgcaatcctagctcactgcagccttcatttcctgggctcatatgatcctcctgcctcagcctcccaagtatctgggaccacaggcacacaccaccatgcct

SEQ ID NO: 34664 - DNA, 601 bp, Human
ctctcagccactggaactcgaggtcctggctactctctgcctcacaggtcagggtgaggctgctgccttcctgtctctcaggggctgcgggactcactcggacgtcagacacatctgggggtacagcaatcatgtcacccagggcagggtggggccagttccctattgccccagcctggtccccctgtcctgggtccccagcccctcacagttcaccagtagttcctgtggttcactcagcagcgatatcatggtgtccaagtccaggccctgacattcatagcgcccactgtgttccttycgggcaggctccagcaccaggaccccgttgtcgttggttgtctcttcctctgcctccctggtgctggggttctagggaggattggggaggtgagcagagtgcacctcccgccactccacctgggtctctgcttgcatccccacctgcacccagcacaaagcccccacacctgcttgctgatgctgaagtgtggtggagggttgccatcagccaaacacctgatttccacgcggtccccttccttcagcattcccacgggctccacttccagccacactttttctgtcgggtctgcatagg

SEQ ID NO: 34665 - DNA, 601 bp, Human
tggcttctgaccaaagaaaaaatgtcacaggagactttgaagaggcagacaggagggtggtggcagcaacactgcagctgcttctggatgctgctggggtgctctccggagcgggtgtgaacagcgcacttcaacatgagcaggcgcctggctccggtgtgtcctcacttcagtggtgcacctggatggtggaagccagcctttggggcaggaaaccagctcagagaggctacccagctcagctgctggcaggagccaggtatttacagccataatgtgtgtaaagaaaaaacacgttctrcaagaaactctcctacccgctcgggagactggggctccttgcttgggatgagcttcactcaacgtggagatggtggtggactggtccctgaaaagcgggccttgcagggccaagtgaggtcctcaggtcctaacccagtggccctctgaaagggggtgtgcaggcgaggggagcaggaggcttctctctagtccctttggaggctttggctgagagaagagtgagcagggagctgggaatggtccaggcagggaagggagctgaagtgattcggggctaatgcctcagatcgatgtattt

SEQ ID NO: 34666 - DNA, 601 bp, Human
tgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagacttgagttcttgctcattcagggggttgggaggcaatactcgagttgccgtaggaccaaatgccaaggcccccttcctcatggcggtgagcctgagctgctgtctggagggcagttccaagtggcaggaaagcataggaaggggacayagctcctgctaacagcctgccaggcccttcgtgctgcgtcatcagggcagttttgctgctgaaaagtagggtgactgtctgctctggtagaacttgagccatttgctcagaagcagaggtaacccctgatctctgctgccaactggaaacggttttgtgtgccttttggttgtagtttcacaggcccccaggttcctgtggtacccatgatgaataaaaagcaatgtatgatttctgggacaattaagctttatttttcatatatatatatattttcatatatatatatacatacatata

SEQ ID NO: 34667 - DNA, 601 bp, Human
acctcacacaggaagccgcctcttctagtgggcaccgacggagcgagcgcgcgtctgcagcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagckggcgccgggaagcgaggagacgcccgcgggaggcccagctgctcggagcaactggcatggcccgagccatggccgccgcgtggccgctgctgctggtggcgctactggtgctgtcctggccacccccaggaaccggtgagtgacccccgcgcagtccggtggcccctgtctggctcccagctccgcatccaggccgggtactcgcccccttgggttcccgaagatgacggccccgcccggcgccacccaccccccatctctgccccggggttggaaggaacacggtgcgagggtgcgagg

SEQ ID NO: 34668 - DNA, 601 bp, Human
cgtggccgctgctgctggtggcgctactggtgctgtcctggccacccccaggaaccggtgagtgacccccgcgcagtccggtggcccctgtctggctcccagctccgcatccaggccgggtactcgcccccttgggttcccgaagatgacggccccgcccggcgccacccaccccccatctctgccccggggttggaaggaacacggtgcgagggtgcgagggcaggaccctcctcttggccacccggagagcggtcggagttgggtacagaaattcctcgaaattggcagcaacacgggkcgggcacaagaccctcctctgggcccctcggaaaggggatggagttgggtgaggaaatttcccaaaaaggcaagtgaatcccggaaaatcagcagatggtgacgcatgccggattaccttacccaggttcctgctcagcatacccaggccataacccagcagcgtgctggcaggctgggtctggacggaggggatggttgatgttggggaggaggacagtgggtgacacttgacaccattacccctctgacccccaatgtctgactccaggggcctggccattcattcattctttcattc

SEQ ID NO: 34669 - DNA, 601 bp, Human
gtaaatagataacatattttattatttatttatatattttgtgtatatatatatatatatatatatatatatatagtgcgtgtgtgcgtgtatgtgtgtgtgtgtatgagagagacaaggtcttgctttgttgcccaggctggagtgcagtggtacaatcccggctcattgcaaactcgacttcccaggctcaagcgatcctctcactgtggcttctggagtagctgggattataggtgctcacctggctaattttttttgtatttttggtagagacagggtttcgctatgctgcccaggytggttgcagccaagcacagtggctcatgcctgtaatcccaacactttgggaggctgtggtgggaggatcacttgagcttaggaattcaaaaccagcctgggcaatatggcaagaccccatctctacaaaaataattaactaaataaaaatttaaaaataaaaaagaatgcataggaccatgtttattagtgtcaataagcgctgtcacattttgaggacctactatgtgctagggcccttagcagaaagatttttatataggacctgggggattagaggtcagtctctgaccgcccaagt

SEQ ID NO: 34670 - DNA, 601 bp, Human
gcccaggctggttgcagccaagcacagtggctcatgcctgtaatcccaacactttgggaggctgtggtgggaggatcacttgagcttaggaattcaaaaccagcctgggcaatatggcaagaccccatctctacaaaaataattaactaaataaaaatttaaaaataaaaaagaatgcataggaccatgtttattagtgtcaataagcgctgtcacattttgaggacctactatgtgctagggcccttagcagaaagatttttatataggacctgggggattagaggtcagtctctgaccrcccaagttcaaatcccacctctgccactaaacctctgtatgacttggaggacactatactctgtgtcagtttccctgtctgtaaaatgatgttaacagtagtgcttgcctcaggggggctatttgaggattaaatgccaagatatatgtgaagcacccagaatagcccctgatctgtgtcagcaccctgtgagtgtccactgttctaagtctcattttacaaactaggaaaaagaatcagagaggttaagtaaccggcctgaagctccacagcagaaaactgaagggacccaaaactcct

SEQ ID NO: 34671 - DNA, 601 bp, Human
ggtggtgggagcctgtcatcccagctacgcggaaagctgaggcaggagaaccgcttgaaccccagaggcagagcttgcagtgagcagagatcgcgccactgcactccccctgggcgacagagagagactccgtctcaaaaaaaaaagagaagaaaagaaaaagttctggcgctatatagtagtaacggttgcacaatatcgtgaaatgtacatagtgccactgaactgtatgctttaaatgacttaaatggtaaatttagttttttaaccacaatatttaccacaattttttaaatcagtratgttgagattcagggaaatacggtaataatagaagaaatacggtaataaatagccaaagtgaaggagcacggccaagttgcagaccatcccagacgcccttaccctcctcgcctgccatggccccaactagtgccccagttccccctccccccacaccccacggtccaccggggatccagggccccagcgtgcaagtgcacgcccaggtgcccgggctcctggagcccctccctatctagtccaagaacgccccgggtctgacaccttctcttcggttctccgcaggggacgtcgtcgt

SEQ ID NO: 34672 - DNA, 601 bp, Human
catgagctccatgaagccttcctcttggaacttgagcaagaagtctctgtgcctcagtttcctcatctgtgggatagggatcaccatgaggattcaaaaaaactgaccctttttttttttttgagatagtttagttctgtcgcccaggctggagtgcagtggtgtgatcatagtaggtcctcactgcagcctggaactcctgggctcaagggatgttcctaccctccctgtagctggaattacaggaatgtgccaccatgcccaacttgttttctgttttgttttgttttgttttgttttsttttctttttaagcttatgtgccaagaactattccaagcctgtgcatgagaaactcatgaaatgtcaagggcttggaactgtgcctagcacacaacacccaaccaaaggcagctgttgtcactccagcaagcctgggattctgggtatcatggtttaggatgagggtaaaacagaaacagtgagtcaagttaaggagaaatcttcggtaaataatataggtaatgatggggaaggaagttccaggtttgggaatcaccaggatgatgattaagagatggtcaaggtggttttggagtcag

SEQ ID NO: 34673 - DNA, 601 bp, Human
gctccatgaagccttcctcttggaacttgagcaagaagtctctgtgcctcagtttcctcatctgtgggatagggatcaccatgaggattcaaaaaaactgaccctttttttttttttgagatagtttagttctgtcgcccaggctggagtgcagtggtgtgatcatagtaggtcctcactgcagcctggaactcctgggctcaagggatgttcctaccctccctgtagctggaattacaggaatgtgccaccatgcccaacttgttttctgttttgttttgttttgttttgttttgttttstttttaagcttatgtgccaagaactattccaagcctgtgcatgagaaactcatgaaatgtcaagggcttggaactgtgcctagcacacaacacccaaccaaaggcagctgttgtcactccagcaagcctgggattctgggtatcatggtttaggatgagggtaaaacagaaacagtgagtcaagttaaggagaaatcttcggtaaataatataggtaatgatggggaaggaagttccaggtttgggaatcaccaggatgatgattaagagatggtcaaggtggttttggagtcagacaga

SEQ ID NO: 34674 - DNA, 601 bp, Human
gggtatcatggtttaggatgagggtaaaacagaaacagtgagtcaagttaaggagaaatcttcggtaaataatataggtaatgatggggaaggaagttccaggtttgggaatcaccaggatgatgattaagagatggtcaaggtggttttggagtcagacagactttatgtgaaagcccagctctgctgcttacagctgtgtgaccatgggcaagtcacttcccttctcaacttcagggctcaggcttcctctcctccactgagccccagaccaggataaccccctttgggtttccccttyccagccctgccctctccgagtcatcactgcctaggaaagagtccgtctgcccccttggactgtgtacccatgagggcagaaccagggctattttggtcactgctgggctccagcactttccaccaaacaatatttattgagcgcttattatataccattctaagagctttacctgcatattctcattgcctgtgatcccatcactatcccctgtcaacagacaaggaaactgaggcacagacttgcccaagaccacacagctgctcagggacacagctgggatttaaaccatgccattct

SEQ ID NO: 34675 - DNA, 601 bp, Human
cctgccctctccgagtcatcactgcctaggaaagagtccgtctgcccccttggactgtgtacccatgagggcagaaccagggctattttggtcactgctgggctccagcactttccaccaaacaatatttattgagcgcttattatataccattctaagagctttacctgcatattctcattgcctgtgatcccatcactatcccctgtcaacagacaaggaaactgaggcacagacttgcccaagaccacacagctgctcagggacacagctgggatttaaaccatgccattctgtatcttttttttttttttttttttgaggcagaatctcactctgtcgcccaggctggagagcagtgacacaatctcagctcactgcaacctccgcctcccgagttcaagcaattctctggtctcagcctcccaagtaactgggattactggcgtgtgccaccataccctggctaatttttaatagagacagtttctccatgttggccaggctggtctcgaactcctgaccccaagtgatccacccacctcagccccccaaagttctgggattataggcgtgagccaccccgcccagcaaccatgcc

SEQ ID NO: 34676 - DNA, 601 bp, Human
gcctaggaaagagtccgtctgcccccttggactgtgtacccatgagggcagaaccagggctattttggtcactgctgggctccagcactttccaccaaacaatatttattgagcgcttattatataccattctaagagctttacctgcatattctcattgcctgtgatcccatcactatcccctgtcaacagacaaggaaactgaggcacagacttgcccaagaccacacagctgctcagggacacagctgggatttaaaccatgccattctgtatcttttttttttttttttttttgagrcagaatctcactctgtcgcccaggctggagagcagtgacacaatctcagctcactgcaacctccgcctcccgagttcaagcaattctctggtctcagcctcccaagtaactgggattactggcgtgtgccaccataccctggctaatttttaatagagacagtttctccatgttggccaggctggtctcgaactcctgaccccaagtgatccacccacctcagccccccaaagttctgggattataggcgtgagccaccccgcccagcaaccatgccatcctgtacccttaatgaatgcc

SEQ ID NO: 34677 - DNA, 601 bp, Human
ctccatgttggccaggctggtctcgaactcctgaccccaagtgatccacccacctcagccccccaaagttctgggattataggcgtgagccaccccgcccagcaaccatgccatcctgtacccttaatgaatgcccccttctgccacggaggggttcattgaatgacttgttgcttttgttcctcttcccagccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactgtgagtgtgcccaagtcagcgatggcaagaacccctgccgggctgcccccaccactgtctacactgactccccaaggcactgtaggcattgcttccatcatctgcaccggct

SEQ ID NO: 34678 - DNA, 601 bp, Human
gcgatggcaagaacccctgccgggctgcccccaccactgtctacactgactccccaaggcactgtaggcattgcttccatcatctgcaccggctcccctgactcctgtctacacgacccacccccattgtctgcaccagctcccctgggccgtaaacaacactgtccctattgtctacaccagtttacttgggccatagtcaatgctggtacccagactgtctgccctggctcctctagcggctgtctgcacggatacctgacactctgttgactcccttgagcacagtctacactgcccmtaaactgcctacacccatttccccaggcaagtatccacaatgaccctccccacattgctacactggttcttctggccacgatcaacactgcctcccttattgtctacacccactcccttgtccttttctttctttcctttttttttttttttttttgaaatagagtctcactctgttacccaggctgcagtacagtggcatgttctcggctcactgtaacctctgcctcccaaattcaggtggttctcctacctcagcctcccaaatagctgggattaaaggtgcacaccaccacacctg

SEQ ID NO: 34679 - DNA, 601 bp, Human
ctggctatgataacaactggtaccttggccagaatgaggccaccctgacctgcgatgctcgcagcaacccagagcccacaggctataattggagcacgtgagtcctgggtctcagggaggaggggctgggggtctggatttctagcactgagggaggaggggctgggggcctggactcctgggactgagggagaaggggctgggggcccggacccctgggtctgagggacgagaggctgggagcccggactcctgggtctgagggaagaggggctgggggtctggacccctgggactgagrgaggaggggctgggcctggacccctgggtctgagggaggaggggctggggggtctggacccctgggtctgagggaggagaagctgggagcctggacccctgggtctgaggcaggacagactggggcctggactcctggtctaagagaggagggagattcagaaaagagaaaaagaggaggttgacttcgggcccccagtggggggcatctctgttttgacatctctgttttgcggttgaggcgtttagcaggtggttgaatcctggctggtggatgcacctgctttttggggtgtgcctg

SEQ ID NO: 34680 - DNA, 601 bp, Human
cagaagacttcggtttaactctgagccaggctaggcccccagagggtactgagctgaggtatgggaactgacttagggttcacaggcgacctctggtggccatgtggggaacagacgagggggcgagggcagaaacggagcccagcgtggaggcggctgctgggggccgggatgcacagcgccagagcagggaggtaccgtggaagccctgaggagaggtgggattctggatggatcttaaggcggggccgacatgattggctaatgggttgggtgtgggcatgagaggaagggaagagtyggggggcctccagagttgctctccgcttatgctatagagggcgtgagggtttctgggcacgtagtgcgtgctcaatcactgtcactccggacctgcagcagaggccacctcctcacctttctgtctctcccaggaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtgaggaactccctgggt

SEQ ID NO: 34681 - DNA, 601 bp, Human
ttctcctaagccttctcacaaaaggaccagtggggccagctttactcccctgttaactccatacctatatcactggtaccgttgttcagctgcctggatacactccctccacacacacaggttgggatagatgtggaatccctctctctcagggactcaggcctttccaaatatattaggcagacctctatcaattgcaattgacagaaacacaaagtagtctaagcaaaaaaaaccaaacaaaacaggactttattgaaaattcaccttcaggtatggttagatccaggggctccaaccwtgtaacccaggaacttttattttatacatctcttgtctctgcttttcgttatactggctttattctcaggcaggctctgaagcaagatggccctcggcagggacaggctcacattctaccagaatggcaacagcaggagaaaaaacataccactttcagtaactgtagccatagtcccagggctggctctcattggcccagcttaggccacagcccacctatgaaccaatcatagcagccagggagaatggaatattctgattggccaggcctgtgtcaaagtcccattctgggcaccag

SEQ ID NO: 34682 - DNA, 601 bp, Human
aattaaatagactgaggcagtggagtggtggctccctaaggaaattcaagatgccatttcaagaatgagggataaaccccaagagtttccttacctaaatacctgtttccttctctttcagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgcmgtaattgagcacctactacgggctctgtgctgagtccttccagtgtgcctctcactgaatcctcaccccactgccatgaggtttcccccatttgactgatgagggtgcagagccagggagccttgttcactggttcattgattacatttacaaatattatttacagagtgggagaagagcgtatagggtcttaatgccatggtagggactttggaatttaattcaggtgatgtgggagtccctgccagatggatggagggtgaaataatgcttaagccctcagccttactccatctgcct

SEQ ID NO: 34683 - DNA, 601 bp, Human
tgtccccattgtcccttttacttatggctttttcttccttgaaggactgaggcttctttctcaagcctgtccagtttctctacacacaaagctcccctcagttccccattccactaatgactgtctacaaacagacatcctcaacccccccatcatgagtagtgttaatatgacaaaccaatgccaactgcagtggtcactgataaagggttatgctaagttccatctctaactccttagggaggtcaggatgtttttgaatgggatgagatcagcaataaatatcactgaacaacacaaracaacccctgaacttgactctgctttttctcaagtgaactcatatgcatgaggatagagtgagggcttcagggctggggttgtgggaggtatgtgtggggaaaacaatctcaccttggctcagagacaggaacatcaggcaggagatcagcatgaagcatgagttggtctgagccatgctgagcagcagtgaatctcttgcttaaggagcaaatcagcaatctctataggaaaacacagggaagagggtttgagagaatgagagcagagcacctattaccttccttatttcctcctctga

SEQ ID NO: 34684 - DNA, 601 bp, Human
gatgctgtcactgaccaccagcatctctgtgctgaatgatgggataaagtagattggaaagttttgggctgatgattggatagggaggggattagtctcatctcatatcagccactgaacacactggagagtggcagcttcccctcccttcgtgagcctcccttcccacactgctctcctcactcacatctgcataaacccaggtctcatgctcttcattaaagtagtagcagtgggagccttaggcactggtgccttctgggcagctgatctgggccttgggcaactcagcatgggcctyctgtcctgggaaaagagagacaattaagaaagaccctcagggcaaggtaaaggctaaaatatgaggtaggagcttctgaggattctttataggaatagaaggatcctataggtcacgaagcgattggtcacttctgcccttctgcatcttacctataggctctcaagatgtctttgctcaagacaagagcacacaatgaataggctcatgaaaagtgtccccattgtcccttttacttatggctttttcttccttgaaggactgaggcttctttctcaagcctgtccagtttctctacac

SEQ ID NO: 34685 - DNA, 601 bp, Human
tgggagacatattgagccctcccagaggatgtaacagaaaaaggacagcacagaaatgtccctgatgatgctgtcactgaccaccagcatctctgtgctgaatgatgggataaagtagattggaaagttttgggctgatgattggatagggaggggattagtctcatctcatatcagccactgaacacactggagagtggcagcttcccctcccttcgtgagcctcccttcccacactgctctcctcactcacatctgcataaacccaggtctcatgctcttcattaaagtagtagcagtrggagccttaggcactggtgccttctgggcagctgatctgggccttgggcaactcagcatgggcctcctgtcctgggaaaagagagacaattaagaaagaccctcagggcaaggtaaaggctaaaatatgaggtaggagcttctgaggattctttataggaatagaaggatcctataggtcacgaagcgattggtcacttctgcccttctgcatcttacctataggctctcaagatgtctttgctcaagacaagagcacacaatgaataggctcatgaaaagtgtccccattgtccctttt

SEQ ID NO: 34686 - DNA, 601 bp, Human
gcactcagtgaaggaggaaagtgtgggagacatattgagccctcccagaggatgtaacagaaaaaggacagcacagaaatgtccctgatgatgctgtcactgaccaccagcatctctgtgctgaatgatgggataaagtagattggaaagttttgggctgatgattggatagggaggggattagtctcatctcatatcagccactgaacacactggagagtggcagcttcccctcccttcgtgagcctcccttcccacactgctctcctcactcacatctgcataaacccaggtctcatgstcttcattaaagtagtagcagtgggagccttaggcactggtgccttctgggcagctgatctgggccttgggcaactcagcatgggcctcctgtcctgggaaaagagagacaattaagaaagaccctcagggcaaggtaaaggctaaaatatgaggtaggagcttctgaggattctttataggaatagaaggatcctataggtcacgaagcgattggtcacttctgcccttctgcatcttacctataggctctcaagatgtctttgctcaagacaagagcacacaatgaataggctcatga

SEQ ID NO: 34687 - DNA, 601 bp, Human
cagcctcctgagtattaaggactacaaacgtgcaccatcacactcagctaattttttttttttttttttttggtagagacaaggtcttggtatgtatgttcggcccaggctagtctcgaactcctggcctcaagcaatcttcctacctcaacctcccaaaggattacaggcatgagccactgtgccagccaaaggactgaatttgaaagactaattccccatttccatttgtttgtatgagaatcataactgcatgaaagattgaaacgggttttaagaagaagcataaacccttaattckcagcccagatctctagaaagaataagaggattccaacgtgttatttggtctgtggtcaatttgtcacccaatacagcagactaaagtcaatcaagaagcatttcctgagttcctactctcctcagcactgaccccgtaatgaggtagaaaacacagtttctctccaattgaaatttgacaattatgtgagaaaaggatctcaaaagagtcaaataagagaaattactccttggaagaaacctcacctgtggacctttctccagctgaaatttcagtaaaggcagagctgctggtatcttc

SEQ ID NO: 34688 - DNA, 601 bp, Human
tcattgtgctgaagagaaagaaagacaggggcagaggatcataaaaaaaaacacagatctatgttttgaggactgaatttctttcctttttttctttctttttttccttttctttctttctccttcctttctttctttcctccctttctttctttcttttttttttcctattgcccaggctaaagtgcaatgatatgattaaggcttactgcagcctcgaccttctgggctcaagtgatcctcccacctcagcctcctgagtattaaggactacaaacgtgcaccatcacactcagctaattttttttttttttttttttggtagagacaaggtcttggtatgtatgttcggcccaggctagtctcgaactcctggcctcaagcaatcttcctacctcaacctcccaaaggattacaggcatgagccactgtgccagccaaaggactgaatttgaaagactaattccccatttccatttgtttgtatgagaatcataactgcatgaaagattgaaacgggttttaagaagaagcataaacccttaattctcagcccagatctctagaaagaataagaggattccaacgtgttatttggtct

SEQ ID NO: 34689 - DNA, 601 bp, Human
tttcccatccagaatggcagaagtcagtttcccagccgtatctcagccctcctgtggctaatcagtagaaatttgctctttttattttatggatagaagttagggcttaattttcataagctctgcatcccaagcattggccatttgcttgggtacaggatgggatttctctactctctgctaggcatgtctcaatcttggagtataattgtgaactcagtatattccctgaggtggatgagctaaataaacatcatgccctgagaaatctgccatctgtaaatttccgcagtgggagatmaccccctggaagtttttatccttctgcactctacaccaagagtacaggctgggcccaaagcatctttaacctctcgtctggaaaccccaagggagggtgataaatcagaccagcctagaggaagaaacagatacagaaaaccacactcctgctctgacctctgtgtggcttctctaaggagcactcacatccagtgagtatgtggcccctgctcagaatgaatcctgggtatgtgccctccatcctccagagttcttaccttggagagcctccttgaaaaacgaacgccagctttcactg

SEQ ID NO: 34690 - DNA, 601 bp, Human
tacaaaaaattcaactacaaaattaataacaacacatgaagttcaaagtattgcataacctgacaaacatagttttcccattttaacagctagtcaataagattcgtttcccatccagaatggcagaagtcagtttcccagccgtatctcagccctcctgtggctaatcagtagaaatttgctctttttattttatggatagaagttagggcttaattttcataagctctgcatcccaagcattggccatttgcttgggtacaggatgggatttctctactctctgctaggcatgtctcartcttggagtataattgtgaactcagtatattccctgaggtggatgagctaaataaacatcatgccctgagaaatctgccatctgtaaatttccgcagtgggagatcaccccctggaagtttttatccttctgcactctacaccaagagtacaggctgggcccaaagcatctttaacctctcgtctggaaaccccaagggagggtgataaatcagaccagcctagaggaagaaacagatacagaaaaccacactcctgctctgacctctgtgtggcttctctaaggagcactcacatccag

SEQ ID NO: 34691 - DNA, 601 bp, Human
tattttgtgtctgtaattttgtcaaatagtttatctctggcatggcatgactgtcctttctctgatgcatgctttatgttcattctatgttttccagatctactagcaagagttttctccaagcatctgacagattctgtcactgggtgacagaaaaacccaagacagttgttctcattggcattgtgcttaaagtaacctggggagtttttcaaatgctattcctagtcccacttcacttctaagattctgactcagtaactatgagaagaggcttcagagtgtacttttaaaacaaacmccggccgatttaaatgctggtggaccatacaacaaattctgaaatacactgacctaagggaaaagatattctctactatgtgcagaaaaacttagtacatgctaccaaaactttttaaaaactatttatagaatatcatttttaaaagcacaaaatgcagaaaaaatgaaaatttataaaatttcaattgaaaaattacaaaaaattcaactacaaaattaataacaacacatgaagttcaaagtattgcataacctgacaaacatagttttcccattttaacagctagtcaataagatt

SEQ ID NO: 34692 - DNA, 601 bp, Human
ccaacagaatgataaaaatttttaaaactgacaatataaattgtgggcaaaaatgtggaacaactggaactctcataattgttttgggttttgttttttgttttgtttagtcacagtctccctctgtcacccaggctggagtgcagtggtgtgatcatggttttctgcagccttgatctcctgggctcaagtgatcatcccacctcagtctcctgagtagctgggactacaggcacctaataacacacccagctaattttttttttttttttggtagagatggggtctcactttgttgctygggctggtctcaaactcctggcctcaagtgatcctcctgccttagcctcccaaagtgctgggattacgagtgtgagtcatcatgcccagctctcgtaattgttcatggaagtgtaaattggtacaattttgggaagctgtttgctggtatctacgaaagctaaattgacatgactataccttatgactctacatttccattcctgagtgtatacccacaacagaaacgagggcttatgtacactaaagtacatgtacaccaatgtttattacaggtttagccatgatagcataaaacttt

SEQ ID NO: 34693 - DNA, 601 bp, Human
ctattagtgaagggcagtagtgacaataagataccactatacacccaacagaatgataaaaatttttaaaactgacaatataaattgtgggcaaaaatgtggaacaactggaactctcataattgttttgggttttgttttttgttttgtttagtcacagtctccctctgtcacccaggctggagtgcagtggtgtgatcatggttttctgcagccttgatctcctgggctcaagtgatcatcccacctcagtctcctgagtagctgggactacaggcacctaataacacacccagctaattttttttttttttttggtagagatggggtctcactttgttgctcgggctggtctcaaactcctggcctcaagtgatcctcctgccttagcctcccaaagtgctgggattacgagtgtgagtcatcatgcccagctctcgtaattgttcatggaagtgtaaattggtacaattttgggaagctgtttgctggtatctacgaaagctaaattgacatgactataccttatgactctacatttccattcctgagtgtatacccacaacagaaacgagggcttatgtacactaaagtacatgta

SEQ ID NO: 34694 - DNA, 601 bp, Human
tcatgccctgggctacatcttacatgggtctgtgtgtactgtgtacaaagaggggatgctcatgtgaggaatgtcacaatggagaatagtactacagatgtaagatccagggacattacaagggacttggtgagaagaggagggggctgcacatctaccatagcccataagaaaaatacatccttaccagctgagtgaggacaactaggacttgaataaatctgactgctatgggcataaatggcacaagaaagccgagggaatgggcagtacgtgatgaggtggaatgacctgagagagmttcataggacctggataatcagacttatcatgaagggcatgaatgtaaatgtttaactctctgccctgacaattaagtgtcagtttccacattcttcagttggggggaatcatacctacctccctggtggactaaatgagaagataaaatgaggtaacatacataaaatgcctagcatattggaatacttgatgcaaattggattcctgttcctattagtgaagggcagtagtgacaataagataccactatacacccaacagaatgataaaaatttttaaaactgacaatataaattgt

SEQ ID NO: 34695 - DNA, 601 bp, Human
caatgttcccagtttccaccaacaaattcaatttgacaaacatttattgaacacctctaggtgccctataccagttcctggggacacaaagctcagtgaccctgtgtccctgtctggggggagaagtgtgtggctcacagcccagtttccctgagagcagaggagcaggaagctcagtatttcttaggcaggccgtcaggtctgaagcggtcggggtctttgccactccggccccattcctcagctttctcgttggacttcgagtcctccaatacagtgctgctgtttccaaataaatagyagtctattaatccctgaagatagaccctggaacggctgcaacccaaagaaaggagacaggagattaatctcttgactcacctgctcacctgagacagctccacctgctaactccctcctcttctcccacccaagtaatgactgagaggaggctggaaaactcaaggaaaggggaagaaaactatcaatcttcttgggcaaaggcctaagtctactgatactttgcgctctgcaacagagtgctttccctttttttttttttttttttttttgagacagggtctcattctgttgcccaggc

SEQ ID NO: 34696 - DNA, 601 bp, Human
acgaaagatagaaataaatccaaatgatcatatgatattgttaataaagtaggtttaaacagaaatgaaatatccattcacaaaaatataggcatagctactttattcagggagtgaaagaaaagtgacaattgcacagatagtagaagctcatgccaggtgacagacagagacagaagacatcaaaataattctttgatggcacccaaagagaagctctgaaaggccggtacagctgaggacttcctttgctcagtctccacctggacagtggcagcatggcagcctcagaaaggaaacmttttgctgtcggggatcatcatgggcagatcacaggctaaggggaaagaagctccctgtgtatccctggatggctttgatgagaagatgcaggtggagctgtggaacgaggtgagccaattatccctatcctttcgtggtcctgatgaattccgaagctgttacttgctcttgggtggacactttggctggcagggtggggaaggtgtcaccagaggatatttctgctggcactgctgaggtgggcagggctgtggacactttggtggtgggcagggctcagggcacttcaggggtggac

SEQ ID NO: 34697 - DNA, 601 bp, Human
caggctaaggggaaagaagctccctgtgtatccctggatggctttgatgagaagatgcaggtggagctgtggaacgaggtgagccaattatccctatcctttcgtggtcctgatgaattccgaagctgttacttgctcttgggtggacactttggctggcagggtggggaaggtgtcaccagaggatatttctgctggcactgctgaggtgggcagggctgtggacactttggtggtgggcagggctcagggcacttcaggggtggacatggctctggacgctttggcaggcggcacacargaggtggctggcagggctgcttacattgctactgttgataagacatcctgctggagtctcagaatctgaaagaaattatataacagggttcacaggaagggactcctacaaagaaaagccaacgtttatgtaataccatgggctatttctccagtctccaaaaaattatttaaactcctaattcccttttcatgactctctggtttctcctttccactttagcaaattgctttatcaaccctgggaaatcctgtgttttctcatgcaatttttctaaagaaaatatctctgttataaaga

SEQ ID NO: 34698 - DNA, 601 bp, Human
tcttgggtggacactttggctggcagggtggggaaggtgtcaccagaggatatttctgctggcactgctgaggtgggcagggctgtggacactttggtggtgggcagggctcagggcacttcaggggtggacatggctctggacgctttggcaggcggcacacaggaggtggctggcagggctgcttacattgctactgttgataagacatcctgctggagtctcagaatctgaaagaaattatataacagggttcacaggaagggactcctacaaagaaaagccaacgtttatgtaataycatgggctatttctccagtctccaaaaaattatttaaactcctaattcccttttcatgactctctggtttctcctttccactttagcaaattgctttatcaaccctgggaaatcctgtgttttctcatgcaatttttctaaagaaaatatctctgttataaagaatcaagcatgaaaataaccacttcatgaaaggcagtcacaagttcagatactctgggcaatctcagaagctattcctatcatcattatctgttgtaaagccccagtgggctgatgggcaaagagcaaagggctgtt

SEQ ID NO: 34699 - DNA, 601 bp, Human
ctcaattagactttctttatttggaaataggaagccacaaaccatgcagattttgtaaggagaggagatgctctcggccgcgtgcacctggacgacctcgttgatcgttgctggactactctccaagccttgctgcagtttgcttctggcccccgatttgccattatgtgtccgcatgtgatttttaagaaaccaaggctccttgaatcttcttccgcacatgttacacccgtaagtgaaagaatctttgtgtgttctcatgtggatctcaacatcaaaagcgactctaaatgtctgcccrcatacctcacagctaaattcattttccttgcaattcttttccttgggaggttctgttcgcacttgacttttatcaagcggactgagatactctgcttcaacccgaagaactgctggttcacagagggtaggccggtgttgcattaagacatgtttattaaggtcttctgaatgtgtgaaggtctggctgcagaacatgcaatccaagggcatatacccctcgatttggatgacatttttttcttgtgtagctcggaatggaacaacagcggtccctttcattgacaaggcatcctccatc

SEQ ID NO: 34700 - DNA, 601 bp, Human
ttcagaaccaccttcccctcgatccacggctccattttcatccagaggggcggcgaggtcaggagaacacgtccccggctgcctcccgtccacagacatggtgggcgactccgcgccggccctccggtccttcttgtggaccctggagtgcaagaccagctggtggtaggttctgaaagctttgccgcactcggagcagtgagtgggcttctccttgctactgggtaacttgggatccgcgtccacggagggcgcttcgccgtgggagtgtttgcacttctctttctcttgcgagaggccwgcacaactgcccttatttgtttctccaagctccttctcggaactcgaatcgtcgttgtcggtgctcccttcttgccccgattccttcacttcttggcaaatggcaacttttcctttggtagccagctgccaagcctggaaggtggtgaacggatcgagctgagggatgcatctgacaggcttcttccccgtttcagggtgagattttggtctcaagttgaacaactgcaggaagtcctccctcgaggacggcattcctccttgtggagagtctgtctgcgcgctgctggtaccgaaagca

SEQ ID NO: 34701 - DNA, 601 bp, Human
ttttttaaaggactgtgatctttttacaaataggctgttgaaattgtccttgggaggtggaagacaggggtcaatgaaccattttgcaaacagggaaatagtagcaaagaaaggttaagcaactcataattggtcacaaaacaacgcagtggtagaaccagaactcaacgccaagctggggtgctcccacccacagccaggcattctgtcctgcctgatgatctagcccatgttttccacaccacctaccggtaactggccttttcatttctttcagggaactggggcatctcacagggcycctgcaacagtaccggcactagcagaaaccacttagctaactggagtctgtgtttaaagcctctttttatgatgccattaagacattagatttgtagtatgctaagtgctgggtttcctgtgtcccaggaaactcaaaaacattctaaagatttgatatacagactacagttctcacgtcaatcacatgatcagaaaaggaactggcactggctgaagagcaggtgaaggaagagtccaatcaatcgtgtgggcaaattcatcgtgggtctcatacacccagttttccgaagaattcaag

SEQ ID NO: 34702 - DNA, 601 bp, Human
gatctactatcacataggatttctcatcagttctttatcatccttactgtaatgaatatttgaaattatgaatgcctatcttcaatagaaaaattaacagcaacacttctaacttatttaatcttcctaacagccctagggaaatatgtattattctacttttacagcaaagaaaactaaaagcacaaaaaggttaaataacttgcccaagggtgcacagatagtaagtggaagagatgaaatttcaaatctacgcagcctcctacatcatgatgtcatagctcctttcacaatctcaagrctactaaatagattctcatttcattctcaatcataaagacataagatgcagcattttaaaatactgtagcttttaataagataagagtcaggacatagcagtcataaactaaacaaatgaactttgtccgggcgcggtggctcacgcctgtaatcccagcactatgggaggccaacactatgggaggccaaggtgagcggatcacttgaggtcaggagttcgaaaccagcctggccagcatggtgaaaccccatctctactaaaaatacagaaattagccgggtgtggtggcaggtacct

SEQ ID NO: 34703 - DNA, 601 bp, Human
taggctgggcgcggtggctcacacctgtaatcccagtactttgggaggccgaggccagtgcatcacctgaggtcaggagttcaagaccagcctggccaacatgctgaaaccctgtctctactaaaaatacaagaattagccgggcgtggtggcacgtgcctattaccccagctactcaggaggctgaggctggagaattgcttgaacccaggagaaggaggtttcagtgagccgagatcgtgccactgcactcaggctgggcaacaagagcaaaactccgtctcaaaaaaaaaaaaaaaaagaaagaaagaaaaaaaaaacccccgcaactccaggtggattggcactgactactgagcacaccatacatgtgcaaaggaagaaaaagggctgtgatgaagtgaggcaagctggggcctcaactggctgcatctggaatttcaacagcaagacaagaatggactagacagaccagtgttctcacccactgtttccatgatcactctcacaacagaaaaataaaattgacaagaaaaattactcaagaataaggctgggtatggtggctcgcgcctgtaatgctggcattctgggaggccga

SEQ ID NO: 34704 - DNA, 601 bp, Human
ccctaggctgggcgcggtggctcacacctgtaatcccagtactttgggaggccgaggccagtgcatcacctgaggtcaggagttcaagaccagcctggccaacatgctgaaaccctgtctctactaaaaatacaagaattagccgggcgtggtggcacgtgcctattaccccagctactcaggaggctgaggctggagaattgcttgaacccaggagaaggaggtttcagtgagccgagatcgtgccactgcactcaggctgggcaacaagagcaaaactccgtctcaaaaaaaaaaaaaraaagaaagaaagaaaaaaaaaacccccgcaactccaggtggattggcactgactactgagcacaccatacatgtgcaaaggaagaaaaagggctgtgatgaagtgaggcaagctggggcctcaactggctgcatctggaatttcaacagcaagacaagaatggactagacagaccagtgttctcacccactgtttccatgatcactctcacaacagaaaaataaaattgacaagaaaaattactcaagaataaggctgggtatggtggctcgcgcctgtaatgctggcattctgggaggc

SEQ ID NO: 34705 - DNA, 601 bp, Human
tacactgctgggcatggtggctcatgcttgtaatcccagcgctttgtgaggccaagacaggaggatcacctaaggtcaggagttcgagaccagcctgaccaacatggcgaaatgccgtctctactaaaaatacaaaaattaggctggcgtggcggtgggtgcctgcatccaaactactcgggaggctgaggtaggagaactgcttggacctgggaggcagagattgcagtgagctgagatcacaccattgcactccagcctgggcaacagagcaagactccatctcaaaaaaaaaaaaaawcatctcttcgttatttataatacctaatatgaagtaaatgctatgtaaatagttgttatactgtattatctagggaattacgacaaggaaaagaaaactgcagatgttcagtacagatgcgaccatccatttttcccccaaatattttagtcccgcagttggttgaatccactgaggcagaacccaaggatatggagggctgacaacatttaacagcaaaacggttcacaagactctttaatcggaagttcttttgctttctgctcttgccaggtcaagggtccacgtgtggtccttact

SEQ ID NO: 34706 - DNA, 601 bp, Human
aggtgcaaaccaacacacccagccaatttttgtatttttagtagagacggggtttcaccatgttgaccagtctggtctccaactcctggcctcaatcgagctgcccgcttcagcctcccaaagtactgggattacagatgtgagccaccacatccagcacctcccatatactttaaatcatctctacactgctgggcatggtggctcatgcttgtaatcccagcgctttgtgaggccaagacaggaggatcacctaaggtcaggagttcgagaccagcctgaccaacatggcgaaatgccrtctctactaaaaatacaaaaattaggctggcgtggcggtgggtgcctgcatccaaactactcgggaggctgaggtaggagaactgcttggacctgggaggcagagattgcagtgagctgagatcacaccattgcactccagcctgggcaacagagcaagactccatctcaaaaaaaaaaaaaatcatctcttcgttatttataatacctaatatgaagtaaatgctatgtaaatagttgttatactgtattatctagggaattacgacaaggaaaagaaaactgcagatgttcagtacag

SEQ ID NO: 34707 - DNA, 601 bp, Human
tgccaaggagaagatgtccctgggacactgagctacttttttacacatacaggtatgtgccagacacctgtacgaagtgacaccaccaggacacatttctatggggaaaaccccagtcatctatgaggttaacaatctacctatgggggaaataaggttggttttaaattaatacagttgtccctcagtatccagagggcactggctccaggaccacccgcccccaccaccccagccaacagataccaaaatccatggatgctcaggtccctaatataaaacagtgtcgtatctgcagtaytcatagtatctgtagtactattttttttttttttgagatggagtctcgctctgtcgcccaggctggagtgcaatggcacaatctcagctcaccgcaacctccacctcccaaggttcaagtgattctcttgcctcagcctctggagtagctgggattacaggcatgcgctaccacacccagctaattttgtatttttagcagagacgaggtttctccattgttggtcaggctgtttcccaaagtcctgggattacaggcgtgagccaccgcaactggccttgtagtactattaatttgcag

SEQ ID NO: 34708 - DNA, 601 bp, Human
ttgaaacgtatatgcatcatgaaccaaactatgtaaaagtgttgttttttgctttttttaaaatcatttaaaaggggatttgccagcataggcaacatggtgagacctcttctctactaaaaataaaaaattagctgggtatggtgacatgcacctttagtcccagctactcgggaggctgagacggaaggatggaaggattgcttgagtcccggaggtcgaggctgcagtgagccgtgattgcccccactgcactccagcctgggcaacagagtgtgaccctgtctcacagaggaggggraaaaaaaaagaggatctgacttgcaacacacagagccttttccccctttaagtaaagacaaagttttgattcatgtccattttaagcaccatggggggggaaatgaagatttttaaccaaaaggcagtaaaaattactatttcatcacaatttttataaaatctactggagtgtctgaaagcaattgttttttaatttgctatctctactgaaccaatcagcatcaagcaattcttgacagagtgttgtcaccacacagaatcctcagtttgaaactaacacaaactgaaatgtgcaaaa

SEQ ID NO: 34709 - DNA, 601 bp, Human
ccaagtctttgaacaagttcttaaactagaacgttgggcatagagcctggatctttgcagacctaggacaaaaaccaggctcctgcctctcacaggcagagcggggctttgagcaaactgcataatccatgcctcggtctcatctgaaaagcatgcacagtacctcctaatgctgggtcacaaactttttctgtaaagggccagacggtaaatagtttcagctttgcaggccacgtggtctgtcacaactgcccgacattgctgctgcagcaaggaggtagccacagacaatatgtaacasatgggcatgatcatgttccaataaaactttattgatgatgatgcatgaaaagctagtttgctcatcccttacctaagccctctgctgcaacagaattaaatgagatcctgataataaaacacttcattcaatgcctagcacaaagtaaatgctcagtaaattccagtcactatgactgttttcctattatcttcagtaatatccaaagatcctgaggactctaattttaaaacacctaaaaaatcaaaatccaacttaaaagcaattttgttacattatattagacaacttaatggttta

SEQ ID NO: 34710 - DNA, 601 bp, Human
acagcaagctctctgtaacactcattggattaggcaaagattgagtcaatcatcttgcaaatgtgttaatcttcaaaaataggctataaaagtgcaaaactatgaaaacaaaatctagattatgtacatatggctcagcttgtgaacaggaaaaaaggtcaatagtgtacactttcctgatacaaagcacttcattgcaatgccaacagactgatctcaaatgagttctcccttgtaacacaggagctaagacttctatcaaggaggacatcttacgttgcataatttaaaaaaaaaaaawtttttctaggattacccttgctctatggagaacagcgaggccagaaaaatgaacagtgcaaatttatttttgaaacagtttcttaataaaatattttgtggtcactaagcccatgtactaataaactcagccatggacagcatattaaagaacaaaagtttaaaatatctaggaagccagctggtggccatcttctctaaaacccaaattgcatgtgcactgagaaaaatgttactgcttcaaaacaaccaaaaatgggaaaataactgaggtctagaaacagattttctctttctagac

SEQ ID NO: 34711 - DNA, 601 bp, Human
tcagacctaaaggcttgagtcattcttgatgcctctttcctgtgtaaaccaaaaagtgtctgagacaggtctcaattgctttaggaatttagctaatgttaaggacatacctagaagaacacgaaattacagaaagagtctgtggtctgtgcctttctccagagatgactgtcagggcttcaatatttaaaagagaaaagtaggttgaaggagaaagatctacatgttccaagagaaaaggagcaggtaggggaatagtcaattatgtattcctagtgtgctcagtaagtcgccacttaargtgaacagagttcacccgtggagatatttaatcttgtatctgtaggtatctgcttagaaaaaaaaaaagaaacacaaaggtggccgggcgcggtggctcacacctgtaatcccagcactttgggtggccaaggtgggtggatcacttgaggtcaggagttcgacaccagtctggtcaacatggtgaaaccctgtctctactacaaatacaaaaagttagccgggcgcggtggcatgcgcctgtaatcctagctgctggggaggctgaggcaggagaatcacttgaacccgggagggggag

SEQ ID NO: 34712 - DNA, 601 bp, Human
ttgagttagacaactcatcaaaagagaaaggatcaacacactgataatcaagggagattaaacatggttaaggatgcattaggtaatgagtcaacgaagacgaagtagcttagtttgcaagaacttggatacacacaacaatcttgtgtgcaactgcaagaggttcacagaatccaagtttgagacctttccttgtatgttggcatttctgagctgtttgttgcctaagccaagtgtcaatgtattccttcatctggagagagcactccatctactgtgctgggttgtgtgagcaccgcayacagaaggtcggtggtaacaaatgactatagtaagttcctgatagttaggccgggcacagtgactcatgcctgtaatcccagcactttgggaggccgaggtgggcggatcaggagttcaagaccagcctgacaaacatagtgaaaccccatctctacaaaaaatacaaaaattagccaggcgtggtggcctgtgcctgtaatctcagctactcaggaggctgaggcaagagaatcgcttgaacccgggaggcagaggttgcagtgagccgagatcttgtcactgtactccagcccgggca

SEQ ID NO: 34713 - DNA, 601 bp, Human
tatcagccacttgttggctaaaattatcttgtaaaatacttcaaccaattatgagccacattttaactgggtttgaataaacccagtccttgcaactgggtttgagttagacaactcatcaaaagagaaaggatcaacacactgataatcaagggagattaaacatggttaaggatgcattaggtaatgagtcaacgaagacgaagtagcttagtttgcaagaacttggatacacacaacaatcttgtgtgcaactgcaagaggttcacagaatccaagtttgagacctttccttgtatgktggcatttctgagctgtttgttgcctaagccaagtgtcaatgtattccttcatctggagagagcactccatctactgtgctgggttgtgtgagcaccgcatacagaaggtcggtggtaacaaatgactatagtaagttcctgatagttaggccgggcacagtgactcatgcctgtaatcccagcactttgggaggccgaggtgggcggatcaggagttcaagaccagcctgacaaacatagtgaaaccccatctctacaaaaaatacaaaaattagccaggcgtggtggcctgtgcctgt

SEQ ID NO: 34714 - DNA, 601 bp, Human
ataattgaggaagtcaagacctatataaatgcaataattcactaaaaacactggtactctcatctgtgaactcctagttcatttcttctaccaaggcatacatccacccacacattttgataccagaagaaatgacaaataactcccccaaatgttcaataaccaattcccacatattcccgtcccttttcaaaggaggctgatataaataccatcactggctgccaaaatgaaaacaggtagtctaggtatcgttccgcggctgacacgcaagacacatttttcttgagaccctgtttaycagccacttgttggctaaaattatcttgtaaaatacttcaaccaattatgagccacattttaactgggtttgaataaacccagtccttgcaactgggtttgagttagacaactcatcaaaagagaaaggatcaacacactgataatcaagggagattaaacatggttaaggatgcattaggtaatgagtcaacgaagacgaagtagcttagtttgcaagaacttggatacacacaacaatcttgtgtgcaactgcaagaggttcacagaatccaagtttgagacctttccttgtatgttg

SEQ ID NO: 34715 - DNA, 601 bp, Human
aaaaaaagaaaaacaaaacataaattgaaataaattattttaaaaacaccaaacttactaatgggactcatatgcctactgggcactgcataccttctccaatcctggagaccaaacgtgcccccttttctcttgttcctcatgaacttcctgaggcatctgctttctattgcagtcattaccagaacgcagttttgcaaaaaaaaaagtatgacatctccaaaaggagtctagcgcaatctgacgttgaaaccacgagctaccttgagctccaagttcatgtgagtatctttttttttttgagatggggtctcactctgtcacccaggctagagtacagtagcacgatcatggcttaccacagcctcatattcctgggctgaagcaatcatctcacctcagcctcccaagcagctaggactccaggcaagtgccgccacaaccatctccaaaaaaatttttttctttttttggagacatggaggtctgtgttgcccaggctgctcttgaactcctgagctcaagcaatcctcccgcctcagcctctcaaaagtactgagatcaggagtgagccaccacccctggcctgtcatgcaggtat

SEQ ID NO: 34716 - DNA, 601 bp, Human
taaaaaatcaactgagatcctacaaaatgaacaaatatgtttaaaaaaattaaaaaattaaaaagcactatccgggccgggtgcggtggctcacacctgtaatcccagcactttgggaggccgaggcaggcagatcacccaaagtcaggagttcgagaccagcctgaccaacatggagaaacaccatctgtactaaaaatacaaaaaaattagcccaggcatggtggcgcatgcctgtaattccagctacttgggaggctgaggcaggagaatcgcttgaacctgggaggcggaggttgcrgtgagccaagattgcaccattgtactccagcctggactagagtgaaactcggtctcaaaaaaatcactatccgctgggcacagtggctcacgcttgtaatcacagtactttgggaggactacttgaggccaggagttcaagaccagcctgggcgacatagggagactcccatctctataaaaatttaaaagtttagccaggtgtggcggcatgcaccgctggtcccagctactcaggaggttgaggtaggaggattgcttgaggccaggagttaagactacagtgagccatgatggttgg

SEQ ID NO: 34717 - DNA, 601 bp, Human
gcctagatcatgccactgcaactccagtctggtcaacagagcaagactccaccttaaaaaaaaaaaaaaaaaaaaaaaaagccgggcacagtggttcacgctgtaatcccagcactttgggaggctgaggcaggcagatcacctgagatcagaagttcaagaccagcctggccaacagggtgaaaccctgtctccactaaaaatacaaaaaactagccaggcgtggtggtagacacctgtaatcccagctactcgggaggctgaggcaggagaatcacttgaacccatgaggcggaggttkcagtgagccaaaatcgtgccactgcactccagcctggtgacagagggagactccgtctcaaaaataaataaataaataaaaaatcaactgagatcctacaaaatgaacaaatatgtttaaaaaaattaaaaaattaaaaagcactatccgggccgggtgcggtggctcacacctgtaatcccagcactttgggaggccgaggcaggcagatcacccaaagtcaggagttcgagaccagcctgaccaacatggagaaacaccatctgtactaaaaatacaaaaaaattagcccaggcatgg

SEQ ID NO: 34718 - DNA, 601 bp, Human
tggaccaatcagagaatcacaggacaagaatgcaataaagacatacatttcttgcaaatcacatccttcttccgctggaggatcccaaaaatgcagagccaccttccagagtttgatttgctggtcccatgaacgtcgactatacttcttaaatttattaggggtcttgggatgaatgccaggttgtcgaaggtgtctacaggagaaagattattctagcacatgcccacatgccactcacatttccacattagcctgaagattaaccaaactatgagattagtattattttaaatattayagatcaccaggcatggtggctcatgcctgtaatcctagcattttgggaggtcatgccaagatcacttaagctcaggaatttaaaaatggcctgggcaacacagtgagacctcgtctctatttaaaaaaaacaacaaaacagaacaaaaaaacagctaggggctgggagcggtggctcacacctataatcctagcattttgggaggccaaggtgggtggatcacctgaggtcagcagttcgagaccagcttggccaacatggtgaaaccccgtctctactaaaaatgcaaaaattagccgg

SEQ ID NO: 34719 - DNA, 601 bp, Human
agaggagaaactctaattgtttgtttaaagaatgtgtctgaggaagcgagaggctcaggaccagaggggagctgagaagaaaccccacatagagggagggaggtacacgatcattctctctaccttcctggtcagcaggtattgccatgatgcagcaaaagttcaggcctgagacatttcaactaggcacaagtttaaaggccaacggggctgggagcagtggctcacccctgtaatcccagcactttgggaggctgaggcgggtagatcacaaggtcaggaattacatggtgaaaccccrtctccactaaaaatacaaaaaatagctgggcgtggtggcgcgtgcctgtaatcccagctactcaggaggctgaggcaggagaaccacctgaacccagaaggtgaaggttgcagtgagccgggatcacgccactgcactccagcctcggtgacagagcatctcccaaaaaaaaaaagccaatagagaaagaaagccttccttccttaattaagaacttttattttcatggttgagccgaaatgactcaaatactttttaggatatttatatttaaaaaacaaattccagagattattgtaa

SEQ ID NO: 34720 - DNA, 601 bp, Human
cagccccagtcagtgaaagagggttctttcctttttatttttgcaatatcccatacaaaagcaatagaaacgtaacagtcttaacaagaagtttacaattgaatatttgaacagaaaatctgtacacattatcatttacagcaattttacatggtaaattaactgattgttttaaaatgttctttctaaatcgctccactctgctgccctaactcttggagtattctaaagagtctaactagtgctatttacaagtaccaaattaagaccatataacttacataaaactcattagtttaayagctcaatttaacaatgtctgacttcagaatgctgttatgacatattgataaaaggccaaaaattaagtttccataaagatattaaaggtgtctgagaatactttgatgcctataaaagtagctgactctcaattggtcccatggattacatggttaaatccaaaacagtccacctgacaagcaataactgaagatgcctgtggaaaaccagttatgtagacgtgtcagcttaccctggaggacaacagggattacgcaattaagctcgctggaagagagcttcaagtactttcttggac

SEQ ID NO: 34721 - DNA, 601 bp, Human
ggctgggcgtggtggcttacacctgtaatcccagcattttgggaggccgaggtgggcagatcatgaggtcaggagatcaagaccatcctggcttacacggtgacaccccgtcgaaagaaaaaagaaagaaagaaagaaaagaaagaaagaaggaaggaaggaaggaaagaaggaaggaaggaaggaaggaaggaaggaaggaaggaaggaaagagaaagaaagaaagaaagagaaaaagaaaggagagaaaggaaggaaggagagaaagaaagagaaagagaaagaagaaaaaaaaaaaaattagctgggcatggtggcgggcgcctgtagtcccagctactcaggaggctgaggcaggagaatcgcttgaacccgggaggcagaggttgcagagagccgagattgtgccactgcactccagcctgggcaacagggcgagagtccgtctcaaaaacaacaaatcagaagaggcagaaagcaaaaatttgaatcatggctttgtcactttccagtcctaagaacttgacaagtcactaacttgtcaagtaatgtgaaatcatgaaaatgcacatgttaatttcgcatcaaattgagtttttt

SEQ ID NO: 34722 - DNA, 601 bp, Human
ttgagtagctgagaaatagttctaaagaaacaattcagggctgggcgtggtggcttacacctgtaatcccagcattttgggaggccgaggtgggcagatcatgaggtcaggagatcaagaccatcctggcttacacggtgacaccccgtcgaaagaaaaaagaaagaaagaaagaaaagaaagaaagaaggaaggaaggaaggaaagaaggaaggaaggaaggaaggaaggaaggaaggaaggaaggaaagagaaagaaagaaagaaagagaaaaagaaaggagagaaaggaaggaaggagagaaagaaagagaaagagaaagaagaaaaaaaaaaaaattagctgggcatggtggcgggcgcctgtagtcccagctactcaggaggctgaggcaggagaatcgcttgaacccgggaggcagaggttgcagagagccgagattgtgccactgcactccagcctgggcaacagggcgagagtccgtctcaaaaacaacaaatcagaagaggcagaaagcaaaaatttgaatcatggctttgtcactttccagtcctaagaacttgacaagtcactaacttgtcaagtaatgtgaaatcatga

SEQ ID NO: 34723 - DNA, 601 bp, Human
accccaagaaatgagtgagtcatatttgcttttatatcttatgcattgcaagaattcagtctcacaaacagttgaaccataaattaaaaatggtagactcacatttgaatagcagctagttatatataaaaaaatccaaattttttaaaaagtgacttgtattaataaaaactggtgaataaatcaccaatgatttgtttcctcatgctgtcatattattcttcagatacaaccataaaggcaaataagccataaagacaaacaagatgacatattaagaatgtttaaaattgcttcttcygaattttccggattctactggcaaagcgaagctttggcatcttctttttctttttcaaagctaaaatcaataaaacgacaatgaaaatcatacatctccagtctgtaggctcactataaatcactatttctgataaggttattgagctcacttcatcttatttttaaggactgtgaagtcaaaactcattatacactcagttaataatattttacctttaagatatgaagatacagctaccgtctactgcagctagccagtaaaagcattttgacaaaactgattaacactacggagata

SEQ ID NO: 34724 - DNA, 601 bp, Human
gactttgtcttcttgggactaaaatataatccaacttttaaatgcaaaatgagttttatttgctagtcctttttattctcaaatatgttaaaagcacatgattatattgtcttatgttgtttcagttatgatcctcttctgaaatcaggaatacgaccccaagaaatgagtgagtcatatttgcttttatatcttatgcattgcaagaattcagtctcacaaacagttgaaccataaattaaaaatggtagactcacatttgaatagcagctagttatatataaaaaaatccaaatttttkaaaaagtgacttgtattaataaaaactggtgaataaatcaccaatgatttgtttcctcatgctgtcatattattcttcagatacaaccataaaggcaaataagccataaagacaaacaagatgacatattaagaatgtttaaaattgcttcttccgaattttccggattctactggcaaagcgaagctttggcatcttctttttctttttcaaagctaaaatcaataaaacgacaatgaaaatcatacatctccagtctgtaggctcactataaatcactatttctgataaggttattga

SEQ ID NO: 34725 - DNA, 601 bp, Human
atatttgtgctgggtgcttagtaggatctttcagtgtggaaactcatctccttaacatctggacaactttctgaagtcatttattatttcctgcctttcattttttttttggtttggaactcctgaactggtcctgtgatgtgactgcagccgccaggcgcgtgcgcagtgtacactgcgtgcgcatacgcgagcccgttgcgcctgcgcgcggtgccgccgtcgcccctcttttcgcggcgttctccacctgcgcgggcctgaatggccttcaggagcacagtcggcctgaggagttgayggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccggggtggctctcccgccccggttcctccctgcgcggcgcggggagggcccactgggtttcctttcg

SEQ ID NO: 34726 - DNA, 601 bp, Human
cgcggcgttctccacctgcgcgggcctgaatggccttcaggagcacagtcggcctgaggagttgatggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccrgggtggctctcccgccccggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccacccccgccaaaaaacaaacagataaatggtggcttggggaaacccggacgtggctgccaaggaaacgggcgactccgagggctgggaaagctcagcttggtgcacattcgctgccaatc

SEQ ID NO: 34727 - DNA, 601 bp, Human
gcgcgggcctgaatggccttcaggagcacagtcggcctgaggagttgatggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccggggtggctctcccgccycggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccacccccgccaaaaaacaaacagataaatggtggcttggggaaacccggacgtggctgccaaggaaacgggcgactccgagggctgggaaagctcagcttggtgcacattcgctgccaatctaggttattggtgaagc

SEQ ID NO: 34728 - DNA, 601 bp, Human
gtctctttccctggcggcggcggcttcttccgtgggacaatatgttcaagagaatggccgaatttgggcctgactccggcgggagagtaaaggtcagtgcccggaccgcccctcttccggggtggctctcccgccccggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccayccccgccaaaaaacaaacagataaatggtggcttggggaaacccggacgtggctgccaaggaaacgggcgactccgagggctgggaaagctcagcttggtgcacattcgctgccaatctaggttattggtgaagcggtgacgccaccctcctggtgtgaggataacaataactgtagcaaacagtcgctgagcgcttacccgcagtatttccaagtgcggtaactgagacaccgaggcatacgaaagctaagaaaatttgctggagttcatggtgttcacaaagcctcaaagcaagagca

SEQ ID NO: 34729 - DNA, 601 bp, Human
cctttcgcgccttttctcctcgggtttgaaccgtggtttcaggttggagagcgagtcagagccattgagcgaaaaaccggcgttcattgggccccaacttcctcgcgtcactgccaactcccacccccgccaaaaaacaaacagataaatggtggcttggggaaacccggacgtggctgccaaggaaacgggcgactccgagggctgggaaagctcagcttggtgcacattcgctgccaatctaggttattggtgaagcggtgacgccaccctcctggtgtgaggataacaataactgtarcaaacagtcgctgagcgcttacccgcagtatttccaagtgcggtaactgagacaccgaggcatacgaaagctaagaaaatttgctggagttcatggtgttcacaaagcctcaaagcaagagcataacactgtgcctggcacatggggaacattcagtaaatgtcaacttcttttgtttttgatgaaattaccatagaccctagcgtaatgtttgacattgtaatatttatttccctcacacagcccctggcacgttaatttttttttttttttgagacgaagtgtctgtcttgttgccca

SEQ ID NO: 34730 - DNA, 601 bp, Human
tctgaattcaactgtaatatttattgtaacatttacatttaaatcagtttattttttaaaagcctctttctaagcgttaatgttttttaaattgtagggtgtttggttgtttttttttttttttttttttggagacagaggctcgctctgttgcccaggctggagtgcaatggtatgatctcggctcactgcaacctctgcctcccaggttcaagcaattctcctgcttcagcctcccaagtagctgggattacagatgcacaccaccaagcccagctaatttttgtatttttagtagagrtggggtttcaccatcttggccaggctggtcttgaacctctgacctcaggtgatccacccaccttggtgaaattgtaggttttaatttctagttacagttattactattttttaatactgattaaacacgtaagtaaaaaagtgaaaaatgtttgacctttattctacctctcacaaattactcctaatatttatactatactttgggaaacactgccacaggctaggtgataaggacattgccacaggtgatgccagtcagaattggccatttttatttcaatgcctagctttcaggtgt

SEQ ID NO: 34731 - DNA, 601 bp, Human
tgttgcccaggctggagtgcaatggtatgatctcggctcactgcaacctctgcctcccaggttcaagcaattctcctgcttcagcctcccaagtagctgggattacagatgcacaccaccaagcccagctaatttttgtatttttagtagagatggggtttcaccatcttggccaggctggtcttgaacctctgacctcaggtgatccacccaccttggtgaaattgtaggttttaatttctagttacagttattactattttttaatactgattaaacacgtaagtaaaaaagtgaaaaatgtttgacctttattctacctctcacaaattactcctaatatttatactatactttgggaaacactgccacaggctaggtgataaggacattgccacaggtgatgccagtcagaattggccatttttatttcaatgcctagctttcaggtgtttaagtaaaggccttttgcatttcttttaacaacactctaaaagcgctttacatggtaatttaaataaaagcattttcaaagagggaacattgtaattattctggcgttttttgtgttaatatgaaaggatgtgtctgaaattgattt

SEQ ID NO: 34732 - DNA, 601 bp, Human
tgtatttttagtagagatggagtttccccatgttggccaggctggtctcaaactcctgacctcaggtgatccacctgccttggcctcccaaagtgctgggattacaggcgtgagccaccgtgcccggcgtatgtgatataattttgttctttgaaattgactatagatttgccttatatttctgtaatagtaccagatatgtactgttgttttaatggaaaaaaatcaaaattgatttagaatattatctatagaggtgtattaaaacaagatttgccaaaaaaaaagttaatttgggacrtgtatttctatacattacaaatcataaaagaattcaacacaggcttcctttttgtttttttaaaaaaagcaaaataggccaggtgcggtggctcacgcctgtaattccagcacactggtagggcgaggcaggtggatcacctgaggtcaagagttcgagaccagcctggccaacatggtgaaaccccgtctctactaaaaatacaaaaaattagccaggcatggtggcagccgcctgtaatcccagctactcaggaggctgaggcaggagaattgcttgaacctgggtcagggaagttgc

SEQ ID NO: 34733 - DNA, 601 bp, Human
gagatggagtttccccatgttggccaggctggtctcaaactcctgacctcaggtgatccacctgccttggcctcccaaagtgctgggattacaggcgtgagccaccgtgcccggcgtatgtgatataattttgttctttgaaattgactatagatttgccttatatttctgtaatagtaccagatatgtactgttgttttaatggaaaaaaatcaaaattgatttagaatattatctatagaggtgtattaaaacaagatttgccaaaaaaaaagttaatttgggacgtgtatttctatayattacaaatcataaaagaattcaacacaggcttcctttttgtttttttaaaaaaagcaaaataggccaggtgcggtggctcacgcctgtaattccagcacactggtagggcgaggcaggtggatcacctgaggtcaagagttcgagaccagcctggccaacatggtgaaaccccgtctctactaaaaatacaaaaaattagccaggcatggtggcagccgcctgtaatcccagctactcaggaggctgaggcaggagaattgcttgaacctgggtcagggaagttgcagtgagccaagat

SEQ ID NO: 34734 - DNA, 601 bp, Human
tgaacatgtattggaaagaaaccatggaaatcagatgactactgcagcaaaaaaacttaaaactattattatcattcggttattagtaataaataagttgagcccatatgctgtgtaaaatagtttttatagtttttggtagttaaaccctaagaaacagtgtttttgcttttttaagctgtcatcagtactagcgcttcattttatatcttatttatgagtctttatttttatagccactggctttttcatcttttgatctcttcttatcagattgttgcttgataatgtaaaaaaaaaatccctccaggcttttgctttgatccttcagcaactttgttaggttgtgataccctcattttagagatcaggataccaaggctcagaggtcaagtcactgctcaaaaacactcagttaattatggtagagctagtttttgaacccagatatttgcattcatacctttttctagtattttttcttttgagtaaaaccactaggcctttttttttcttaagcctgtagggtcaaaactcagtaatggctctcacattccacatatgtggctggggtttaactccagtttcaaggctttcacat

SEQ ID NO: 34735 - DNA, 601 bp, Human
ttgatccttcagcaactttgttaggttgtgataccctcattttagagatcaggataccaaggctcagaggtcaagtcactgctcaaaaacactcagttaattatggtagagctagtttttgaacccagatatttgcattcatacctttttctagtattttttcttttgagtaaaaccactaggcctttttttttcttaagcctgtagggtcaaaactcagtaatggctctcacattccacatatgtggctggggtttaactccagtttcaaggctttcacattcatcaccattttatcttgttagaatcacatcagtcttttagcaccaaacatttacattttaattatcagattatattttttaaactgtgtatgtatttttaaaggagctgaatatcacctggaccagtatttcagcaaaccggttcctaactggctgcatcagaaacacctgaggtgcttgcttatttatttattaatttttgtgaggtgctttttaaaaattcaagctcctaggcctcaccttttggagagtctgattcagtaggtttggaatggggccagcaccccaggtgattttgatgcacaatgagaattggg

SEQ ID NO: 34736 - DNA, 601 bp, Human
caccccaggtgattttgatgcacaatgagaattgggacccaatgacgtagacttactcttttcttcctacgtaggaatttatttaggcaatatctcaaatgagaatctagtttgggcttgcatatctccaatatggagaattaacttatgtcactaagtaaaacatcctattcaaggttggggtagttttagttttaagaaagctgtacttcgttacgcttccctgaactttttactgattactattcctaccttagttttcttttctcatgagtaagcatccatagctcatttaaacatwttttgtgttttcatgtgatgaagtttttagatctcctaccatctgtgttgcccttcaggaaaacacactcatgttatattttgtttggcaataattttttttttcttttgagacagagttacactctgctgcccaggctggagtacagtggcataaacacaactcactgcagcctccacctcctggcctcaaacagtcctctgcctcagcctccccagtagatgggaccacagatgcatgccaccatgctgagttaattttttattttctgtagagataggggctcgccatgttgcccag

SEQ ID NO: 34737 - DNA, 601 bp, Human
gcaataattttttttttcttttgagacagagttacactctgctgcccaggctggagtacagtggcataaacacaactcactgcagcctccacctcctggcctcaaacagtcctctgcctcagcctccccagtagatgggaccacagatgcatgccaccatgctgagttaattttttattttctgtagagataggggctcgccatgttgcccaggctgatctcaaactcctgggctcaagcattcctctcgccttgccctcccaaggtgctgggattacaggcatgagccaccatgaccggycaagaaattattaaatattatatctgctatttgtaagatattgtttaagggattgagaaggatacaaaaatgagacactgaccttaatgagaatagtttattagggaaaagagagcatagaatttagcagatgttgagagggagagagaagcagctcatatgttactagagtagaagctctttttaactttgtaagattgctgggttttcatttttattttgagaatatgctgccttacctccctgtctcctcatctgttaccccttatccccagttggaaaataaatctatgaaagaaa

SEQ ID NO: 34738 - DNA, 601 bp, Human
agtttattagggaaaagagagcatagaatttagcagatgttgagagggagagagaagcagctcatatgttactagagtagaagctctttttaactttgtaagattgctgggttttcatttttattttgagaatatgctgccttacctccctgtctcctcatctgttaccccttatccccagttggaaaataaatctatgaaagaaatcattgtaccctgtaacctcattatgagacagctcttgaagtcactcttagaaaggtatataacctattgcactgctatagtgattaatctgttkaatagattcccatatagatttacataggcctgaattttattctctaaaaaatattatagggttttttagtattattaaactattgtactttttcaatagttagctcttacagaaaatgtccagtgaaggtttatttaaaatatctaagaaagacaagttggttggaagacaacttgtgatttacttctgctacccagtaacctattatacagatcaagccactataaaaagaatggttgtttctaaaagcaaaatgtcaaattgagttttcattcctagaaatagggatttctaggcaag

SEQ ID NO: 34739 - DNA, 601 bp, Human
tcatctgttaccccttatccccagttggaaaataaatctatgaaagaaatcattgtaccctgtaacctcattatgagacagctcttgaagtcactcttagaaaggtatataacctattgcactgctatagtgattaatctgtttaatagattcccatatagatttacataggcctgaattttattctctaaaaaatattatagggttttttagtattattaaactattgtactttttcaatagttagctcttacagaaaatgtccagtgaaggtttatttaaaatatctaagaaagacaasttggttggaagacaacttgtgatttacttctgctacccagtaacctattatacagatcaagccactataaaaagaatggttgtttctaaaagcaaaatgtcaaattgagttttcattcctagaaatagggatttctaggcaagtataggcagtttcattgttctaagaattttcaaacaccactcaaaattacagacatctgtcttgaaatgtttttattgcctatatccgcatgaatgcctctggaagtctgaataataaatttagggaaggacagttttacaatgtaattgtaagaat

SEQ ID NO: 34740 - DNA, 601 bp, Human
aatttattcccacagatctgaaggctagaagtctgaaatcaaggtgttggccatgttttttccaaagcctttaggggagcatctttccttgcctcttccagccccagatgttccttggcttttggcaacatatctctaatatcttcctccattgtcacatggccttatctttctccctggtctctgtgtcttcttctcttagaaggacaccagtcatattggattgtggtccaccctaatgacttcattgtaattacacctgcaaagaccctgtttccaaataatgtcacatccacaggtrctgagaattagggcttcgtatcttttgcctgcatttatagtcccagttacttgggaggctgaggcaggagtatcatttgagatcaggaattcaagaccagcctgggcaacatagtaaaaccccatctcaaacaaaatataccttttgcagggaggtcacaattcagcccataacatctttatcccatctttgacctcttttccaagaaaactgctttttaacagttacctgttctcaattcctctagaaattactcactcctgtgcatctcatatatttaaatccctaatactggatttc

SEQ ID NO: 34741 - DNA, 601 bp, Human
ctttttcattccccacagtaaatttgtaaactctaatcttcaaagcagtcacaattaatccacttgtgtaagtaaaagaattcatgttttagtgatttctcagtttaatttctatagctttatcttgtgttatttttagtttcctctctagagattcttgaacagattcttaattaccctctaaagagtattcatgttaggtagatatgaatggatctaataggaaaataaaggtacagaaaatttgggtgatttgctgcaataagttgcagttgaaacaagatcatgaatttgacatgtrtatacttattccagtctctatttcagttaaaaaaatgccagtatcttatgatgataaaaaccattgcacagatttgacatctgtttctatttcacaggtaaccctgtatcatttgctaaagctgtttcaatcagacaccaatgcaatgctggggaaaaagacagtggtttcagagttctatgatgaaatggtaagaagattttataatgatagttttaaaagcatttgaagttggagaactttgaagttattgggtttttgttcattttatcccattagatatttcaagacccaacagca

SEQ ID NO: 34742 - DNA, 601 bp, Human
cccggctgccctacagccctgccaaacccactgctcacccaggtagcggcctccagccttgatgacaatggcacttcggctccgcgtctcctcctccgcctgggccatgctctgccgcgccttctggtaggagtcgtcggtggcacacaccgtgatcttgtcctgtatgctgcccaggcagtccaggtgaacttccccatgactgcaagacaaggccaggagctggggtcagcagctgggacaatgcagggaggatccgttgagggcccaagcccccagcccaccacctggcctggaaaayggactctgtcaacaccatctcaggcaatatggtttcaatggggcacatctcaaccctgggccagaggtggcagggtgacctcaagagccggcggggtgctctggggtggggcggcgcctcacctggagacatactgctggatgcagtcgaagctgccctgggggttgtcgcggccgatgttggagaggtagaaggagaacgtccgcgcctctgcggggcagtcaggctgggggatggagatgtgctgcgtggagggggagggggtgtcactgggaggtcctcggcaggacaggtccccag

SEQ ID NO: 34743 - DNA, 601 bp, Human
gcctgagtgacagagaaaggtcctgtctttaaaaaaagaaaaaacaaaaaacaaaacacgctgtctcttcaactgttctccccacagcagccctgtgcttggggcttacagcccagggcctcaacatcatggacaacccgggctccctggccatacatgtccacccggactcagtgttgaccaggaagaccaacccctgcacccacatctggggtttcactcagagggaacccctctgctcagcaaagggaaatcacgtgctttcttcggaaggaggagagagaggaattgaaatgccccygccttttcttaaagataaaactcaaaaagccatcaaggctgtcgtctgctctgagccatctccctcctccctgaagcccggcaccctactcctgccgtaatgagttcccatgactcctggagctctgcctggactaagaggcggggtgctgcagctctgtaaacaaacagcactgtgcttcccactgtcaaggcctgttggcttctcaactgctgaaaccgtttccaagttgatgctgagtggccagagctttcctgcagtgctgggtcgctggcaacagggcctgtgaggctcatttcc

SEQ ID NO: 34744 - DNA, 601 bp, Human
aggctctgtctctacaaaaaatctaaaagttagccatgtgtggtggcacacacctgtggtcccagctactctggaggctgaggtaggatcacttgagcctaggagtttgaggctgcagtgagctatgattgtgccaccgcactccagcctgagtgacagagaaaggtcctgtctttaaaaaaagaaaaaacaaaaaacaaaacacgctgtctcttcaactgttctccccacagcagccctgtgcttggggcttacagcccagggcctcaacatcatggacaacccgggctccctggccatacatgtccacccggactcagtgttgaccaggaagaccaacccctgcacccacatctggggtttcactcagagggaacccctctgctcagcaaagggaaatcacgtgctttcttcggaaggaggagagagaggaattgaaatgcccccgccttttcttaaagataaaactcaaaaagccatcaaggctgtcgtctgctctgagccatctccctcctccctgaagcccggcaccctactcctgccgtaatgagttcccatgactcctggagctctgcctggactaagaggcggggtgctgcag

SEQ ID NO: 34745 - DNA, 601 bp, Human
aaccctcactgggccaggggcggtggctcacacctgtaatcccagcactttgggatgctgaggtgggcggattacgaggtcaggagatcgagaccgtcctggctaacacggtgaaaccccgtctctattaaaaatacaaaaaaaaagaaaattagccgggcgtggtggcaggcacctgtagtcccagctactcgggaggctgaggcaggagaatggcgtgaacccgggaggcggaggttgcagtgagccgagatcgcgccactgcactccagcctgggcgacagaccgcgactccatctcaaaaaaaaaaaaaccctcactgtacccaaagtggtgtgctaagatacatttctgatcaagtttttggctgaaggacccacagatttattaacatgtatatggggccaggtgcgctgactcatgcctgtaatcccagcattgtgggaggcccaggcgaaaggatcatttgagcccaggagtcagacaccagcctgtgcaacatagcgaggctctgtctctacaaaaaatctaaaagttagccatgtgtggtggcacacacctgtggtcccagctactctggaggctgaggtaggatcacttg

SEQ ID NO: 34746 - DNA, 601 bp, Human
acatctaaacagacagcagacccctaccagaacataaactgtttcaaaaaccctcactgggccaggggcggtggctcacacctgtaatcccagcactttgggatgctgaggtgggcggattacgaggtcaggagatcgagaccgtcctggctaacacggtgaaaccccgtctctattaaaaatacaaaaaaaaagaaaattagccgggcgtggtggcaggcacctgtagtcccagctactcgggaggctgaggcaggagaatggcgtgaacccgggaggcggaggttgcagtgagccgagatcgcgccactgcactccagcctgggcgacagaccgcgactccatctcaaaaaaaaaaaaaccctcactgtacccaaagtggtgtgctaagatacatttctgatcaagtttttggctgaaggacccacagatttattaacatgtatatggggccaggtgcgctgactcatgcctgtaatcccagcattgtgggaggcccaggcgaaaggatcatttgagcccaggagtcagacaccagcctgtgcaacatagcgaggctctgtctctacaaaaaatctaaaagttagccatgtgtggtggc

SEQ ID NO: 34747 - DNA, 601 bp, Human
agagatggggtctcactatgctgcccagactggtctcaaactcatgggcccaaaggaccctcccacctcagctttccaaagtgctggtattataaaccagagccatcctgcccaacctgaggcaggggctgtttgtaaacccttctgatgttaaactgggggtccctgaactgcaagaggcagtcactcccaagcctgcacttcagagtcctatgctggccccatgtggctgccatttttgtttttctaaagtcagtaaagatgtcggagccactttcagcagctgctctgaagaccctgrggtgcaagtggcaccccagccttaggcctggtcaagctctcctctggcaggcgtggctgtgcccagagccctggggagagcaggttcccctctatccccaacgcagagacgtgggcagggtccagcacgctgctcccctgctctgtcctgaacaatgatgccccggcatccttgggaacagggtcggccgagcaagctcaacagtgcctcaaatccttcccccaaaagctcttcgtaacaacatcactctgatcttatctctcaaaatctgatctgtcaaattaacccagaaagccttgc

SEQ ID NO: 34748 - DNA, 601 bp, Human
tttttttgagatggagtctcgctcagttgcccaggctagagtgcaatggcgctatcttggctcactgcaagctccgcctcccgggttcacgccattctccagcctcagcctctggagtagctgggactacaggcacccgccaccacgcccggctaatttttttgtgtgtgtatttttagtagagatggggtttcaccatgttagccaggatggtctcgatctcctgacctcgtaatccacttgcctcggcctcccaaagtgctgggattacaggcgtgagccaccgcgcccagcccatggkgagcatttttaacagttgagtaatatcccacccccaaactgctgccagtttctctgtagcataaacagacattactgtgtgcagtttttttcaggttggcaacagtttccttcgacgggattcccagaagccagattagtaggtcaaaggctgaatatttttatggctcatgacaggctttgctaaatattactcagccgtcaacacccctccccttgaaggataggcttgcgggtttccctggggctcagccagtcctagaggtggacaccttccatctctgctctagatttttccaca

SEQ ID NO: 34749 - DNA, 601 bp, Human
ttttttttttttttttgagatggagtctcgctcagttgcccaggctagagtgcaatggcgctatcttggctcactgcaagctccgcctcccgggttcacgccattctccagcctcagcctctggagtagctgggactacaggcacccgccaccacgcccggctaatttttttgtgtgtgtatttttagtagagatggggtttcaccatgttagccaggatggtctcgatctcctgacctcgtaatccacttgcctcggcctcccaaagtgctgggattacaggcgtgagccaccgcgcccrgcccatggggagcatttttaacagttgagtaatatcccacccccaaactgctgccagtttctctgtagcataaacagacattactgtgtgcagtttttttcaggttggcaacagtttccttcgacgggattcccagaagccagattagtaggtcaaaggctgaatatttttatggctcatgacaggctttgctaaatattactcagccgtcaacacccctccccttgaaggataggcttgcgggtttccctggggctcagccagtcctagaggtggacaccttccatctctgctctagat

SEQ ID NO: 34750 - DNA, 601 bp, Human
tggcctacagggcactctggtctccatcttgctgcaggcatagcagtcactgttttctgctgcatctgacatggctctgcgtcacagcgtatcccatggggagcattttttttttttttttgagatggagtctcgctcagttgcccaggctagagtgcaatggcgctatcttggctcactgcaagctccgcctcccgggttcacgccattctccagcctcagcctctggagtagctgggactacaggcacccgccaccacgcccggctaatttttttgtgtgtgtatttttagtagagatggggtttcaccatgttagccaggatggtctcgatctcctgacctcgtaatccacttgcctcggcctcccaaagtgctgggattacaggcgtgagccaccgcgcccagcccatggggagcatttttaacagttgagtaatatcccacccccaaactgctgccagtttctctgtagcataaacagacattactgtgtgcagtttttttcaggttggcaacagtttccttcgacgggattcccagaagccagattagtaggtcaaaggctgaatatttttatggctcatgacaggctttgctaa

SEQ ID NO: 34751 - DNA, 601 bp, Human
gcagtggtgtgatcaaggttcactgtagctgcaaactcctgggctcaagcgatcctcttgcctcagtctcccaagtaggtgggctataagcatgcactatcatacccagctaattttttgtatagataggatctcagtattttgcataggctggtctcgagctcctggcctcaaggatcctcccacctcagcctcccaaagtgctggaaacaggcgtgagccaccgcgctgggctccaccccatttctgatcacaactcccagggaagagtcagccacggctggggatgctgggtgagggstacctctggggccacgtctgagcccaccttccctacaaccagcctgccttgctgttgccggttgaccaaagctaagttcgtctcccagactgctaacaaagatggattcagaacgtctgccttagagggatctgaggaagctccaggtcactgccctgagtgggtgctgcgtgctggcctacagggcactctggtctccatcttgctgcaggcatagcagtcactgttttctgctgcatctgacatggctctgcgtcacagcgtatcccatggggagcattttttttttttttttgagat

SEQ ID NO: 34752 - DNA, 601 bp, Human
ttcttccaggctggagtgcagtggtgtgatcaaggttcactgtagctgcaaactcctgggctcaagcgatcctcttgcctcagtctcccaagtaggtgggctataagcatgcactatcatacccagctaattttttgtatagataggatctcagtattttgcataggctggtctcgagctcctggcctcaaggatcctcccacctcagcctcccaaagtgctggaaacaggcgtgagccaccgcgctgggctccaccccatttctgatcacaactcccagggaagagtcagccacggctgrggatgctgggtgaggggtacctctggggccacgtctgagcccaccttccctacaaccagcctgccttgctgttgccggttgaccaaagctaagttcgtctcccagactgctaacaaagatggattcagaacgtctgccttagagggatctgaggaagctccaggtcactgccctgagtgggtgctgcgtgctggcctacagggcactctggtctccatcttgctgcaggcatagcagtcactgttttctgctgcatctgacatggctctgcgtcacagcgtatcccatggggagcatttt

SEQ ID NO: 34753 - DNA, 601 bp, Human
cctgtgctcaagcgaccctcccacgtcagcctcccaggtaggtggggccacaggtgtgcaccactatactccagctaattttttttaagagatgggatctcgctatgttgtccaggcttgtcttgaacccctgggctcaagcgatcctctgatctcagcctcccaatgtgctgggattccagccaccacacctggctcctatttcttccaggctggagtgcagtggtgtgatcaaggttcactgtagctgcaaactcctgggctcaagcgatcctcttgcctcagtctcccaagtaggtgrgctataagcatgcactatcatacccagctaattttttgtatagataggatctcagtattttgcataggctggtctcgagctcctggcctcaaggatcctcccacctcagcctcccaaagtgctggaaacaggcgtgagccaccgcgctgggctccaccccatttctgatcacaactcccagggaagagtcagccacggctggggatgctgggtgaggggtacctctggggccacgtctgagcccaccttccctacaaccagcctgccttgctgttgccggttgaccaaagctaagttcgt

SEQ ID NO: 34754 - DNA, 601 bp, Human
actagagaaaaaagatctgatagtgggtttgggagggtgtgcagagacagtgggagacagacagagacagaggagaggaaagaggatggcccactaccgatccgtgatgtctcccacccccagttcccccgcacacaatcctcagggtgcagaagggataatgagggtcatgaaggcaggtccagactcaactgtcttagaggtgctggggccaggctggctccaaaaaggggagggctaccacctgcagtactgagaccccatcacctgccccctggcccctctagcctgctttttttcyttttttgatacaagatcttagctcactatagcctagacctcctgtgctcaagcgaccctcccacgtcagcctcccaggtaggtggggccacaggtgtgcaccactatactccagctaattttttttaagagatgggatctcgctatgttgtccaggcttgtcttgaacccctgggctcaagcgatcctctgatctcagcctcccaatgtgctgggattccagccaccacacctggctcctatttcttccaggctggagtgcagtggtgtgatcaaggttcactgtagctgcaaactcctg

SEQ ID NO: 34755 - DNA, 601 bp, Human
acccttccatcctgctcccaagccctgtggccttcaggaccacacaagaccaccccagcatcctctgggtaagctctggctgccttcatgcgggtggggacatgctgggggatgggaggcggcattaccggacgagcacccgcttcagcagctgctggtccccctccgagtagccaggccagtccttctgcacatccttgtacatgcagtcctgcagtgtacacgtgccgtccttagcactcatgttggccacctgcaagacagagccagccatcactttgtgggaatcctgagagagacrggggactagagaaaaaagatctgatagtgggtttgggagggtgtgcagagacagtgggagacagacagagacagaggagaggaaagaggatggcccactaccgatccgtgatgtctcccacccccagttcccccgcacacaatcctcagggtgcagaagggataatgagggtcatgaaggcaggtccagactcaactgtcttagaggtgctggggccaggctggctccaaaaaggggagggctaccacctgcagtactgagaccccatcacctgccccctggcccctctagcctgctttt

SEQ ID NO: 34756 - DNA, 601 bp, Human
agccgcctgcctccttaaccactgctcccctgagctgctgccacttctgaccctgggtcccaattagcctgaggggatgcatttaattaacgctgcttaatgacgcctgccctgccgggagtgtcgtttggccttatttctctctacttcaggttcttgagaggctcttttcaaaaagtcagtgaacttcccaggccctgtggggatgcccaggttgtggagggaagcatgaagggaagttggggacagctgaggagggtctcagcagactgaggccttttgtctgaagattccaaggtcsgggccagtgactcacacctccgtcccactctgtgagcgtggccttcccccaccacgggacaccctggggcaccacgtgggcagtagggaggatggccagagaggcctacttggacccttccatcctgctcccaagccctgtggccttcaggaccacacaagaccaccccagcatcctctgggtaagctctggctgccttcatgcgggtggggacatgctgggggatgggaggcggcattaccggacgagcacccgcttcagcagctgctggtccccctccgagtagccaggccagtcctt

SEQ ID NO: 34757 - DNA, 601 bp, Human
acttgggcccccacatcccatctgtctcacggcctgcactaggctaacggcctgcactgggctagcccagctggtaacaaatactccaaggccctgctttgatatacacgaagccatggtgtcaaaaactgctataaatggggctttcttagggatggggtgctaaataggaaaaaaaaaaaaaaacagctatgcagaggggcaccgcaggtcaccttctatgtggttatggcccagggacatcaaccctgccccctgcacgctagtggaagcttgtgaaggcagtgctgatccccatgcyggcccagagtgaaagcagagtgccaaggggctggcatgagcccagcaagctcactcagcagacggaacatgagccttgaatcaggggagctggaggcggctctggagcctgcatcccggggaagctccccgacgccccagaggtgcagcccagccttctccacctcactccactagctctgggcagttctccttccagtgccctaagggtctgaggaacccagggggccaagggagaggacacagggtatgaggatgggggcgggtcttctgccaagactgtgccctccgccagcctgcc

SEQ ID NO: 34758 - DNA, 601 bp, Human
tgatgagaggagatttggataccagggacagatcgggtttggacatcatgaacaaagagaacatgagtggagaaaccacccccaaaagccacatgtggtgccagctcagctggggaggctcctgcagtgacttgggcccccacatcccatctgtctcacggcctgcactaggctaacggcctgcactgggctagcccagctggtaacaaatactccaaggccctgctttgatatacacgaagccatggtgtcaaaaactgctataaatggggctttcttagggatggggtgctaaataggaaaaaaaaaaaaaaacagctatgcagaggggcaccgcaggtcaccttctatgtggttatggcccagggacatcaaccctgccccctgcacgctagtggaagcttgtgaaggcagtgctgatccccatgccggcccagagtgaaagcagagtgccaaggggctggcatgagcccagcaagctcactcagcagacggaacatgagccttgaatcaggggagctggaggcggctctggagcctgcatcccggggaagctccccgacgccccagaggtgcagcccagccttctccacctcactcc

SEQ ID NO: 34759 - DNA, 601 bp, Human
agagcaagagatgaaaaccagctgggcgcggtggctcacgcctgtaatcccagcactttgggaggctgaggtgggcggatcacctgagatccggagtttgagaccagcctgaccaacatggagaaaccccatctctactaaaaatacaaaattagccgggcatggtgcgcatgcctgtaatcccagctactctggatgctgaggcaggagaatggcttgaacccaggagacggacgttgctgtgagccgagatcgcgccattgcactccagcctgggcaacaagagcaaaactccatcacaaaaaaaaaaaaaagagatgaaaaccaggaagaggaggacagactctagcagcctgccaagagcagtttgaggtggtgtgcagtaggataggcctttccactaccacacacaggacagaaggacggatagacggataaggcaagttttcagcctgcgggggccgtggtgcccaccatcccagagtaggtacctggccagcccctggctctgtggaccagcacagggttggggtgggaagcctctgaccttcaacgtggagggaaagcatcttggactctacaagtctagatgtgatcaacc

SEQ ID NO: 34760 - DNA, 601 bp, Human
agagcaacactctgtctcaagaaaaaaaaagaaactacaaataatagtaaattaagagacaggatgagaaatgtcaaagaagtctcctaaaaggagaataaaaaagagcaagagatgaaaaccagctgggcgcggtggctcacgcctgtaatcccagcactttgggaggctgaggtgggcggatcacctgagatccggagtttgagaccagcctgaccaacatggagaaaccccatctctactaaaaatacaaaattagccgggcatggtgcgcatgcctgtaatcccagctactctggakgctgaggcaggagaatggcttgaacccaggagacggacgttgctgtgagccgagatcgcgccattgcactccagcctgggcaacaagagcaaaactccatcacaaaaaaaaaaaaaagagatgaaaaccaggaagaggaggacagactctagcagcctgccaagagcagtttgaggtggtgtgcagtaggataggcctttccactaccacacacaggacagaaggacggatagacggataaggcaagttttcagcctgcgggggccgtggtgcccaccatcccagagtaggtacctggcc

SEQ ID NO: 34761 - DNA, 601 bp, Human
gttccagaccagcctggccaagatggtgaaaccccatctctactaaaaatacaaaaattagccaggcgtggtggcgggcacctgtaatcccagctactcgggaagctgaggcacagaattgcttgaacccaggaggcggaggttgcagtgagccgagatcatgccactgcactccagcctgcgtgacagagcaagactctgtctcaggaaaaaaaaaaaaaaaagaacatgctcctacgaaaacgcaatggggaagactcttagaaactagaaataataggccttgcatggtggctcacaygtgtaatcccagtgctttgggtggctgaggcaggcagatcacttgaggtcaggagttcaagaccagtctggagaacatggtgaaaccccatctctttgcctaggcaacagagcaacactctgtctcaagaaaaaaaaagaaactacaaataatagtaaattaagagacaggatgagaaatgtcaaagaagtctcctaaaaggagaataaaaaagagcaagagatgaaaaccagctgggcgcggtggctcacgcctgtaatcccagcactttgggaggctgaggtgggcggatcacctgag

SEQ ID NO: 34762 - DNA, 601 bp, Human
ataattccattgatctgaaatgtccacaacaggcaaatcaatagagacagaaagcagattagtagttaccaggggctgggagcatgggagggaatggggagaatgactcctgatggggatagggtttccttttggggaaatgaaaattttctggaactagacagaggtggtggctgcacaatattatgaacgtacaaaatgttactgagctgctcactttaaatggatgacttgtgttacatgaactgtatctgaataaagctgttattctttaaaaaacatccttagaggccgggcccgrtggctcacgcctgtaatcccagcactttgggaggccgaggcaggtggatcacgaggtcaggagatcgagaccatcctggctaacacggtgaaacctcatctctactaaaaatacaaaaaattagccgggcatggtggcgggcgcctgtagtcccagctactcgcgaggctgaggcaggagaatggtgtcaacccaggaggcggagctagcagtgagccgagatcgcgccactgcactccagcctgggtgacgagcaagactccgtctcaaaataaataaagaaataaataaaataaacat

SEQ ID NO: 34763 - DNA, 601 bp, Human
gcgcagtggctcacgcctctaatcccagtcacagctcactgcagcctggatctcctgtgctcaagtgatcctcccacctcagcctctagggtagctgggatcacaagagcacaacaccatgcctggctaattttttcattttttgtagagatgagggtctcactatgttgcccaggcttgtctagaacttgagcccaggcttgggctcaagcaatcctcccacctaagcctcccaaagtgctgacattataggcatgagccaccacgcccggtcctgattcaacattcctcacagctacargtttccacagattacatgtcagccacacagcgtataattccattgatctgaaatgtccacaacaggcaaatcaatagagacagaaagcagattagtagttaccaggggctgggagcatgggagggaatggggagaatgactcctgatggggatagggtttccttttggggaaatgaaaattttctggaactagacagaggtggtggctgcacaatattatgaacgtacaaaatgttactgagctgctcactttaaatggatgacttgtgttacatgaactgtatctgaataaagctgtta

SEQ ID NO: 34764 - DNA, 601 bp, Human
ggtgcttgggacagtcaccccaggcatgcctcacttacctgtgggggcgaggccgagcgcccacgctcgcctggggggctggaggcagcagggtctccaaggaggctgccagtgctctgtggctggcacagcttcctgcgaaggagaggcagggctaggtcagaaggtgctgagggggcctaggggccccaggcctgtatccacatgggggcccggtggagatgcctcaaggaagggacccccctcctcccaaatccagagcagggccaaggggtcacaggagcctgggcctgaggccatyctgcccccgacttcacccaaaggaggacttccccactcactgtccccctgagcccagaggaggatcactttgtgtaggtgcctgctaccggagagaccagggacacacgctagggtgctggaccctgcttttaaagacagctgttcatcctgttcagaacgctcactgcagaaactgtccaaaatgcagaagagaacggagggccctggcctaggatgagacagccttcctggaagcccaggtcacagcaggatctggagggcggcagagtggccaccagcttgactaggtgatgcagct

SEQ ID NO: 34765 - DNA, 601 bp, Human
aggcctgtcttggcacctaggcactgggcatccaaggaagggacacagcccagagtggtctgtggaccctggagccgggccaagggtctcaaatggcagatcctgccatttgatcgtggcccaggtctggctgtggggtgtgggtgtgtcctgggaatcaggagtcctgccctgagcatggccctggtcagagaggctgcccagggagtaaggccaccttctccccgtcggcccccacatgcagtcccacgggaggtgggaagcccagcacgaggcagggctgacccaaccccgaaagtcytccttcctatccagtaagacccagccacagttgtgaggacctgctctccagccacagcaggggacggggcatggccctctgagcaacgcaaagctataatgaaagaagggctcccaccctcatcccaggaatcccctgactcagcctcctccccagagacacaacccaaaagcacagcaggtgacaccacctgggctgccctgggccagctggcgccgagagcgaagtggccatctgcaactggccgccatcgccacatgggaccactgcagcccctgtcgcacatggtggtggaacagc

SEQ ID NO: 34766 - DNA, 601 bp, Human
tagagatgacagcccctgggccggggatgaactgcctaggggccaacacgcaccaggccagacaggaaaccaccttgagtccccaggcctgtcttggcacctaggcactgggcatccaaggaagggacacagcccagagtggtctgtggaccctggagccgggccaagggtctcaaatggcagatcctgccatttgatcgtggcccaggtctggctgtggggtgtgggtgtgtcctgggaatcaggagtcctgccctgagcatggccctggtcagagaggctgcccagggagtaaggccaycttctccccgtcggcccccacatgcagtcccacgggaggtgggaagcccagcacgaggcagggctgacccaaccccgaaagtcttccttcctatccagtaagacccagccacagttgtgaggacctgctctccagccacagcaggggacggggcatggccctctgagcaacgcaaagctataatgaaagaagggctcccaccctcatcccaggaatcccctgactcagcctcctccccagagacacaacccaaaagcacagcaggtgacaccacctgggctgccctgggccagctggcgc

SEQ ID NO: 34767 - DNA, 601 bp, Human
aggaagtgagaggcaaggcgcagctgcgaaggccaagcccatgctcccgccacgcagtggactccgtgggtattctacaacagataactgccatgtgtcaggctggtcaacattacctcatttgacatgccccaagatcttcaccagctaggatgacaaacggggaaatcaaggctcagggtcagctcaacctggtaccagtgggaccttcaaagtccagcccttggcaaacctcagcggcccccgactcctactcaagctctggctgtgtggggccggccaagctggtccctgcttcggsgccccggagaacacccccacagcagctcctctccccatctctccccttcacagcccacgtctctctacttgcttgtcctgggcacgggcacaggacagctaagacatgccctgcacaagtaccaccttcaggactctggtaacatggaccaccagcaccaggctcagcttctggtgcctccactgtccttttcttggtgcttgggacatctacccctgctttgcattttctcacctgtggtagagatgacagcccctgggccggggatgaactgcctaggggccaacacgcaccaggcca

SEQ ID NO: 34768 - DNA, 601 bp, Human
tttgctgagccctctctctcagtgtaacacacctgggctgaccacagcagcttctctgctgccaaattcccaaaagtggacgaagctcactccccacaaagtttctaacactccccactttgggccagacactgtcttccatatcaccaccacccccacctgggttgtctttaagaggctgtggccttcccagggacgcaactcaatgggcatgtattgaatgggtctgaccctggtccgggccagaaggaagtgagaggcaaggcgcagctgcgaaggccaagcccatgctcccgccacrcagtggactccgtgggtattctacaacagataactgccatgtgtcaggctggtcaacattacctcatttgacatgccccaagatcttcaccagctaggatgacaaacggggaaatcaaggctcagggtcagctcaacctggtaccagtgggaccttcaaagtccagcccttggcaaacctcagcggcccccgactcctactcaagctctggctgtgtggggccggccaagctggtccctgcttcggggccccggagaacacccccacagcagctcctctccccatctctccccttcacag

SEQ ID NO: 34769 - DNA, 601 bp, Human
cagatgtatcctcaatacactttttttttttttttagagacagggtcttgctctgccacccaggctggagttgcaatggtgcgatcatggctcactacaaccttgaactcctgggctcaagtgatcctcttgcctcagcctcccaagtaggtgagactacaggcatatgccaccatgcccagctaattacaaaatttttttgtagagatggggtctcactgtgttgcccaggctggtctgaaactcctgacctcaagcaatcctcctgaactggcctttcaaagcgttgggattaaaggcrtgaaccaccacacctggcgaattttttttttttttttttactttttagtagagatgaggaggcttgcctatatcgcctaggctggtcttgaactcctggacttaagtgatcctcttgacttggcctctcaacatgctgggattataggcggaaccactgtgcctggccctagtgcacattttcaggggccctctgcactatcccctgagagagcaggagtctgcgatctccagtttgctgagccctctctctcagtgtaacacacctgggctgaccacagcagcttctctgctgccaaat

SEQ ID NO: 34770 - DNA, 601 bp, Human
atcctggctccaccggcggcctggcctctcgggtgattccctggattatgagggggcctggcccagaagaggctgctatgtttggaattcacatactcagacttgcagtggcttctacctctgataacctgcagtgctgggggagggggtctgaacccagaaaagggaggcctggcctgcagggcccagacaaacactcacagcaagtagtcaggcgtctccgacgtggacgtgggaacactggaaacgctgcaggttccgtttaaacctacgagagcaaacacatacctcctgagtctgygcccatggcaccggtcggcaggaagcacgccaggatggggacatgcatgaaaactgtacactttgctgctggagggacatagagggatagcagaggggatgactgtgtggcaggtgcaagggctgagcccctcgcacctggcaactgtgggctgctggacctgggcgtgccctccaggtggtgagcagagctcagcgtgcacctgcgtgtccagggcaaagccctgcaggacacagagcacccaggcatcaccacagtcacattcttggcaaacagcggacaggtcagggaactgcaggg

SEQ ID NO: 34771 - DNA, 601 bp, Human
tgagtcgtcgtctttggaaggcaaaggggccttggccaggagagaccccggcatctgattaatcagggcccagccctgtagtcaggtcaccagttccgaaaggtggcaggtggggcggctacgtccaaggctaggctaagggtggagactctctgtatacacagggcagctgaatgagctgtgagctcaagccaggggaccacaggagtcctgattcccaggaccacagggacctgtcacctccccctgctatagttgtggcagcatggatgggccccagggtgctggacagagctcagcygcggagtctcctgagggtttggcacaggtaccaagagccctgtgtcctaggctgtgagaggaccccaggcgctcaaacatgtggggatccatgtaccccggctcgcccccatccaaggaggtgggtcacagctgtccccactgcaaaggaggctgacaagctgggctgccttcaaggactcccacaacaggaccccagggccgggccagaaccatggggttgctgcatggagtgcaccagggggagaagcgctgcctggggaagggccagactctggggccaccaacaggccctggctcg

SEQ ID NO: 34772 - DNA, 601 bp, Human
accagctggagttctcaaaatagccacctgggccaccctgtttgcttgctggagcagagaccctgcccgaggaggagaggctggggaaaggggtgcctaaacgtagagccagagaccagcagaggccacctgcccattccccacgccctcagaacgcagctgcacctttcgacgacctctgtaatactgcaggcaggacccagggcagcggctagaccctgggtgtccgaggagagggaggcacaggtttagaaaaaagattttgcttctcttttgtacaaaaatagactcaagtctcatyagcagtagctaaaagtggctgtctttgtataaaactagaaaaggcaggcgcgccaccccaagggcctaggagtcttctggcgagacaggaggctgaaccccggaggctgcagccagggaggaggcagtgggcttcctggggagcccatcataagcagggactgctcaggaagcgcagggagggccgaggtgggcttgcagccacccgccagggccagacgtctgcaggggctgccctgaaagccggcggtgctggctcagatgagcatcttcctcgggtttatttttttaaataaatcct

SEQ ID NO: 34773 - DNA, 601 bp, Human
aggccagcagcatcgagaccacaaggtctcaacagtgtggaatgagcagcagcagcaacaaatgggaaaccgaggacatcgcaaagaaaagtctgacgccgctgcggccgagtctcaacttggagcacagaaacacagtggcccccgacagctgagggcctgaaatagcagggcaggcctgggggcgctgaaagccctctgcccccttggctctgagcagctgtctgggggcaccagctggagttctcaaaatagccacctgggccaccctgtttgcttgctggagcagagaccctgcccraggaggagaggctggggaaaggggtgcctaaacgtagagccagagaccagcagaggccacctgcccattccccacgccctcagaacgcagctgcacctttcgacgacctctgtaatactgcaggcaggacccagggcagcggctagaccctgggtgtccgaggagagggaggcacaggtttagaaaaaagattttgcttctcttttgtacaaaaatagactcaagtctcattagcagtagctaaaagtggctgtctttgtataaaactagaaaaggcaggcgcgccaccccaagggccta

SEQ ID NO: 34774 - DNA, 601 bp, Human
taaaaaaggaatgaaaatagggagtatggggaatgagagaggggaagggaagagtcaggctgacagggaagaagagatgctgattcaagctgtctgatcaaactaaaagggacttaatttagaaatgaaaattatttcttctcaattcatgattcaggtgaaccagtttggttttaacaaagaaaaaacaaggaaaaaatatttgctaatgttaacagccctctcacaggctccttttcatctgttcagtaactggagactctttccaacatggtctttagagctttctagagatacgacygtgactttgttggtcttcacgcactgggtgtgtctgtaaatacagcgctgtccacggtgtctgtcctgcttccatcccaaattcaggctttagcttaaaacatctttagtttaattttttaaaaaattcttttctttcccccagataaaatcttaatcttttgcactagactgttagccagggaaaacaaagcaagaaaccagtgtctggaaccgaacaggaacagaacaagagcatggttctccttaaatacatacatttaaatacattcaatctgacatgggtatgaaatttgcctgt

SEQ ID NO: 34775 - DNA, 601 bp, Human
ttctttcccccagataaaatcttaatcttttgcactagactgttagccagggaaaacaaagcaagaaaccagtgtctggaaccgaacaggaacagaacaagagcatggttctccttaaatacatacatttaaatacattcaatctgacatgggtatgaaatttgcctgtcaacatttacttttgcaggagagatctaagttgcactaaggtgaatgcagtgaacagactgagcgactgtctggatgcgagcttcagactgtcaagagaagaggcagctcctcctgccacagccgagtggaygccaccctgggaaccagggccaggcctgtctgctctagcagaaccggctggcaggtcagttgggttgaaacaaatagacacagctctccagactggaagtgttttgagcaagtgagcccggtcagctgaagaagcaactggcttcagcagtgtcagcaatatttctgtaggaaaacagataaaaagttgtgaaacatctttgaggttttgaaaaaaacatcataaagcccaccacaaaaacatcaaaattcctgactgttttcaataaagcaaatcacagaggccgcatctggatgagta

SEQ ID NO: 34776 - DNA, 601 bp, Human
tgttcaacaaatagaaccaagttaccaataacaattctggaaaagagcagggcacagtggctcacgcctgtaatcccagcacttcgggaggccgaggcaggcggatcatttgaggtcaggagtttgagagcagcctggccaacatggtgagaccctgtctctactaaaaatacaaaaattagctgggtgtggtggcatgggcctgtaatccagctacttgggaagtggaggcaggagattcgcttgaacctgggagacagaggctgcagtgagctaagatcgcgccactgcactctagccwggtcgacacagagtccgtctcaaaaaaaaaaaaaattctggaaaaagctccttgattcataacagcagcagagcttattacggaaacacgggatgatgactgaacccctgtcaatgtgcacataagtagcacagtgacaaatccaagtaacttccggttatttctgatgaatgaaaagggatatcctatacagattattctctaaagcaaatgagtctctatgacggactgttctctggccttaacaatcagcatgaagaaagtgcaggtggatgaggcagattcaagagggggactaga

SEQ ID NO: 34777 - DNA, 601 bp, Human
attttgggtttaaagggcccccatgggccaccaggatgcacgtgaaggtgaacccctggtcctgccagcctgccgtgtggcccgcaccacagggctggttgcaggcctacccctaaacccccagccgggcactttctaccttgattggtctgggtcaccagttctctaagtcttcagactagctggtagccctgcataaattatctcatcctctgagattcagtctcatctgaaatggtggggaaccttaaatacctacgaagggcctggcactatccctggtaaattcgaggccaaaagrttcattcccttccctcgctctgggaggttcctccctcctgagatgaagaatcccaatgcctgaggctgaggatgcttccaaaaatgtagctgaatatttactgtctgtccacattgtttatcaatatctttcttgtcccttcaagatctaaatagagaagggagtggcaccaaagaagaaaattatccattgttggccttctccaatgttacctgcataaaaccccttagaaaaatctcacaagccctcagtgttccctttagggaagtggcaggagggtgcaggggttaagaatgcata

SEQ ID NO: 34778 - DNA, 601 bp, Human
agccgggcactttctaccttgattggtctgggtcaccagttctctaagtcttcagactagctggtagccctgcataaattatctcatcctctgagattcagtctcatctgaaatggtggggaaccttaaatacctacgaagggcctggcactatccctggtaaattcgaggccaaaagattcattcccttccctcgctctgggaggttcctccctcctgagatgaagaatcccaatgcctgaggctgaggatgcttccaaaaatgtagctgaatatttactgtctgtccacattgtttatsaatatctttcttgtcccttcaagatctaaatagagaagggagtggcaccaaagaagaaaattatccattgttggccttctccaatgttacctgcataaaaccccttagaaaaatctcacaagccctcagtgttccctttagggaagtggcaggagggtgcaggggttaagaatgcatatttggggtcagccggcctggatttacttcccagtgttgtaagaccttgatcgagtcattaaactctcaaaacagtagctctaccagacagttgtggtgtggtttaaatgagggaatctaaac

SEQ ID NO: 34779 - DNA, 601 bp, Human
tgctaatagaataatgatttttgtaggaagacacactgcagttgtgccttggggcttccaaattaaccatgggattcaaatggtttaaaatcatgcagaagtttcaaaacaatctggattgttaaaaatacatcaaataaaaatgcatcaattcattgctgagcagactggactaagatcgtattacactagactatctcagtagcccttactttgtacgcttttcctcagcaagcaaattaggagtcattagtggcccatttttgcaggaaataaaacatcaaccctacatttctccatygaagaaataaaagcatagatatctctctataaacacacgcatatattttaagagatagggtcttgatctgttacccaggctggagtgcagtggtacaatcttagctcactgcagcctcaaactcttgggctcaatagatcctccagcctcaatttcccaagtagctggaattataagcacctgccaccatgcctagctaatttaaactttttttttttttttcagagacagagtcttactatgttgcccagactggtcttgaattcctggcttcaagccatcttcccacttcagcctcct

SEQ ID NO: 34780 - DNA, 601 bp, Human
ttacttgtgtgaactactgaggatcagtggtagagtggtcagcattttgggcctttaaaaacaagatcttctgtaaataccatggtacaattattaacctctacttttacctctgaatcagccacagatttttggattccaggctggctactgctatctcaaatgctttgagtctctctgccatctagtgaagttaggaacagaatcattttgatgttgttcaacgcaaaacaattattttaaaaaatcattgccttcacgttccaaagtaaaaagaatagtttttggattatctgtgtckgtctctttgcataaatgaaggatcatttcaaactaactggatggcaggtagtttggcctttgcttttcatctggttttacacttagaaataaatccattattaaactataatcctctagccgggcacggtagtatgtgcctataatcccagctacccaggaggctgaggtgggaggactgcttgagccgggagacggatgttgcagtgagccaagatagtgccactgcgctccagcctaggtgacagagtgagactctctatcaaacaaaacaaaacccccccaaacgataacccccaaa

SEQ ID NO: 34781 - DNA, 601 bp, Human
atttttggattccaggctggctactgctatctcaaatgctttgagtctctctgccatctagtgaagttaggaacagaatcattttgatgttgttcaacgcaaaacaattattttaaaaaatcattgccttcacgttccaaagtaaaaagaatagtttttggattatctgtgtcggtctctttgcataaatgaaggatcatttcaaactaactggatggcaggtagtttggcctttgcttttcatctggttttacacttagaaataaatccattattaaactataatcctctagccgggcayggtagtatgtgcctataatcccagctacccaggaggctgaggtgggaggactgcttgagccgggagacggatgttgcagtgagccaagatagtgccactgcgctccagcctaggtgacagagtgagactctctatcaaacaaaacaaaacccccccaaacgataacccccaaatagagctattttaaaagtacactcactatttcatctttagagattcattttagatactggtgaattcctcaagagaaaaatgtcaatgataagaaagttacaaaatattttaaaagctcctcaagca

SEQ ID NO: 34782 - DNA, 601 bp, Human
attaactgaacatgacatgcacacaaatattaatgttcatgacattacacacttggtatctcttaagactgacattaaacaacaaatcaatatgaagaggactaaaaggtctcccactgtagtttctatacagtacttctcaagaattacctattcattaatgatctggtataatctgtaaagtatttttcaaaagtcgcagaatgtctatatttaaatttatagaggtctttttacattttgtatctattgatttgtttgagtcagactcagaggctttcaaatatataaacatatatgmacttgtagacattgacataaacatagatccatacacgctcgcacacaagatagacacagtctatgcacacacacttacttcggtcattcttaaagtaagacctgcactcagagaaaaggaggtacctgagctgagagcctggaaggtactgtgctggacttggggactcctcacaggccccaactgtcctcccaggtttcctatcattccctggttagccagattcatctgggagccatgcaaagagctgtgagagaggagctgtgacccaacactgggggacactggggagaaaggact

SEQ ID NO: 34783 - DNA, 601 bp, Human
gaggactaaaaggtctcccactgtagtttctatacagtacttctcaagaattacctattcattaatgatctggtataatctgtaaagtatttttcaaaagtcgcagaatgtctatatttaaatttatagaggtctttttacattttgtatctattgatttgtttgagtcagactcagaggctttcaaatatataaacatatatgaacttgtagacattgacataaacatagatccatacacgctcgcacacaagatagacacagtctatgcacacacacttacttcggtcattcttaaagtaagacctgcactcagagaaaaggaggtacctgagctgagagcctggaaggtactgtgctggacttggggactcctcacaggccccaactgtcctcccaggtttcctatcattccctggttagccagattcatctgggagccatgcaaagagctgtgagagaggagctgtgacccaacactgggggacactggggagaaaggactggtgaaaggtggtggggatctaagtccagtaccgtagtttggaggaaatggaaactgctgtgcatttgcctggggaatccgagggttgctcatagt

SEQ ID NO: 34784 - DNA, 601 bp, Human
ggccgagaagcactgttaccaatcattcctgcatgcaagccaaagaaaactgagagatgcagtaactgaaaacatatttagcatgtatgaacaccagatgatcttaccctacaaaacaatcattctgtaattcacacttagccaatagctaatgttctcattgggcagatgtgggaccttggctaagaaataacaattggcaatcactacatagttttcataacatggacctgccgctctttatagtttagaaaagctattaaaattgttcccatttgtacttagaaacaggtgccgtggygtgtggataaccccaacttccttcctcaggaagtgaatcacattagctgatatacacgtcaatgctttactttccaaaagggaggtagaggccaagaggaataaggtaaaaactgataatcaatactctcattataaacgataatcatagaagatatcttgaagtctatatgagactttatcctcaagtctccttcagggtatacttcaaaactgaccaagagtagcctctaagcaatggagaacttatagatctttctgatatttactgtagttcttcatagccaaggcaagggagttc

SEQ ID NO: 34785 - DNA, 601 bp, Human
tttcataacatggacctgccgctctttatagtttagaaaagctattaaaattgttcccatttgtacttagaaacaggtgccgtggtgtgtggataaccccaacttccttcctcaggaagtgaatcacattagctgatatacacgtcaatgctttactttccaaaagggaggtagaggccaagaggaataaggtaaaaactgataatcaatactctcattataaacgataatcatagaagatatcttgaagtctatatgagactttatcctcaagtctccttcagggtatacttcaaaactsaccaagagtagcctctaagcaatggagaacttatagatctttctgatatttactgtagttcttcatagccaaggcaagggagttccttgccttgtatccactgtattcctgactatacagacctagaatgggttaggacagatttgtaaaaatcccttcctttttgaggtgttaacagttatctgaccacacataagagcgtaacgctgctaagcaggactgtgtttgctctgtcctgtcctggcccccaggatgctgataatggccaaacatttgctaagacttgatattctaaaggga

SEQ ID NO: 34786 - DNA, 601 bp, Human
gagtagccgggattacaggtgcacgccaccacgcccatttaatttttgtatttttagtggagatgaggtttcaccatgttggtcgggatggtctcgaactcctgaccttgtcatccacccgccttggcctcccaaagtgctgggattacaggcatgagccaccatgcctggcctagtctgtgtttttttaaacagcgtgagagtattgtatgatcttcacaggctggacaccagtgctctcttggctgctcggattttaatacaggcctattctcaaattcctgcagaagattcctacaakaactcatatcttcttgtattctgctggtaagccttaataaatcatggctcctttttctcttatagaactttatataaatcaatattttatttatcttaaattttaaattaatctttgtttactgaatatttaatgaaatgaatatgactatataattagtgaagcagtcagtgcatgacatatgtggcaggcacccaataaatatttgctgaaggaaaaagttaccttaatacagcacagttcacagttgccatgaattccttataaacaatagaaagttaaaaatctacttcttcccct

SEQ ID NO: 34787 - DNA, 601 bp, Human
tctttaaattctagacatatttggatttgatatgatttttatagctagttgacaagaatttattgtgtactaagcactagaccagcatcacactgacaacctataatttgttaacgctattaaatttaatactaagatattacaaattatagtaacttattacataacatcaagtactttattttcctgaattatataaacatagtctgaaatagcacatttaaaagaaaaagttcttaaccatcaatgatagaaataaaatattttaaaaaattagggctgagaatggaaattatgtgcrtgcttaatcatgacttcctcaggtttggttatcaggttgccatcaataatctgaataccaccaggagctacagaaagaggagaaaccataaattctacacagtccttcataacctcccctagggctaatgagcatggactgtctagtgtgtctgtttttttttttgagactgagtttcactcttgttgtccacggtggagtgcaatggcatgatctcagctcactgcaacctccaccttccgggttcaagcaattctcctgcctcagcctcccgagtagctgggattacaggcgcccacc

SEQ ID NO: 34788 - DNA, 601 bp, Human
ctgggattacaggcgcccaccatcatgcccagcaaattttttgtagtagagatggggtttcaccatgttggccaggctggtcttgaactcctgacctcaggtgatcgacctgcctcagcctccccaagtgctgggattacaggcacgtgcgactgcgcccagcctgtctagtgtgtttcttacccaattctcaactcttttgacttcgtgatctcccatgatccacaattaactctccattgcccaagaaagagtgaggtttgagaggtcacatgcaaatctttcgcgcgcgcgcgcgcgygtgtgtgtgtgtgtgtgtgttctgagatggagttttgctctgtcgcccaggctggagtacagcggcgcaatctcggaccactgcaacctccgcctcccgggttcaaccaattctcctgcctcggcctcccgagtagctggaattacaggcacccaccaccacgcccggcccaaactcatctgtcttttgtttttcctatttcagaatggtcagaaatcacttgagaaaagacctagcaatgaaagatgttctatgatttgactgatggttgccatttttgatctgagaacaaatgccagg

SEQ ID NO: 34789 - DNA, 601 bp, Human
ggtgtaatctaggctcactgcaacctccgcctcccaggttcaagcaattctcctgcctcagcctccccaacagctggaactacaggtgtgcacaaccacacctggctcattttcgcatttttagtagaaatggggtttcaccatgttggctaggctggtcttgaactcccaacctcagatgatctgcctgccttggcttcccaaagtgttgggattacaggtgtgagccatcgcgcccggcctaaatacatttttcttaagaaagccattcaggatcttcttagtatcaaaaggaactagytctatgaaggcttaaaactatgaacactatttgaattcattcaagcttggcatctgaaaaatgcactatgaagttttcccaactagagataatattgctttgcctgtgtttattccttgtcaatttatggagtacacatttaacattaattgtcgtaagttcactttacatgttcttcttcaaggagataaagttcagaatatctatacccctcaggttaacagtaacatttgatgactacagaatttttttttttctgtattcatgtaagttttggaaggaataaatttgatcacatta

SEQ ID NO: 34790 - DNA, 601 bp, Human
gttagccgggaagagtaagttcaagagatctattgtacaacactgtggctacagttagtaacaatgtattatatgcctgaaaatcactaatagattttaagtgtttgtaccccaaaaagtatgtgaggtaatgtatttgttaattagcttggtctagccattccaggatatggatttcaaaacaacatgttgtataccataaatatatacaattttaatttgtcaagtataaataagtattattttgaatatcacttaaggtatcctggattttttcagggaacttatttttcagacaatragagcacataatgtagcctattattctagttttgaatttacataccatggctcagacgtactaatatcagttcaatctttctttctcctttctactatccctttccctcttaaatattttttataccagtggtctaagaaattcttttgcattaatcagaagtttagttaagaataaagagaggtagaacgaccttcattgggtttcaaaaccagttaaactctgatcttaaaaagagagaaaggtaaataagaaataattcaattacgtctgttctgacaaagcccagtttcaaggaag

SEQ ID NO: 34791 - DNA, 601 bp, Human
tttgtttacacagtgtctgtggctgcttttgcactacaatggtggatttgaatggctgtgacagagactatatggcctgcaaagcctaaaatacttacatttggtcctcacaaaaaaaggcctgcccacctatgttctataacaatgtcactctgctaggagagtatttgaaacacacagcttcagcgagattttcaagataagaacaacaaaggagaaagcttatttttatccaatcacctgagacttcaaaatgcccctatggagaaaatccttgatggatacagattagtacacctgygagaagatgtgataaaacttacctggtcaccaggctcaaagctcatctcctccttctcagttttcattgctattaattttgtgttactggcaggatctgtcttactgtccagtctctcaagtttgggggttatttctggtaaaccaatatctttagtatcatctttatctagcaaatagcgaagtagtgcattctctttcttcttggggctcaccggctcttgtttaatagtcacttctgatccaggagctgtgctgctggactcctggctcaggtctttgcctgtggcttctgctgtta

SEQ ID NO: 34792 - DNA, 601 bp, Human
ttgcaagttctatgagctttaatttacagccttggcagtcacttttgagttaccaaatgtgttcacaaatccaaataaaacaggtttcacaaattgtcaaacatcagcttttcgttaggtgggtgaaatttgccacatctgtaatcactttcaaattgtttcagtttgaggttagatttattaacagttggcaaacagagttgcctgatttttttactcctaaacagtgaattgagaaatgtgataaaatggaactcctcagccagagcaacgttatatatttactgataggacctcatawagttttccacagcataagcataaatatttagataactaatgaaatttaatcattttcctaaatatgtgctctaagacaatatggcttatgacatttatttaaaaatcaatattcaatttctttatcttcacttttttatgaaaatgtttattacccttcaatttaaggtctaatgttgagaagttaatttgaaccagagaacaaaaatctaaaatattatttgtaaatatatacatagaaagttctagatttaggctaggcgtggtagtccacacctgtaattccagcaatttgggaggc

SEQ ID NO: 34793 - DNA, 601 bp, Human
gccagagcaacgttatatatttactgataggacctcatatagttttccacagcataagcataaatatttagataactaatgaaatttaatcattttcctaaatatgtgctctaagacaatatggcttatgacatttatttaaaaatcaatattcaatttctttatcttcacttttttatgaaaatgtttattacccttcaatttaaggtctaatgttgagaagttaatttgaaccagagaacaaaaatctaaaatattatttgtaaatatatacatagaaagttctagatttaggctaggygtggtagtccacacctgtaattccagcaatttgggaggccaaggtggaaggatcactcaaggctggcgcatgcctgtaatcacagctactcaggaggtggaggcacaagaattgcctgaacccaagaggcagaggttgcagtgagctgagatcgcgccactgcactccagtctgggagacagagcaagactctgcctcaaaacaaaacaaaaaacaaaacaaaacaaaaaaaccaaacagttctacatttaaacacacaggagcagaaatcatactagtgacatcaatattcctgccctg

SEQ ID NO: 34794 - DNA, 601 bp, Human
gagagtcagtcatttcacttgcctgaacctcctcgtccccttgtccagagtgagagacgtgatgttcacatcacaggcttgctgtgagggccagtgagaggaggcaaaagggataatgccacacaaagaccaggtgctcaataagggctgctgttattactgaagtcttgggctcagttccagctgtcctattgcttaagtctgtgagctgagacaagtcgtgtcaacttttgggccctctagaaacacctggatagtctttgttggttaccaccttgaagaagggcttggggtcccactrttaccttcaccaggggttcactcactctccaaaattccacttactcttatattcagattctaactgaatcgttaatatttcttttcattagatggtacttataatcttgtcacatatctagaagcccctggatcaaagaaaatgacctcttcctccttttgcctgcctctgtgacactatcatctcctgttctactttcatcactcttctgtcctacaggttctcctgttaaattttcctttagatggcaacactggggccagatgagacagctcacgagaacagtcaccagctctgttc

SEQ ID NO: 34795 - DNA, 601 bp, Human
gtgaactccaggaatcattgacagaaagctcccacaggaagcaataatttaagaaaaatcatttagagatgcttaccttcatgatgatgcctcttagcataggacacagattctccttcatgctgcgcatggaacttctgaatacaccttcttaccaggtcctcccagcctggtttcatggctgctctcatggtgctggtatccagagacgtgatcttgcctattaagtaacagcaggcattatacctacatgttgatctattctttatggaaataattttttttttttttttttttttttagacagagtctcactctatcgtccaggctggagtgcagtggtgcgatctcagctcactgcaacctctacctcctggggtcaaacgactcttgtgaatcagatgcccaagtagctgggattacaggcgtgtaccaccacatttggctaatttttgtatttttaatacagatgaggttttgccatgttggccaggctggctttgaactcctgacctcaagtgatcctcctgcctcagccacccaaagtgttggggttacaggtgtgagccaccgtgcccagccagaaacaattaaattttaa

SEQ ID NO: 34796 - DNA, 601 bp, Human
cttggctgttcctgaattgctctactgtagtcttttaaaactgtttcatgtattatttcttcaacaagactgaaatatccagtaatagctggtatcacaaaactaaaatgcaattatagtcctcaagaaaataacaactaaatttttgggcactacgagataaacacctttctagctactgtatgagttattaactcatttaatcctcttaacagctctatgacacacgtagtagcattatttccattttacagacaaaaagatcaaagcacaaagtttaagtaacttgtccaatgtcacrcaaaccttcggcaaagccaggattagaatctgagcatgccatggctcagaaaccctgtgcttatgctatactgtgttaacttaacatagaacgtacttttaaatgtacaaaaaatgtttataaagcacaaagtaataaattagctcagctattccttttttatactgccttggaatattatcagatggataaattagcagcacttactccgctgcataaaacaaaataaaatcatttgacctaggcaaaaaacttaattttgaaatactatgtgtttattatctctaacagctctaatat

SEQ ID NO: 34797 - DNA, 601 bp, Human
atcacaaaactaaaatgcaattatagtcctcaagaaaataacaactaaatttttgggcactacgagataaacacctttctagctactgtatgagttattaactcatttaatcctcttaacagctctatgacacacgtagtagcattatttccattttacagacaaaaagatcaaagcacaaagtttaagtaacttgtccaatgtcacgcaaaccttcggcaaagccaggattagaatctgagcatgccatggctcagaaaccctgtgcttatgctatactgtgttaacttaacatagaacrtacttttaaatgtacaaaaaatgtttataaagcacaaagtaataaattagctcagctattccttttttatactgccttggaatattatcagatggataaattagcagcacttactccgctgcataaaacaaaataaaatcatttgacctaggcaaaaaacttaattttgaaatactatgtgtttattatctctaacagctctaatatttccttctcaataaaatttaaattttaaaataagcattaaataactagcattcaatgccaaccacagttcagcatattcatttaaaccttatt

SEQ ID NO: 34798 - DNA, 601 bp, Human
ttaaagaaacatcaatcctttattacttggtgtatatgggaaagggtctcggaagtgtctctgatgtggcaaactcaccttcatggggacctcagcattgccctgaccttagaagggcactaattatgtcaaattattctatgttacttgttctccagattaagatgcaggttcctaaattacccaaataacagtagcacgcttccggtaatgagttcacagcctcactttttgttgtcatcccaacggaggtaagggaaggagataaagaatctaggatcatttcaggaagttgagatartaacagtggctgtggagcatgttcactgtgccttacaagtacctcctggaaggaatcttttatctttcccaatttacagaggaggaaactgaggctcaaagaggttaaagtctcagaactagtcagtggtagtacagcttgaatgtgaatccagaaggatcagattccaaagctcatgctttgatgaccattcagtacagtcctctactctaatattcattcacccctaatccacttcccatcatgtttaccttggtgatggaaatgttgggggtttagtttctcctggttacattaccc

SEQ ID NO: 34799 - DNA, 601 bp, Human
cactctctggccttccattgccttgttgactatggaaaattgggttaagtgtgtttttgcttttctcctggaaagggaggctgaatgttttcaagccagtgattctagaggagataagcaagggccaacactgggacatttaaagccttttggccagcaggtccagccccaggaaatgaagtttgtcatttctaaatacaaagactgggtcagatgctcttggagtctttattgtgtgccccccctccgccctgcccccaattttatggtagattttcatagaattagattttctaaaaayaaaaatccctttaagcatcaactgaaaaaaaagagataagggggactattggttatctctgttttaaaaatactaattattgtctgctgcagcaagctagctgattctacaatggcagtgctgcaaagcttctggccatgcagtcttttcaacctcatcgtatcatcagccgagcaaattatcctgagaactgacataatttatgtctcagggttcctctgtttcttgttatatattcactgacatttttttttctcatcttaccataacctacatcttgaattttaattttggaacagg

SEQ ID NO: 34800 - DNA, 601 bp, Human
ttctacaatggcagtgctgcaaagcttctggccatgcagtcttttcaacctcatcgtatcatcagccgagcaaattatcctgagaactgacataatttatgtctcagggttcctctgtttcttgttatatattcactgacatttttttttctcatcttaccataacctacatcttgaattttaattttggaacaggtacagcaaagcacttggcgtttagtactagttaataaaatagaaaaactgtactttacaaactgtagacattagctggtcataaagcttcctgaagttaataaayaacaggtagttaagaccaaccttatgcttctcttaaaagttccttttgcctattatttcagttttcttccttatgagataaataagctagtttcaaatagcataaatagaaagcataaagctcctccttggtcctcatattttaacctgtatgtataggcatttgtacatggcatgtacaaaatttaagaattttgagaacatttcaagctaaaatacaacacagaatttagtaggacttgtgaatacagtttctcaaataaatgctcaactggcaattacaacttgtcaatgtctactc

SEQ ID NO: 34801 - DNA, 601 bp, Human
atcaactctgcaagttcttctatatatttattttccctgttcacgattacgtttttcagtgttccttttggggcttaaaagaagaaacacatttttatgatgtatttgaaaaagagctattgtgaaaaaaatgaacgtgttaaacaagtttaatacaaagatagcaaacaaaagctacctatataaacacagaaatacttttgggggaaaaacacaattttccaaaagtgttccatgtttttttaaaaaaatcaacctaagcctagtttgtaatgaaactatctgttcaatgtgtttggcrtctcccactggactgtccacttcacagtgacctggactgtgctcaccactgtgcttagtgcagtacttgaaacaagtgggcaccaaattagttgacaaataaaagaatgtttcaaaaaggtaaaggaggttatattttaaaatttatttaagattagtaaaagaagagaagttaacccagttaataacaggaataaatttcaataatttttggtaaaacataaaaaataaaaccagatatttataattttatagacttcttcagaatgttagtaagcaaaccaaacagcctttttaggta

SEQ ID NO: 34802 - DNA, 601 bp, Human
ggggaaaaacacaattttccaaaagtgttccatgtttttttaaaaaaatcaacctaagcctagtttgtaatgaaactatctgttcaatgtgtttggcgtctcccactggactgtccacttcacagtgacctggactgtgctcaccactgtgcttagtgcagtacttgaaacaagtgggcaccaaattagttgacaaataaaagaatgtttcaaaaaggtaaaggaggttatattttaaaatttatttaagattagtaaaagaagagaagttaacccagttaataacaggaataaatttcartaatttttggtaaaacataaaaaataaaaccagatatttataattttatagacttcttcagaatgttagtaagcaaaccaaacagcctttttaggtaatgcaaaaagtcacaatacagctagaaacaaaagcgaaactgacccaggaaatttgttaactgtccaagctgaatgacatgcaaaatataaacaaacagtccaatttcaactaaagtttaaaaagttaatggaatggaaaaatatcaaaagaggcaaaatcttccattagaatgtgacaaaatagtaaactgaaaagttcctt

SEQ ID NO: 34803 - DNA, 601 bp, Human
ataaatacatactataatacaatgtctctattttatagtgtttatacaatttgtccaggatcaccccacgaattactggcacagtaattcagaatttggttttttttctaagtctcatttttacccgtagcttctgtttttacagcaaaaggtaaagagtggctggaatgcttagaatagcccagttcccattctgaccccctccaccaccctccacccatgccctctcaccctctcacaaggtaagaaataaatgacaaataggtgagaaaggggagttgtgttcaaaagacccctgagygccccagagggagggctcagagacctgccactacagcccacagctgaaacagttcccactttctcccactgcctccccaggtagggctcctgactattaaaggcagtctgacagacagaagtttgtggtttaccaggaagtagtagggaacctagaggagctgggggctgggatgtagagagtggagatttattgggcttgatgttttgcttggcaactagaaggggaaaagggaatataaaatactggtgttttgccctttctcctgctctgcctctcttgatgacttttcctagccct

SEQ ID NO: 34804 - DNA, 601 bp, Human
ttaaaggcagtctgacagacagaagtttgtggtttaccaggaagtagtagggaacctagaggagctgggggctgggatgtagagagtggagatttattgggcttgatgttttgcttggcaactagaaggggaaaagggaatataaaatactggtgttttgccctttctcctgctctgcctctcttgatgacttttcctagccctcttccctactatttcatgtctgatgcttttactgtccattaggtagaaggtgttgtttttatttaattcttaaaattatttatatgatttaaaacaytgaaaaagtgaaaagtctctcttctacttttggtaactatttgcccagttctcatccaccgaaacaggtagcaacaattattgtttcttgattatcctaaaacaatacacattcttttttcttccttgtttatacagatggcaatattccaaaaacattttctaaaccttgctttttgtctgtaacaatattcttaagagatttttttttcatattaacccataaagagcatcctcatctttatcctagctgaactgtgttccaggttctagatgtaccacagctgtttaacagacattt

SEQ ID NO: 34805 - DNA, 601 bp, Human
tacctgtagttgaagctgctcaggaggccaaggcaggaggatcccttgagcccaggagttcaaggccagcctgggcaacatagatatataaataaagaaaataaaaaaatagcttttctctctctaggaggagactttggtgctttaaccactgtcttctcctcagccctgcactttacttagggttaattcgtttttttctctactgctttatcacaaacatgacacttagcaccagaagttgtcaaatccgctgctgctctgtggccctgtgagtgagccacgccactcctgtagtcascagttgttcatcagttaccgtgtgccacgcatgttgctaggagctggggctgcagcactgaatagaaaaaggaagaagaaaagaccccaagagactgtgtctctgaccttgtagaactgacattcagtctactgatttaagtatccagaagtcacttaaacattgaacttggatttctgcagttgtaaaatggaattgatggtaactgtctcacctaagttgccttcccctgagcccaagactcaaataaggtgtttgtaacagtctctgtaatgatagaatgcctctatgaaatgttga

SEQ ID NO: 34806 - DNA, 601 bp, Human
ccaggagttcaaggccagcctgggcaacatagatatataaataaagaaaataaaaaaatagcttttctctctctaggaggagactttggtgctttaaccactgtcttctcctcagccctgcactttacttagggttaattcgtttttttctctactgctttatcacaaacatgacacttagcaccagaagttgtcaaatccgctgctgctctgtggccctgtgagtgagccacgccactcctgtagtcaccagttgttcatcagttaccgtgtgccacgcatgttgctaggagctggggcygcagcactgaatagaaaaaggaagaagaaaagaccccaagagactgtgtctctgaccttgtagaactgacattcagtctactgatttaagtatccagaagtcacttaaacattgaacttggatttctgcagttgtaaaatggaattgatggtaactgtctcacctaagttgccttcccctgagcccaagactcaaataaggtgtttgtaacagtctctgtaatgatagaatgcctctatgaaatgttgattactgtttgcacccagaggtggtctcctggcctctgcaggctctccatgg

SEQ ID NO: 34807 - DNA, 601 bp, Human
cctgtagtcaccagttgttcatcagttaccgtgtgccacgcatgttgctaggagctggggctgcagcactgaatagaaaaaggaagaagaaaagaccccaagagactgtgtctctgaccttgtagaactgacattcagtctactgatttaagtatccagaagtcacttaaacattgaacttggatttctgcagttgtaaaatggaattgatggtaactgtctcacctaagttgccttcccctgagcccaagactcaaataaggtgtttgtaacagtctctgtaatgatagaatgcctctaygaaatgttgattactgtttgcacccagaggtggtctcctggcctctgcaggctctccatggagcgtgctggcctgggaagaagaccacttcacccaggcgggctcctttcagcccttgtgctccagaggtgcgtgcttgcagtctgatgacttccttggtgggagacacgagggatgactcttgtattttgggatgaatcctgttggtacaagtcatctcagagtgtgtggccaccaagaaatgttccctgcctttggctccatgatactctaaactgtatttagagtattcaggacaag

SEQ ID NO: 34808 - DNA, 601 bp, Human
ttgaacttggatttctgcagttgtaaaatggaattgatggtaactgtctcacctaagttgccttcccctgagcccaagactcaaataaggtgtttgtaacagtctctgtaatgatagaatgcctctatgaaatgttgattactgtttgcacccagaggtggtctcctggcctctgcaggctctccatggagcgtgctggcctgggaagaagaccacttcacccaggcgggctcctttcagcccttgtgctccagaggtgcgtgcttgcagtctgatgacttccttggtgggagacacgagrgatgactcttgtattttgggatgaatcctgttggtacaagtcatctcagagtgtgtggccaccaagaaatgttccctgcctttggctccatgatactctaaactgtatttagagtattcaggacaaggaccatgaagtgaaagtctatggaaaagggtttgtctcacttctgaacctttggttgtagatatagaaacatgacaaattagccaaattgaaaacatttgacctgaaatatcccagtactgaaacacaaagggatttttttttttttttttttttttttttttgcattttctg

SEQ ID NO: 34809 - DNA, 601 bp, Human
agctgtgagagggggctacagtggtgtcatctgaacacttgttgtaatgcccgtcttacaaggttatttgaggtttacataagttaacgtctataaagagctcagcataatacccggcacgtggcaagtatccagtgtgctaagttctgctaagttaacactgttattccactcaccgaggcagccttttcagtgcactctgagcagcagaggccggcctgtccaggcctgggctgtttataccgaagcatagctctgtatgtacaaatcaaaacccccaagtcttctagttgggccagtkctccttttgctttgcggattgaccttcattttctgaattttcagtaagaaaagtccaaaaatataaatgagcggaaggctgcttttaaatggcttttctttccagaggcccaaatggaacctcaccttgcacagacatgaacagcttcgaggttctctttggacctgatggaggaatcaggaggaatatgtagttttctaaagcgagtgataaaagccacaagccttttctaatttcacatggcatttttgacaggtaagcatagtttcaaaagctcaaagagcacaaagatttctttgg

SEQ ID NO: 34810 - DNA, 601 bp, Human
ctacagtggtgtcatctgaacacttgttgtaatgcccgtcttacaaggttatttgaggtttacataagttaacgtctataaagagctcagcataatacccggcacgtggcaagtatccagtgtgctaagttctgctaagttaacactgttattccactcaccgaggcagccttttcagtgcactctgagcagcagaggccggcctgtccaggcctgggctgtttataccgaagcatagctctgtatgtacaaatcaaaacccccaagtcttctagttgggccagtgctccttttgctttgyggattgaccttcattttctgaattttcagtaagaaaagtccaaaaatataaatgagcggaaggctgcttttaaatggcttttctttccagaggcccaaatggaacctcaccttgcacagacatgaacagcttcgaggttctctttggacctgatggaggaatcaggaggaatatgtagttttctaaagcgagtgataaaagccacaagccttttctaatttcacatggcatttttgacaggtaagcatagtttcaaaagctcaaagagcacaaagatttctttggctcagttgctctaaa

SEQ ID NO: 34811 - DNA, 601 bp, Human
ctcagatcagccctgcactttgggatgtcactgagcagacttcccgagtctccatggcttcctgtaacctgccctttccattggctctgatttaagctgcagcctctggcacaccgatggaagctcgcggcatcgtgttttccatccacgtgctcccacagagccaggttgtccaaaaggaaaataatcccactctggagaagcaaaaactgctggggctgctaagaggagcacactgagtaaaccacccaccttccaacagaatccgccttttttgttatttttccattgcagaaagacraatggcgggacaggcagggcttttgaggaggtgtggatttcatcctccatcataaacgagcagaaacatacttaaccctctttcatcctctatgccatccagcttttaatcctctattgctgtgcccaacgaggtaccagctgtgcagtactgaaagtcacaagcagttgctgaagttaggctggcagtgagtgatacaaacagaagctgcttcggttctgggtctggtctcagaggctggagctgtgctcactctgatgtctttgcctcttgccgcaagggaagttgcttgttgttttt

SEQ ID NO: 34812 - DNA, 601 bp, Human
atatcatcagcagagggtgcagacctgcaaagcctccattaaaaataggaatcatggggtggctccatccagtcactttctgattcacgggaagatgaagaaataattttgaaattcaaagtggagagacttacagatttggaggcagtaattaaatgccatatgttagcactaacacattgaaaagttgttaattaattcaggcagccccaaatccaggtgtgactttgacagattgtacacgcgggtgttagcgcagacttacaattagagattttttttttaaatgaagtttctattyccctaacttaaaaaagtcaccccgtgtatttaaagtattaacccattctcatcatatcatggaaggtagacttcaaatggctgctggtgtggaaccccttttgattctgtggtcgtcgttactaatcacgggggaccccatctgtgcagcacttcatgtgtaaaagcatttccctgcccttattcagtgtccgtcatggaaaatgacttttacccttcaagtgtttttttgttttgttttgttttggttttgtttttttaattccttaaagcacctagcagaatactgtgaacacagtgc

SEQ ID NO: 34813 - DNA, 601 bp, Human
tttggctagtaagagattcccaaagcccagcacttctgtgcacacgcacaggtgcgctcacacgccacacacacagatggaagttaacattttgataacgtggatgatggaggtttccattttttttcttggctaatacttgatatttttaaaagtgcgagttatctttcttcttgttgcctggctgagttgaccttgagtgatggctaggaagtcagcatttcttcatgagtagtttccattttcttcatgttcgtcttaggaaaaaaatcatttttaagcttacccaggagctgcatgkttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacataacaggaattttatttttactctcataaaaatgccagccatagtttgctgggggtaggagtctcggagacgagagggaaggaggagtcctgctgatttttctcccttttctaccccctttccatcccatctctcccc

SEQ ID NO: 34814 - DNA, 601 bp, Human
atctttcttcttgttgcctggctgagttgaccttgagtgatggctaggaagtcagcatttcttcatgagtagtttccattttcttcatgttcgtcttaggaaaaaaatcatttttaagcttacccaggagctgcatggttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacayaacaggaattttatttttactctcataaaaatgccagccatagtttgctgggggtaggagtctcggagacgagagggaaggaggagtcctgctgatttttctcccttttctaccccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactc

SEQ ID NO: 34815 - DNA, 601 bp, Human
ttaagcttacccaggagctgcatggttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacataacaggaattttatttttactctcataaaaatgccagccatagtttgctgggggtaggagtctcggagacgagagggaaggaggagtcctgctgatttttctcccttttctamcccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactcgttgcccagggtatctggtgtctctctggcttagctgtcgcgcctgtgctgcccatgactgaccaggcttcaccagttcacagcggatccatgctactttgccttctctgaag

SEQ ID NO: 34816 - DNA, 601 bp, Human
cggcctgcaggtacactcgttgcccagggtatctggtgtctctctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccytctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcaca

SEQ ID NO: 34817 - DNA, 601 bp, Human
tctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccttctctgcacatgaagcggaagatggggcgtgccatcctgagrtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactc

SEQ ID NO: 34818 - DNA, 601 bp, Human
gagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagytgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacac

SEQ ID NO: 34819 - DNA, 601 bp, Human
tgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccrtttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagac

SEQ ID NO: 34820 - DNA, 601 bp, Human
tgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgytaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtcctaaaaaaaaaaaaaaaaaaggcacct

SEQ ID NO: 34821 - DNA, 601 bp, Human
aagagcaaaactcctggagtcctgagccaggggaactcgttaagtgacagaaaagcgactttaccctgaagaagattgtaggcacttctttgccaccatgatagaagcagaagctgtagctcagagccttgacgataagctggtgtttacagaatagttggaaatcactgttgttttccctgtttgcctctcccttgacaatgccacacacctccttcctggaaccactcataaaggctgacgctggaggttgacactcgtctgactgcacttccctgagtcagtccaaggtggaaatgtrtatataaaatgtgtttttcacttctttttgctctgtcgccaggccagagtgcagtggcgcgatctcagctcactgcagcctccacctcccaggttcaagcaattcccctgcctcagcctcccgaggagctgggacgacaggtgcacgctaccacgcctggctaacttttgtattttagtagacatggggtttcaccacgttggccacgatggtctccatctcctgacctcgtgatccacccgcctcagcctcccaaagtgctgggattacaggcgtgagccaccgcacccagcctgtgtt

SEQ ID NO: 34822 - DNA, 601 bp, Human
ctgagtcagtccaaggtggaaatgtatatataaaatgtgtttttcacttctttttgctctgtcgccaggccagagtgcagtggcgcgatctcagctcactgcagcctccacctcccaggttcaagcaattcccctgcctcagcctcccgaggagctgggacgacaggtgcacgctaccacgcctggctaacttttgtattttagtagacatggggtttcaccacgttggccacgatggtctccatctcctgacctcgtgatccacccgcctcagcctcccaaagtgctgggattacaggcktgagccaccgcacccagcctgtgtttttcacttcttacaggaaatccatattcttagcaacatggagaggttttcattctcttattactgcagttaccagtgcaatttctttggggcaaatgaggaacttggtttccttctcaatctctggctctgggccagcactggcaccccaaaccacatgttgaaagaaaagattggatcatgaggatgaaagcactcgtcttcacccttctcactagtttgacctgacttcagcaccatgtgaggaagaacatttgctcttttgattcttaaaca

SEQ ID NO: 34823 - DNA, 601 bp, Human
ggggcaaatgaggaacttggtttccttctcaatctctggctctgggccagcactggcaccccaaaccacatgttgaaagaaaagattggatcatgaggatgaaagcactcgtcttcacccttctcactagtttgacctgacttcagcaccatgtgaggaagaacatttgctcttttgattcttaaacataaagcttaaagatgtcagctgctagaatggaaggccgagagaacaaaagttcccacctacaaccacctccagagccccagcatgaaggtagtctacaggagaactaggaggmggtggaaccacgccaagcttttgattcctgtgttttcttcggaaggtggtttaaaaaaaaaaaaaaaaaggcggcatggaaatcagtttatgcattctctaacaattctgaaattttgttatataacactcacttaaaagatgtaattctctaaaagctgaacaagtcactgtattgagtgtgatcctggaatagcagatccagtatccggggctcctctgcggtttttcacctgtgccatcgtcaggggcaagcaaagccatccatcgctgtggcagactgcaccacctctggctccca

SEQ ID NO: 34824 - DNA, 601 bp, Human
tttcttacctctgtcctgagctttccccatttgtaaatgacagccgtaactatatctgccctgcttctcttgcagggagtcattcacggctggtgtgctagcttttcgtctgagcataccctctgcatgtgttagcggagagaccccgggcgggcagtatgtgtgcttgatttctgctccccgtctgctggcctggctgatctaggcagtgactctctggcacattttctctgtctgtccagtggggacagtaatgaacaggattgccgcctgcagcgttcagagctccttgagcatacawcagttatttctgcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctgttgcaa

SEQ ID NO: 34825 - DNA, 601 bp, Human
catacatcagttatttctgcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctrttgcaaaaaaagaaaaataagaaagaaagaaaatactcatttataaccatttatcctgagaactgaagacagacagtggtacttttttcaattcgcaggacccagggactcctggctacaggggcctgctcctgaatcagtgtatttgttaaaagcacaattctctttcatgctaccattttgctttcattaaagaattgcagttttgaatcaaatattaatgtgtctcccattagtggcactgcagataaagggcattcagcatttctgttctcagcgtctattgctggctcagctgtt

SEQ ID NO: 34826 - DNA, 601 bp, Human
gcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctgttgcaaaaaaagaaaaawaagaaagaaagaaaatactcatttataaccatttatcctgagaactgaagacagacagtggtacttttttcaattcgcaggacccagggactcctggctacaggggcctgctcctgaatcagtgtatttgttaaaagcacaattctctttcatgctaccattttgctttcattaaagaattgcagttttgaatcaaatattaatgtgtctcccattagtggcactgcagataaagggcattcagcatttctgttctcagcgtctattgctggctcagctgtttaaaaataaataaaaatt

SEQ ID NO: 34827 - DNA, 601 bp, Human
ggccccagcccatgttccagggcagacaccctcaggaaattgtcacgactctacgtggaaagcacctaacacctgccaagcacctggagcctctcgaagatccaaggactcttcctggcttgaggcagcgtagccatatctcagtatgcgtttctccctttggggaagtaacccattctgccatcttctctaatttggaaaacactgagatgctttcaagcaactttgggatgctcagcaccttctgcagcagctgctcagcctctccaggcctgctgtagaagccttcatggagaaaagragcaggatgccatgggcccacatgtggcaattcacatgaggtgtttgctctcagaagcagagcctgaagtttctaagccaaatgtgcttgatcgacagcatcaccctagcatgttgatttcctaaaatacacacactctcacttacccacaatcccacagtcagcctgggctatttaggtacagggttttctgcaccgtggcagttgaatatctgtaacccagagacagtaaaggagtttaatttttttccccccacaaactgtaggcaaatcttcactgccatttaaggtaactttctg

SEQ ID NO: 34828 - DNA, 601 bp, Human
cttagtacaggtagcgtgttcagatagtaagcttcatcagctgccatgctgtcagagaaccacatgagacagctcagcattcaccgtgagctgaacttcattcaggcttcttcaagccagcttagccaggaggcgaatgtgagatgagtttctcatgtactgagagtttttgtgtgttaaaaattatagcatgatgcaaacaaaaaatgcattgacttattttcatgactggatgtcgttgtgctttgagggtaatgggcaggcattgctttctcttattgctgttggattaaaaggtgcsgctacagtattgacttgataatctcaccaggtattcgtgcagagcaaaagaagaaaatatattttatggctcacaaattgatttacataaaccaaacaatctgctggttgtttgaatgcagaatattctattttgcttattggccacaggggcaacaatctcacatcgttgatgccagaattctgcttttcatgcattcactctgaaatgacaatagacgtcagcctctcagtgtttagatctgcttcatttggaaatcttttaagtagtaataataatgttttgaggaaattgagtgga

SEQ ID NO: 34829 - DNA, 601 bp, Human
cttggagcccccccagtaatgctcagagagccacggacaacccacgggagaccatgttcccctgtgttcctgtagaaggaggactctggatcataaagcagaactgggcatgaaccaggctgagaaacagtaggttcccatcatgtaaagagttggtttgaccactggggcatatttattcctaagcctttgatcctttattattaatatctctgttatttgaaaaccaaatttggtgtttaaaactggacattcatgcttacacagaggggtcctctgacacttaaatttcttgtttggtttttttttaattggcatttaaataggaggttatatattatgcagtcacattataattgtttgactaacgttgtttatttttaactaattatattatttccaggactctggcatacatctttaaccaagatgtattacctaattcacaatgatgtgaatgttgaaagaacaaggtcttaaaaacaattaattttatatcgtgccttctgtttctccacttgccttcactctatccctgccctgtgtttcatggtttaaaaaatcatttttaagctataatcattggcctaattttctgctt

SEQ ID NO: 34830 - DNA, 601 bp, Human
ttttcccctccctacgctgaggcatttgttttcagtacattttcaatctcggggaattattgaaatcagcatttatgcaggatatttttccaagttagattgattctgttaagaacaggactaattgaattcctgcctgatgtaggaggggcaaagtcccacaggttaaacttctaactcgtctttgaaaggcaccccaaggccctgagttagaagacatgcagctgatgatgtaacgagagggaggccgctgggctggctcatccctgtcaggtcagggtctgcgccagcaggacctcargtgaaatctcccagaacttccattccatgatcctggctcttcgcagtggaaccagattgatgaaatcaagtgtttcttacttcatctatttgaaaccaacaaaattctattctatttcaagccccagcagacccagttctctcagccattccttacatctcttggtgtctgaacttgagctttctggttgtttactcatgctctccatttcactttgtgtctttattgaaacacagtgaccagaatttaagacagtcccccgagcgagatctgaacaggacggagtagtaacctctagtg

SEQ ID NO: 34831 - DNA, 601 bp, Human
aaatcaaaccgaaataaggccttgctattacagtgggcagtccctagctttcccaccccctcttccccgctctcttcctctttctgtgtgcgtgagagtatgtgtgtgggcagggaatggagagggatgactgaacacagacttttcttggttttagtataacctgatagtgtgaagtcccataatatcgtcgtacctgaggcttgggtttcagtcagccaagggtccccaacccctgggctgggtaccagtaccggtccatggcttgttaggaaccggaccgcccagcaggagaggagcrgcaggcgagagagcgttactgcctgagccccacctcccgtcagatcagcggcagcctcggaatctcctaggagcacgaacctggtctaaactgcacatgctgaagggtctaggttgcgtgctccttatgagaatctaattcccgatgagctgaggtggagcagtttcatctcaaaaccttcccctcaacccctggtctggtgggaaaattgtcttccacgaaacttctttccccggtgccaaaaaggttggggactgctggaatcagccactgatagttccacactgcttggcgctgtta

SEQ ID NO: 34832 - DNA, 601 bp, Human
tcaacccctggtctggtgggaaaattgtcttccacgaaacttctttccccggtgccaaaaaggttggggactgctggaatcagccactgatagttccacactgcttggcgctgttacctcaattgagatccattttcgagtcatatccatgtgtagggtttatcatatcaaactggaaagacctggacttccccagaggaacggtgttctggattgtttcacgagccccaaataaattctgaaagttttgtttttttgtttttttgttttttttgagacagagtcttgctctgttgcccakgttggagtgctgtggcaccatctctgctcactgcagcctccatctcccaggctcaagcaattctcatgcctcagcctcctaagaagctgagattacaggcatgtgccaccacacccggctaatttttgtaatttaactagagatgggggttttgccatgttggccaggctggtctcgaactcctaacctcaagtgatccccaccccccccccaccttggcctcccaaagtcctgggattacagatgtgagccactgcacctggctctgaaagctgtttttaaaatagtgaattaatcttg

SEQ ID NO: 34833 - DNA, 601 bp, Human
ggggactgctggaatcagccactgatagttccacactgcttggcgctgttacctcaattgagatccattttcgagtcatatccatgtgtagggtttatcatatcaaactggaaagacctggacttccccagaggaacggtgttctggattgtttcacgagccccaaataaattctgaaagttttgtttttttgtttttttgttttttttgagacagagtcttgctctgttgcccaggttggagtgctgtggcaccatctctgctcactgcagcctccatctcccaggctcaagcaattctyatgcctcagcctcctaagaagctgagattacaggcatgtgccaccacacccggctaatttttgtaatttaactagagatgggggttttgccatgttggccaggctggtctcgaactcctaacctcaagtgatccccaccccccccccaccttggcctcccaaagtcctgggattacagatgtgagccactgcacctggctctgaaagctgtttttaaaatagtgaattaatcttgttcctcctgagcacacaatgtgacaatatttcagtaataaaataaatgtggtaaatctgtgtttc

SEQ ID NO: 34834 - DNA, 601 bp, Human
tggagtgctgtggcaccatctctgctcactgcagcctccatctcccaggctcaagcaattctcatgcctcagcctcctaagaagctgagattacaggcatgtgccaccacacccggctaatttttgtaatttaactagagatgggggttttgccatgttggccaggctggtctcgaactcctaacctcaagtgatccccaccccccccccaccttggcctcccaaagtcctgggattacagatgtgagccactgcacctggctctgaaagctgtttttaaaatagtgaattaatcttgttsctcctgagcacacaatgtgacaatatttcagtaataaaataaatgtggtaaatctgtgtttctggtatccatgtacatttgaatataggagaaaactatctgcttgcccacactgctaactgcatctgtactggtctcccttaccaaaaagaagatccataagttcagcccaacactcagtctttcacctaagttaagctgcggttcagctgagttggacaagtccagcagcaccccaggggctccatgcctttatcttgtggcacccactcattctgcatggcaggaaaaatgcagccc

SEQ ID NO: 34835 - DNA, 601 bp, Human
aaaactatctgcttgcccacactgctaactgcatctgtactggtctcccttaccaaaaagaagatccataagttcagcccaacactcagtctttcacctaagttaagctgcggttcagctgagttggacaagtccagcagcaccccaggggctccatgcctttatcttgtggcacccactcattctgcatggcaggaaaaatgcagccctgaaagcactagtggaaaatgcagactttctcataggtatattaatgtttttgaagattgacatttacaacgcgtgacttcgatgtacatascaccagatagttgtgagttttgacaagctgtatgtttcactctgcagtgaggacttttaaaatggctgcccatttgcttggtcatgtagtggtggctgcagctgtacgcctgtgaatagatgcattcatgtttgtagttaccatgatgatctttatgttggcaccagagtcagtgaaccaatgtgcttctgatgaaagatgaagaaagctgaacggtgctggaaagtagaagagagggagggaatggaccctgattgacagagatgagttacggtaactgctagactacagagagagata

SEQ ID NO: 34836 - DNA, 601 bp, Human
gcggttcagctgagttggacaagtccagcagcaccccaggggctccatgcctttatcttgtggcacccactcattctgcatggcaggaaaaatgcagccctgaaagcactagtggaaaatgcagactttctcataggtatattaatgtttttgaagattgacatttacaacgcgtgacttcgatgtacataccaccagatagttgtgagttttgacaagctgtatgtttcactctgcagtgaggacttttaaaatggctgcccatttgcttggtcatgtagtggtggctgcagctgtacgsctgtgaatagatgcattcatgtttgtagttaccatgatgatctttatgttggcaccagagtcagtgaaccaatgtgcttctgatgaaagatgaagaaagctgaacggtgctggaaagtagaagagagggagggaatggaccctgattgacagagatgagttacggtaactgctagactacagagagagataattagtcacgctatgttggtttcaatagatctaacacctggttgttaaaaagagtaaattgattaattgttttaaggcagcagtgttagtttccccagtgtttatgttt

SEQ ID NO: 34837 - DNA, 601 bp, Human
agtggtggctgcagctgtacgcctgtgaatagatgcattcatgtttgtagttaccatgatgatctttatgttggcaccagagtcagtgaaccaatgtgcttctgatgaaagatgaagaaagctgaacggtgctggaaagtagaagagagggagggaatggaccctgattgacagagatgagttacggtaactgctagactacagagagagataattagtcacgctatgttggtttcaatagatctaacacctggttgttaaaaagagtaaattgattaattgttttaaggcagcagtgttggtttccccagtgtttatgtttcttaatagagattggacatgaatatggatttacagccccagctctggggaccttcagtccatcagtaggcagtagcaaccaaccctggaaatgcagagtaaactgaatttgtccccagtttaatgagggagttactttgctctcaccatctccactttgcccttgtgtgttcatccgcagctcctgcagcaggccacctcctccagcaacctgggtgcgttcagcggcattcaacaaatggcaggtaagtcaggaagcacgcctctccttttgaccgtg

SEQ ID NO: 34838 - DNA, 601 bp, Human
caatgtgcttctgatgaaagatgaagaaagctgaacggtgctggaaagtagaagagagggagggaatggaccctgattgacagagatgagttacggtaactgctagactacagagagagataattagtcacgctatgttggtttcaatagatctaacacctggttgttaaaaagagtaaattgattaattgttttaaggcagcagtgttagtttccccagtgtttatgtttcttaatagagattggacatgaatatggatttacagccccagctctggggaccttcagtccatcagtaggsagtagcaaccaaccctggaaatgcagagtaaactgaatttgtccccagtttaatgagggagttactttgctctcaccatctccactttgcccttgtgtgttcatccgcagctcctgcagcaggccacctcctccagcaacctgggtgcgttcagcggcattcaacaaatggcaggtaagtcaggaagcacgcctctccttttgaccgtgctattgtcagaatttggggttggttccgagggcaaagacaagaagcaggggaagagaaccaagaatgatgatcagacttgttagctttctg

SEQ ID NO: 34839 - DNA, 601 bp, Human
gagagtagccaagcccagcagatccacgacagctaacagagctgctgatacgggagcccagttagctaccatgcagcccaggcaccccggcacctgcccattctcatttttaataaaggagtccgtgacagttgttgccctattttaagccatggttcaataagtggactgtttttaaagggtgaccaggcagtatacttttttaaagcaaaataatcccagtaatttcatactgtaaaggctcggaataccttgcactggacttggtagaaaatgaacctaaaatttatccaaataaaamttaacttgtataatcctgataaatcattttcagaattaggacatttttcaggttttagtacatctttgtatttagtacatcttttggggaaaagcgaaaacgtggaccgagctttagctgaccatacctcccaaatgggacggctcgtgattagcgtggagcccgtgaagtggtagctgtgccgcggcctcattgttttattccagttagaaccgcctccagctttgacttttccagcagccaagtaggagcctcactgccttgacccccatttccggtacagctcctcgctctgacctt

SEQ ID NO: 34840 - DNA, 601 bp, Human
gctaacagagctgctgatacgggagcccagttagctaccatgcagcccaggcaccccggcacctgcccattctcatttttaataaaggagtccgtgacagttgttgccctattttaagccatggttcaataagtggactgtttttaaagggtgaccaggcagtatacttttttaaagcaaaataatcccagtaatttcatactgtaaaggctcggaataccttgcactggacttggtagaaaatgaacctaaaatttatccaaataaaaattaacttgtataatcctgataaatcattttyagaattaggacatttttcaggttttagtacatctttgtatttagtacatcttttggggaaaagcgaaaacgtggaccgagctttagctgaccatacctcccaaatgggacggctcgtgattagcgtggagcccgtgaagtggtagctgtgccgcggcctcattgttttattccagttagaaccgcctccagctttgacttttccagcagccaagtaggagcctcactgccttgacccccatttccggtacagctcctcgctctgaccttgtccttcacctaggtcgaggacgcgtgtgct

SEQ ID NO: 34841 - DNA, 601 bp, Human
cccgcagcagacaaggcatcatggtggtgcgatgctgcccacccctccatgggaacttggaggcgtccactggagacgagctgctgtcttcagcccgtcctcgtctggcagcaaggccccacatggctctgcaggctgcgaggcacacccagaacctcatgccttgagatccaagcagagcggcgagtcgccgctcctctcccgccagaatttcctccacacgggcatctgcatttccagaggactgtgcccagagtgcgatcatctgtaatccacagcacccgttaacagcctggccaawgtgagaccaacagaatttatcagcagcgtccagcccttcccgagttattgtacatacccctctcacctatctcaaaaaacacggaagttcctttgcatcacacaaatagtgggaggtgaggatgaagtaagatcactggaggaatagagaaatgactctccagccctctggtggccatagtaacagggacagaggggaagcacagcggcagggaggtggccgcgatttgctggtgtccgagggatcatttagggtaattaggacagtctgcatccaagctctttggacagcacttacttg

SEQ ID NO: 34842 - DNA, 601 bp, Human
cagcagacaaggcatcatggtggtgcgatgctgcccacccctccatgggaacttggaggcgtccactggagacgagctgctgtcttcagcccgtcctcgtctggcagcaaggccccacatggctctgcaggctgcgaggcacacccagaacctcatgccttgagatccaagcagagcggcgagtcgccgctcctctcccgccagaatttcctccacacgggcatctgcatttccagaggactgtgcccagagtgcgatcatctgtaatccacagcacccgttaacagcctggccaaagtgrgaccaacagaatttatcagcagcgtccagcccttcccgagttattgtacatacccctctcacctatctcaaaaaacacggaagttcctttgcatcacacaaatagtgggaggtgaggatgaagtaagatcactggaggaatagagaaatgactctccagccctctggtggccatagtaacagggacagaggggaagcacagcggcagggaggtggccgcgatttgctggtgtccgagggatcatttagggtaattaggacagtctgcatccaagctctttggacagcacttacttgcatg

SEQ ID NO: 34843 - DNA, 601 bp, Human
ggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtaggtgccgcccttggccccaggcagggcccagcccaacaggcagcactggcctctagagcacggttagaaggtatcaaattgaactgaacccatgtcataacagaaagcagttgttttgttattcatgtttaaaaaaaaaaaaaactgaaagctgggcatggtggcatacacctgtagtcgcagttacttggcaggttgagatgggaggatcgcttgagcccaggagctgaggctgcagtgagccatggtcatgcctgtgactagccactgcactccattcggggaacacagacatacccctctctctcaaacaaaagcaaaaacctatttatttcagtctttctcacttggtcttatagttaccttctaatttaatttttcatcgatctcttcagatgaagttcttgtccattgtatatttatataccactctggctttgttga

SEQ ID NO: 34844 - DNA, 601 bp, Human
actgaacccatgtcataacagaaagcagttgttttgttattcatgtttaaaaaaaaaaaaaactgaaagctgggcatggtggcatacacctgtagtcgcagttacttggcaggttgagatgggaggatcgcttgagcccaggagctgaggctgcagtgagccatggtcatgcctgtgactagccactgcactccattcggggaacacagacatacccctctctctcaaacaaaagcaaaaacctatttatttcagtctttctcacttggtcttatagttaccttctaatttaatttttcaycgatctcttcagatgaagttcttgtccattgtatatttatataccactctggctttgttgataaataaatggtttcaattatttcccccagctacatcttctgaagggttatggcatctctgcagatctaagtccaggaaagttgatcacctttcttgcaatccccaaatatcctctcactgctcaccccctgccataattaagttctataaactattaatttcccataaactacttcatagctgctgactgtaaataattcccagggacctccctctcccaagtcagcacagaccatca

SEQ ID NO: 34845 - DNA, 601 bp, Human
tggtggcatacacctgtagtcgcagttacttggcaggttgagatgggaggatcgcttgagcccaggagctgaggctgcagtgagccatggtcatgcctgtgactagccactgcactccattcggggaacacagacatacccctctctctcaaacaaaagcaaaaacctatttatttcagtctttctcacttggtcttatagttaccttctaatttaatttttcatcgatctcttcagatgaagttcttgtccattgtatatttatataccactctggctttgttgataaataaatggtttyaattatttcccccagctacatcttctgaagggttatggcatctctgcagatctaagtccaggaaagttgatcacctttcttgcaatccccaaatatcctctcactgctcaccccctgccataattaagttctataaactattaatttcccataaactacttcatagctgctgactgtaaataattcccagggacctccctctcccaagtcagcacagaccatcaccttttccccttacacagaaactacttgttgggggaaggggatggatggccacaggcttctgtgggtgaaacgctc

SEQ ID NO: 34846 - DNA, 601 bp, Human
aaatatcctctcactgctcaccccctgccataattaagttctataaactattaatttcccataaactacttcatagctgctgactgtaaataattcccagggacctccctctcccaagtcagcacagaccatcaccttttccccttacacagaaactacttgttgggggaaggggatggatggccacaggcttctgtgggtgaaacgctctctgtcctgtgtttgccagggttttggagtccacacatcctatgagtgtgtggccggctctcagtaggtgatggttttcaggtgaatgatraaatccatggttaggattgccttggtctttgtttaattgggggtcttcagggaaagcaagtaagtgatcgattgccttgcttctctgccagtaaagcaaaataaactccaggaagttaatgctaagaataaattaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttt

SEQ ID NO: 34847 - DNA, 601 bp, Human
ccttttccccttacacagaaactacttgttgggggaaggggatggatggccacaggcttctgtgggtgaaacgctctctgtcctgtgtttgccagggttttggagtccacacatcctatgagtgtgtggccggctctcagtaggtgatggttttcaggtgaatgatgaaatccatggttaggattgccttggtctttgtttaattgggggtcttcagggaaagcaagtaagtgatcgattgccttgcttctctgccagtaaagcaaaataaactccaggaagttaatgctaagaataaatkaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttttgaagtttctttcccttctcttttaccctcaccccatagctccaaactgctttgtctgaagtgggttttaagagaacacagcttaaaagatactcatggtttttttttttttttaaaggaaggaaaaggttttt

SEQ ID NO: 34848 - DNA, 601 bp, Human
aactccaggaagttaatgctaagaataaattaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttttgaagtttctttcccttctcttttaccctcaccccatagctccaaactgctttgtctgaagtgggttttaagagaacacagcttaaaagatactcatggttttkttttttttttaaaggaaggaaaaggttttttctttgtataaataacatggatatcacttttaaaatgaaaaatatatgaaagtctaagttacttttcattatttcaactttctctttgactattatggtaggcttttgaaacatgcacaggtgttcagacaactggttccccaggcttgtgaaagagaccctacatcataaacatcacttgtcttcccaaagaaaggcctgtgtgtgttccttttctctgtggtctgagtaccatggtgacaaatgagggcagagagcagggccctgtag

SEQ ID NO: 34849 - DNA, 601 bp, Human
agttaatgctaagaataaattaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttttgaagtttctttcccttctcttttaccctcaccccatagctccaaactgctttgtctgaagtgggttttaagagaacacagcttaaaagatactcatggtttttttttttttttaaaggaaggaaaaggttttttctttgtataaataacatggatatcacttttaaaatgaaaaatatatgaaagtctaagttacttttcattatttcaactttctctttgactattatggtaggcttttgaaacatgcacaggtgttcagacaactggttccccaggcttgtgaaagagaccctacatcataaacatcacttgtcttcccaaagaaaggcctgtgtgtgttccttttctctgtggtctgagtaccatggtgacaaatgagggcagagagcagggccctgtaggacaatgata

SEQ ID NO: 34850 - DNA, 601 bp, Human
ttgatttgttcagtttttctttggaatcatctcccaccttgtcataactctcttctgatccctttctcacccagttaatatgtgctcaagaaatttaaaccatcttcttattagtttaagtaaaacataattttaaaagcaaatgatgccaggcagagcaaaaataataataataataataataataataataataataataatgaattccagattttctactccacagttcagtccgaggttgcgagacctggtgtgttttttccccagacaggaagtgagcctctgatggcccgcctcygtccattacctgcaggaggcgagtcccatgaggaatggggacgctggtggactcttacagctttgttcctacaaacgtccccagttctttatgccagatcaagtgccctgtgagagagataaaacatgaacaccccaacagccaggaccagtagtgagtgtaacagagaatctaacaagtgacagtaacgtgcactgggagaaatctgatgaaagggtgacttgtgaacaggtgtttcccatttctagaggaagagagatgacacacaggtagaatcccatttttaaaaaaggtattttg

SEQ ID NO: 34851 - DNA, 601 bp, Human
acatccactgcattcatctccaaggctaacgcccaggagagtcattcctctcaaagtcatgagactcaggctaccttctttccttgccttgactcactgccagtcatttctaataaagatgattattagactgtgtgttaagagatttggcaaatcaaaactggctggaaaactaggcaaatgatagagaaatcggagcagcattactgctacatccattattgtcaattgttacaattttttagaatgcacagagcacccttttttccttctcacagcctgtccgtacctgagaaaatayggccacccaagaaaaacccatgccaagattatctgtccccattctgcccactgtcaccttcagccccatgaaaaggtgactgaaatgcatatgccaaggggcagtggcacctgtgactcacagaagactgtcagtggaaaggaagccattcgtaaccagcatctttggaaatcaggaaaatctgaaggatgattgctttcctgaaaggcactccagcacttgacatttatccatctgtttgtttgttcaactaaatgcttagcctacctgttgttaaagtattcctaagaagggactttg

SEQ ID NO: 34852 - DNA, 601 bp, Human
ttctgcccactgtcaccttcagccccatgaaaaggtgactgaaatgcatatgccaaggggcagtggcacctgtgactcacagaagactgtcagtggaaaggaagccattcgtaaccagcatctttggaaatcaggaaaatctgaaggatgattgctttcctgaaaggcactccagcacttgacatttatccatctgtttgtttgttcaactaaatgcttagcctacctgttgttaaagtattcctaagaagggactttggaaactaagactcaagggataccttactctgactttttttttcctccttaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggtatgcaaaagaaactaagctagtatattgcagtaggttcccaagtgaagagtcgtgggaaggaaaatgtgagacagtttcagccaggatagggccttccccacattgtgttgggctctgattttctggatccttgtaagcagattt

SEQ ID NO: 34853 - DNA, 601 bp, Human
aaaatgtgagacagtttcagccaggatagggccttccccacattgtgttgggctctgattttctggatccttgtaagcagatttgggcaaagaaaggaaggctctgggaaattaaagtcaacgcccatacattaggtaatcttctatactacactattaaggaatctaaccacaatttagctcatcttccccactaattccttagccctccaggtttagtacaattcagacaccgtggttgtgggcaacaccatattgggggcttattggccttgacatacacgcacacaaagacactttsacagacagacacccattcatcagcaccaacacatccatgtgttcaggctgcttgcgtgatcgcagctccacgtgcccgggatgagcagttgacagatctcacggttacatagcacgctgcatgatgagatctgaagggccaccatcggggagtgggaatgaatgcggagtccaggggcgtgcagctgttatcagagactcagctgccatgccccctttcctcaagcagcctggactctgcctcttgtgggtgtttttcgctcccttagggaggaagggatgctcacagaatggactgatg

SEQ ID NO: 34854 - DNA, 601 bp, Human
gtgatcgcagctccacgtgcccgggatgagcagttgacagatctcacggttacatagcacgctgcatgatgagatctgaagggccaccatcggggagtgggaatgaatgcggagtccaggggcgtgcagctgttatcagagactcagctgccatgccccctttcctcaagcagcctggactctgcctcttgtgggtgtttttcgctcccttagggaggaagggatgctcacagaatggactgatgttttacaccaggacaatagcattcattaaatatattccttgtttcatttttcaaamcctattggcccccaaagcagtttacaggccaggatgttcagagtatatattacttggcaagctcagggcccagtttgagttagagtatttgctttaatcactcctgcaatttaataattcatgctggtgggaaatagtaacagcataaaacccaggtagttaggtaagggctggaggaaacacacagaattctgtgctgtaaaggaaagtagcaaagggagggtggttctcaaacttaactctggctggtaatgagtaatcaggccaaagagaatgttttggcttctaaaactctaatcc

SEQ ID NO: 34855 - DNA, 601 bp, Human
aaagggagggtggttctcaaacttaactctggctggtaatgagtaatcaggccaaagagaatgttttggcttctaaaactctaatcctaaggtctaatttgtgctatcacccaggaaggtctgaaggcatggttaaaggactccgcatgtcagccacttacagtcaccacgttaccctagcagcaaggctgtcagtcgggacccattcggcggctgctgtggcaactgtataaacccgtgtgacagttcagtagagagggatatgcaaattaaatcattatggggggcgggggggtgtgtytgagcaggagcctactttagggaggcttccctacatgatttacaaggctttgaggctgacttttgtgtttttcgtagctaaacaatattctagatttggaagggaattctgcttcatgatttgatttgagaaaatacttccttgaaaacagattgtttatcagcctacagcctccttaaccatgtgctcatactgatgtaaaccatagctgttagtgtcagcagacaattcttgagcatgatggactggtttccatttttgtggaacgctatagcacccagtttgcttggtgagccagcc

SEQ ID NO: 34856 - DNA, 601 bp, Human
aaaactctaatcctaaggtctaatttgtgctatcacccaggaaggtctgaaggcatggttaaaggactccgcatgtcagccacttacagtcaccacgttaccctagcagcaaggctgtcagtcgggacccattcggcggctgctgtggcaactgtataaacccgtgtgacagttcagtagagagggatatgcaaattaaatcattatggggggcgggggggtgtgtctgagcaggagcctactttagggaggcttccctacatgatttacaaggctttgaggctgacttttgtgtttttcrtagctaaacaatattctagatttggaagggaattctgcttcatgatttgatttgagaaaatacttccttgaaaacagattgtttatcagcctacagcctccttaaccatgtgctcatactgatgtaaaccatagctgttagtgtcagcagacaattcttgagcatgatggactggtttccatttttgtggaacgctatagcacccagtttgcttggtgagccagccgcatttcttagggctgccagtcataaggtagtgccccgttccttcctagttcttagccaggttttgttatccat

SEQ ID NO: 34857 - DNA, 601 bp, Human
aaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcmttttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatt

SEQ ID NO: 34858 - DNA, 601 bp, Human
gcatttttatatgactaagatgttagagtctaataagagaataaaaccattaaaaaaaaaagcttagtatttgaatattcctagccatatcattcttaaatttctcaactaaatgtcctgagaatcagttgccccatgtctcttctagatatttctataagttaagataggatgtcatctggatgtgaaacctactttaggctttttgtaatgaaaattatttttttgacataggtcaccagaaggattatgcggcacgaataaattagaatgtcattttaagacttctgaatagaatatrccatgatggtggattttcctttttggttgtcatttagaagtaaaatcccatgtaactgactgctactttattttttcttaagccatcatgccttaaaaattagtaacttgactacgtttctaagcattagtggatgttttcatggttttacatgtctatacatctcaatatgtatgtattccatttttacattttagaaaaaaaagatagttttaagaacttctaaagtaccattttagaaattgcttaattacatgatattcttctttaagccataatgtgtatactcactcaatactt

SEQ ID NO: 34859 - DNA, 601 bp, Human
aatgctggtgctgtaaagcccagattgtaaaaatttttattgagggctttaattacttaactaatcacagataaaaataatctgaaaaatcacactcctagaaaagattgtttagagtaaagctaatttcccaataaaaattgaatcgctaattttttatctaatttcttcagtttggtttactgagaaggatactcaaaagaataagctacatataccttcatttggtttgtaggccattttgtatgggggtatgtagggtttttgggggtttgttttttgttttcgctaccctcactttttttactgtgcagttaaaaaataacagtagttaatcttatagctttatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctc

SEQ ID NO: 34860 - DNA, 601 bp, Human
gataaaaataatctgaaaaatcacactcctagaaaagattgtttagagtaaagctaatttcccaataaaaattgaatcgctaattttttatctaatttcttcagtttggtttactgagaaggatactcaaaagaataagctacatataccttcatttggtttgtaggccattttgtatgggggtatgtagggtttttgggggtttgttttttgttttcgctaccctcacttcttttactgtgcagttaaaaaataacagtagttaatcttatagctttatataaattttggaatttatatrtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctcatgtatcttcctttaggcaatattttattttgccagcaagctgaatagttgtttttactattattgcca

SEQ ID NO: 34861 - DNA, 601 bp, Human
aggccattttgtatgggggtatgtagggtttttgggggtttgttttttgttttcgctaccctcacttcttttactgtgcagttaaaaaataacagtagttaatcttatagctttatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacrtactttgttttatttttgcatcatatagtaaacttttttacaaaacctttttaaagatactttgctcatgtatcttcctttaggcaatattttattttgccagcaagctgaatagttgtttttactattattgccagttctgtttcttcctttgtcttaatggctttttttttttatcaaaaaactctttttgatactttctccatgttgtgctttgatttctcagaacattggaaaaccaaaaaggaactggagtaaagaagagccctatgttgtgtggacaatatcctgttaaaagtg

SEQ ID NO: 34862 - DNA, 601 bp, Human
taaaagttaaaagggacttaaattttagcacctaggatatcttggtataaagaatatttgtctttgaagacaaacctcaaaaaaatgggggaatggggagaggacttaacaagtgtccctaccccttgctaaatactaaatagggaggaattttggctagtcatatggtagattcttattaaatacagtttgtataaatatgttagttgaacagtattttaagttaggagtagaggtggactgcctttcattttatacttgaatgaaattatgattgaaactctggatcaatcaggaaacrtgtctgccaccatttataaggttgttaatagtcacgtgtacaatatcaagtctacccttcttcactacatactaccttaacccacacccagtccttcaatcccaggacaggtaacaggcaagtgagaaatctatgttatgctttgtgtaaatatttgtctagctagatattttggtagtttggtcattacgtttaacctaattgccctgactttaagttatgttttgtctagttagaagtattgttagattaattgcttaactatgatagggaatgaattgaccttaaaagtttgtttag

SEQ ID NO: 34863 - DNA, 601 bp, Human
tactaaatagggaggaattttggctagtcatatggtagattcttattaaatacagtttgtataaatatgttagttgaacagtattttaagttaggagtagaggtggactgcctttcattttatacttgaatgaaattatgattgaaactctggatcaatcaggaaacgtgtctgccaccatttataaggttgttaatagtcacgtgtacaatatcaagtctacccttcttcactacatactaccttaacccacacccagtccttcaatcccaggacaggtaacaggcaagtgagaaatctrtgttatgctttgtgtaaatatttgtctagctagatattttggtagtttggtcattacgtttaacctaattgccctgactttaagttatgttttgtctagttagaagtattgttagattaattgcttaactatgatagggaatgaattgaccttaaaagtttgtttagtcattcattcaacaaatactacactcctccatgtgccaggcactgttctagattctgctgaccagcaatttgactagtttgcttattttcctcattatgataccattttatagagatgtagctgtactggaat

SEQ ID NO: 34864 - DNA, 601 bp, Human
agaagtattgttagattaattgcttaactatgatagggaatgaattgaccttaaaagtttgtttagtcattcattcaacaaatactacactcctccatgtgccaggcactgttctagattctgctgaccagcaatttgactagtttgcttattttcctcattatgataccattttatagagatgtagctgtactggaatagaaaagatgtgtgaattttttaagtactttgtttggcatgcattgtacaatttactttgtgattttctgcattctatattaggagcttcaatgtttaactrtaagcctcatcaagaatcaggattggaaacatttgttcccaaatgctgttttaaatatttatttatttttcagcatacaaattataatttaatttatgaaggcttgctagagacctgtaatgatccatagatccccgtttgaactagcagtctctcagaccataatgttttgtctcaggatttaatgatgttatatgtatgtatctagtccgtgaaaatgagcttcatttccttcttattcatatagctgcactcatacttttctattcaagtagctttagtagaataaaaatttggtat

SEQ ID NO: 34865 - DNA, 601 bp, Human
cctcatcaagaatcaggattggaaacatttgttcccaaatgctgttttaaatatttatttatttttcagcatacaaattataatttaatttatgaaggcttgctagagacctgtaatgatccatagatccccgtttgaactagcagtctctcagaccataatgttttgtctcaggatttaatgatgttatatgtatgtatctagtccgtgaaaatgagcttcatttccttcttattcatatagctgcactcatacttttctattcaagtagctttagtagaataaaaatttggtatatgtrctctcatttgatgatgatgatgatgccactaacagttttgtgagttttcccattagttatggtggtaggtcctgagcaacccaaatgctgcctgaagtactgtgcattcattctcatctgcttgtacaaataaattataaatgataatttatcatctaacatctaaatttataatttaagtatagttattacagaattaaaactatgacttacttcaggaatttagccaactcttttatgaaaatgttttatctctatttttcttgaagatttaaatttttttaaatgtaattcagttac

SEQ ID NO: 34866 - DNA, 601 bp, Human
atttgtatgttttcactttgttatatggatatagtcatagctacagagtaaaaaaaatagttcaaaaatttaataaatcactttttatttcaatcagatgaaaactcttggaagtcagaagctgaaattgatatggaactatttcatcaggtaaaatttaagctttttttataatttggttatttactctctgagcaattcagttttgttttgaaattttcctgaatcaatagattaaatttcttcttcctatgggattgatatgaattatttaaagtttctttcttgagtttctttaacygaaatagaattattttcctaatggtaaacatgaccacctctattttaaaaagttaggatcattaacaaatgtttccattgttaataaacaaaatctttctttcctgatacttattttctctgaggatttgcataatcttaatccactatatagttaaataaaagggaaaccaatatttattgagaatctgttatgtttcaggtactttatatttgttaaaccttcttgtgtttagaagcactcatcacactgatattagtctgtatttgcaggacctcaccatgtattgtttcccaaata

SEQ ID NO: 34867 - DNA, 601 bp, Human
gctaatagtttagtttggctggtttatagggtacattttgagagagagaagagataaactagagtgacaggtgataaaataaaaaatcccaaagactgatggtgaataaatatttttttctttctatattgccccataatacctgataaatattttaaataaaactttggttgggttaaaacgatattttaggctgggtgcggtgatgcacacctgtaatctcagcactttgggaggccgaggcgggtggatcacctgaggtcaggggtttgagatgaggctggccaacatgttgaaaccytgtctctactaaaaatacaaaaaaaaaattagctgggtgtggtgatgggtgcttgtaatcccagctactggggaggctgaggaaggagaattgcctgaacctgggaggtacaggttgcagtgagctgagattgtgccattgcactccagcctgggcgatagagcgagactgtcctcaaagacagaaaacaaaacaaaaacctgatattttagaaatgagaggaactaaattttttttttttgcatgtgagtgggagacggagtctcgctgtgtcgcccaggctggagtgcaatggcgcga

SEQ ID NO: 34868 - DNA, 601 bp, Human
tttgtattattgatagtctctgaagctttgcttagccattaaaacattttaattttttttttttttttacttcagcctattcagacacaaaaatcacacattatttgctgtaactccacagtggtgatttctataagaaatgggaatgtaatatttaacattttttttttttttctaaaaaagaaattactggctgggtgaggtggctcacatatgtggtcctgacacttcaggaggccaaggcaagaggatcacttgagcccaggagtttgagaccagcctgggcgatatagtgagaccsccccccccgccatccctacaaagaaaaaataatactaagctgagcttggtggcatgcacctgtagtcccagctacttgggaggctgaggtgagagatcgcttgagcctgagagattgaggctccagtaagccgtgatcatgccaatgtactccagcctggacaacagagcaagaccctgtctcaaaaaaataataagaagaatttaaaaataactcataacatgatttataagtagaaatttaaatttttttcaaggattagcttatatttttaaatcttttattactagaattaatgtc

SEQ ID NO: 34869 - DNA, 601 bp, Human
tgggcgacagagcgagaccctgtcttaaaaaaaaaaaaaaagtgaaataaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcrgataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctccaaaaaagaaagaaagaaaaataggccaggcgcggtggctcatgcctttaatatcaacactttgggaggctgagcttg

SEQ ID NO: 34870 - DNA, 601 bp, Human
cacctataattccagcactttgtggggctgaggtgattggatcacctgaggtcaggagtttgagaccagcctggccaacatggtgaaacctcatctctactaaaaatacaaaatttagctgggcatggtggtgcgtgcctgtaatcccagctgcttgggagattgggcagaagaattgcttgaacccgggaggcggggattgcagtgagccgagatcatgccactgcacttcagcctgggcgacacagtaaaactccacctcaaaaaatatatataaatcacatatgagaaattgtttggtagagattacttgagaaaaaatgcaagtgttggattgtaatgcattgacaccagcttgatgttcttagagcaaattaattcttaggaggagaaaaagattaatctgatattttcatttataatgtactactaaattgaagttgactagaagattattattgaattaacaagatggaacatatctgacaaacttaatgtctggcctggagacattttggactgtttttggtgggactagacttaaataaaattggaacaaggccagatgtggtgactcacacctgtaatcccagcactttgg

SEQ ID NO: 34871 - DNA, 601 bp, Human
ctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaataaaaaaaaaamcaggagtttgaggctgcaggtactcactccagcctgggtaacagagtgagaccctgtctctaattgaatgaatgagtgagtaaatgaatgaatgaatgaatgaatatttttaaaaagaaaaatacagactgtatatttttatttttatttattattattattatttgagatggagtcttgctttgttgcccaggctggaatgcagtggcgtggtctcggcttactgcaacctctgacctctgcctcctgggttccagaggctgaggtaacaggtgccctctaccacacctggcttttttt

SEQ ID NO: 34872 - DNA, 601 bp, Human
cctgacctcgtggtccacccacctctgcctcccaaattgctgggattacaggcatgagccaatgcgcctggcccatatttttatttttataggattaaccaaacaatccacaacaaactaaattgacagtgataaagctaaagtaagattattttcttcattcattcagcaaacatttgttgattacctactgtgcaacaggtgataacaacatctgccttcacagagctcatgatctaatggaattcaaaagcaagaatagtagttgactattacaggatcaacttaagataacactaayggtttttcaaaatgttctatgggatattcttagattacttttaaatgcctgccctgtgcatgatctgaagttttgtctcagtcaaaattaggttgtaggccgagtgtggtggctcacgcctataatcccagcactttgggcagcctagtagggaggatcacttgagctcaggagttcaagaccagcctaggcaaagtaacgagactcttgtctctacaaaaaaattttaaaaattagtcaggcatggtggtgtgtgcctgtagtcccagctacttatggggctgaggtgggaggattgcc

SEQ ID NO: 34873 - DNA, 601 bp, Human
cccagcactttgagagaccaaggtgggcggatcacgaggtcaggcgatcgagaccatcctggctaacatggtgaaaccccgtctctactaaaaaatacaaaaaaaaaaaaaaatacagaccaaacatccctagtccaaaaatccaaaatccaaaatgctctgaaatccgaatctttttgagtgctgacatgacatctcaagtggaaaattccacacctaacctcatatgatagggtcatagtcaaaagtcaggctcacaacatgcagtttatttggtgtccccaagggtaaaaaagatccktccagctcccttcagctgtgatagatttttttaggtgtatgtgaaacagaagtgaatttcatgtttggacttgtgtcttatccccaagatatctcattgtgtatatgtgcatattccaaaatccaaaaaagaaatcagaaacacttctgatcccaaacattttagataagggatactcaacctatattggacattccttctgcctctgagcttctttgccttggaataacaaaacatctgatgagtatgcaaaatgtgtttcctttgtactatatattggatataaccatgcctcactta

SEQ ID NO: 34874 - DNA, 601 bp, Human
aaaagtctgtggaagatcaaatatgataaagttttacttacagtaccataatatactttaggatcattcagggtgtcagaaactttataaatgcttccctccctagtaagttaaattaaactttttctcttttttagaaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtractaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaa

SEQ ID NO: 34875 - DNA, 601 bp, Human
ttttttagaaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtrcagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatga

SEQ ID NO: 34876 - DNA, 601 bp, Human
cgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctcccatacaaaggtctagtctgatgttttgtgtacaaactcatatctccaattaacagtatttattgagggtgactttgtattgcactaacgtctattgctattacctgttgtgattgataagtaaagccactcattgaaaaacccaattccaaacaccacagtttgtgacacatgaagtaatgaatgactcttggtatgaaaacgtggcatttaagcgtctactgtgacagtatttcatttgtggacaaaagtagctttaaagcaagtatctggaaaatttttagcacacaggtttaaaatggtcctgcacgttgcaatacagcagcacgtgactcagagtc

SEQ ID NO: 34877 - DNA, 601 bp, Human
gtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctcccatacaaaggtctagtctgatgttttgtgtacaaactcacatctccaattaacagtatttattgagggtgactttgtattgcactaacrtctattgctattacctgttgtgattgataagtaaagccactcattgaaaaacccaattccaaacaccacagtttgtgacacatgaagtaatgaatgactcttggtatgaaaacgtggcatttaagcgtctactgtgacagtatttcatttgtggacaaaagtagctttaaagcaagtatctggaaaatttttagcacacaggtttaaaatggtcctgcacgttgcaatacagcagcacgtgactcagagtcatgacaagggggtgtgatataacgaatgaaataaaatttccaaactgtt

SEQ ID NO: 34878 - DNA, 601 bp, Human
catacaaaggtctagtctgatgttttgtgtacaaactcacatctccaattaacagtatttattgagggtgactttgtattgcactaacgtctattgctattacctgttgtgattgataagtaaagccactcattgaaaaacccaattccaaacaccacagtttgtgacacatgaagtaatgaatgactcttggtatgaaaacgtggcatttaagcgtctactgtgacagtatttcatttgtggacaaaagtagctttaaagcaagtatctggaaaatttttagcacacaggtttaaaatgstcctgcacgttgcaatacagcagcacgtgactcagagtcatgacaagggggtgtgatataacgaatgaaataaaatttccaaactgtttttagttaacaatttaacttgttccaattgctaaaggggcatatttaaaaggtaaataagtaaaaagccgtgtactttttaagattaaagaaagtacaaaggatgtcaattttttaagttatcatgttaagaaaacatgatggaatcagagcattgagaaaatgcttactaattattactaattaattattactaattattaagatggcttc

SEQ ID NO: 34879 - DNA, 601 bp, Human
agcgctgacctcccaggctcaagtgatcctcccacacctcagcctcccaagtagctggggcgacaggtgtgcaacaccaccactactagtattgttggtttttctttagagacggggacttgctatgttgcccaggctggtttcaaactcctgggctcaagcaatcctcccacctcggcccacagtcatgagccactgcaccctgccccagcaagtttgaatagatccctttaaaagaaattgccatgccaggcgcagtggctcaagcctgtaatcccagtactttgggaggccgaggcasgtggatcacctgaggtgaggagttcgagaccagcctgaccaacatggagaaacccctcctgtactaaaaatacaaaattagctgggcgtggtgacgcatgcctgtaatcccagctactcaggaggctgaggcaggagaatcgcttgaacctgggaggcgaaggttgcgttgaaccgagatcgtgccattgcactccagcctgggcaacaagagtaaatctccatctcaccaaataaaaaaataaataaataaataaattgccttagctcaacattcaaccttggagcttcaaacctgagt

SEQ ID NO: 34880 - DNA, 601 bp, Human
gcgacaggtgtgcaacaccaccactactagtattgttggtttttctttagagacggggacttgctatgttgcccaggctggtttcaaactcctgggctcaagcaatcctcccacctcggcccacagtcatgagccactgcaccctgccccagcaagtttgaatagatccctttaaaagaaattgccatgccaggcgcagtggctcaagcctgtaatcccagtactttgggaggccgaggcacgtggatcacctgaggtgaggagttcgagaccagcctgaccaacatggagaaacccctcytgtactaaaaatacaaaattagctgggcgtggtgacgcatgcctgtaatcccagctactcaggaggctgaggcaggagaatcgcttgaacctgggaggcgaaggttgcgttgaaccgagatcgtgccattgcactccagcctgggcaacaagagtaaatctccatctcaccaaataaaaaaataaataaataaataaattgccttagctcaacattcaaccttggagcttcaaacctgagtatttgtctcactcactgttatttatttcctgaacttaaagcagaaactggtacacagta

SEQ ID NO: 34881 - DNA, 601 bp, Human
cagctactcaggaggctgaggcaggagaatcgcttgaacctgggaggcgaaggttgcgttgaaccgagatcgtgccattgcactccagcctgggcaacaagagtaaatctccatctcaccaaataaaaaaataaataaataaataaattgccttagctcaacattcaaccttggagcttcaaacctgagtatttgtctcactcactgttatttatttcctgaacttaaagcagaaactggtacacagtaccagtactcgatacattatgtagttaattaattatagattagggaaatattstatgaaaacccaattataggccgggtgtggtggctcatgcctgtaatcccagcactttaggaggccgaggcaggcggatcacaaggtcaggagttcgagaccaacctggccaatatggtgaaacctcatctctactaaaaggtacaagaattagctgggcgtagtggcgggtacctgtaatcccagctactggggaggctgaggcagaagactcgcttgaacctgggaggcggaggttgcagtgagccgagatcatgccactgcactattccagcctgggtgacaaagcaagactccgtc

SEQ ID NO: 34882 - DNA, 601 bp, Human
tgatcgcacctggcatcctttctccatagtaagtcacagcctgagagtgactgcatgcggagtcccgggagtcctcctagtgagccagcgagcctgggcatagtctgggggatccttgatccatctgggaaagctaacgatgctcctacctgctttattccctctgaacgcagaaacggctaaggatcactcatctgtgataaccatgtatgactaaggtaatcatatatgagtcagcctgacaagcagtcacacgtattaccttctatctctttccattcggttatgcctctccctacgytgagaccttcctccctggggcccactctgggcctgctcccccaggtttgcctgtgaggactccgaggactgccaagcgccttgtgtggcggtggcaccttcgcccacattctgaatctctccaagggctcttcgctctacatttgtgtccaactgacgcattctactccgattcctcttcagtgcttgtttgcatagcgctgcttctttgcgaaagaagaaaaaagtggtttttaattttgtattcttatctcaattaatgctgaatacagttttggccttttcaatccaagatataaac

SEQ ID NO: 34883 - DNA, 601 bp, Human
tggggcccactctgggcctgctcccccaggtttgcctgtgaggactccgaggactgccaagcgccttgtgtggcggtggcaccttcgcccacattctgaatctctccaagggctcttcgctctacatttgtgtccaactgacgcattctactccgattcctcttcagtgcttgtttgcatagcgctgcttctttgcgaaagaagaaaaaagtggtttttaattttgtattcttatctcaattaatgctgaatacagttttggccttttcaatccaagatataaacattattgggtaagcascacagagaaccgaaacacaaagagatgtactaatgcagtttttcagcatcagcagggaccatgaagcccaagcctattttatacaacgaaactgaacaagaatcaatcatcacactaaatacgttttccaagtgctatgcaaccaatatgacctcatccaaagcccctctttttaattaacaggtgttatctatgaatacagaaaacaagaagttgtttactttttctaaaggtcagaatggaaaaaaaaaaacaacaacaacaaaccacctggacatatttcctcccaaaaatattttc

SEQ ID NO: 34884 - DNA, 601 bp, Human
aagaggaacattcattagttcagatggatgtcgaatgagagttaccaaactgccaagacaaaagaaagcccagaagtgtcagcaatacgtggcagacaagcatccaccatcccactcccatggctctggctagtttttccagacagcaacccaactctcatcctggaaatctctacacaacaattagcaactatcgctgctgtggaagtcctcctcttcctatggaggaaaagcaaaactgcgccacctccctgctctcatcacatcctgacaccaatctcacttttgccatcctccagtstgaccacgatgggcaactacaggctgggatgagcagaaaactgcggacgcagccccttccacagccatccctgagggtcgccaagggggcggctgcaggctggagcctcattttagagctcaaagcctgcaaacccccgtcgggccttcctaggcttccctgacatccaagagtgccacccggagcacatggttcccaggaattctgcgcgctcggccccactccaggcggggccactgagggagggggtgtttagtttctggaagtacctgctccccggggcccgcacagcgcacacag

SEQ ID NO: 34885 - DNA, 601 bp, Human
acatgcctttaccccaaccctactgcctgtcccccaaaagatgcaggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtaagcggggccgcgaagttggagagggttggggasgttaagggtcggggtcttggtactggtgggtgaaatgggtccgggctacctgttgctgcggagtcctaacagaaccgctacaggaatgggcccaccctacctaagaaaaactgagggctggagcacgggttagcctggctcgacctctgagctagggagggatgtcagggctggaggcaggttctcccggaggctgctcagtggtgtgcgatgctagaggagggttccaggccttggctcaacttggccactatctcccggggtgaccgcggtcaagatcctgctcctttctgcgagctg

SEQ ID NO: 34886 - DNA, 601 bp, Human
cgcctgtggtcccagcactttgggaggctgaggcagggggatcacttgaggccaagagttgaagaccaacttgggcaacaacatagcgagaccctgtctctacaaaaactggaaaaaaaaaaaaaagaattagccaggtgtggtggcacacacctgtagtctcagctactcaggagactgaggtgggaggatcacttgaaaccaggaggtcgaagttgcagtgagctatgattgtgccactgcactccagccagggcaacagagcaaaacccagtatcaaaacaaacaaacaaacaacaamaaaaaaaacttgtaaccaccttgcatcaaacattctcagggaagtacaagaaagctggaattaaatttacagagtatagtgtaaattacattttctagctatttagctcataaaccaggccttagtagtcccattcttattccattcacacctgtactctgtccccagtgccatggttttcttctttcaaaaaattaagaaacagaagtgtggaatttattttagaggttgaaactttattgaccaatgtatattttgagtttaaaggaaaaacttgtattttatcagttcaggacacca

SEQ ID NO: 34887 - DNA, 601 bp, Human
aggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctsagatgctctcgacggtaccttcctccaagtgatggtctgcggggcgggagcggaccttttggagagtggccacaccatgcccacagagctggaaacccggttaaggagtattgtcctaagggcacagtgtcagggtccctgcgccctgaggcttggccgaccctggagccctagttttgctgttttctgtagtgttaggatcacttcctccatagcttagtgctactctgagctcactttcatctggtcatgcctggttgaatatatttgttatacatttctcaagctttctcttctgcc

SEQ ID NO: 34888 - DNA, 601 bp, Human
ctgctgcctcccagggtttgcctcccgggtggagcccaggttgggtttgagcttaaggtcctcatttctctaacctaaggctttgtggtaacggattccccacaggatatcaagactggagataatggcccagaagaacgctgttggggtccttgcccctgctccccgcttcttctccccaccacttgcttgcccaccttccagaccagcctgctgcctcacatgaggacctgcgtgacaaccagcaacccctgctttactgggggcttactaggttcaatttcacgtaacagaaaacctyaaaataacagtagcttcaacaagactcacgtttatttctctctcatgaaaagaagtccaggtggacaccgccctgggctggtgtggtcctaccaatgaggaaactgaggttagagaggtgtaggttcttggtctcggttatcagctcaattgctcatcgtcggatttgcacatagttcctaatgatcccaggttgcagttgttggcatcaagtcaagctctgtgctatttggacattgtcatcccaagctcatgttgtctaactttttccctgtttctgactttgctgcagatacagcct

SEQ ID NO: 34889 - DNA, 601 bp, Human
tgcattcctgaagctttgctctttggggtggatctcaagcctctgatcattgtaaatgcggcttcaggaaccagcgttggtattgcctggctgcagacggttaaagacctagttgcttcttttggaactttttatcatgatgtaaaccaagggcttctgtttaccctgcaggcagccacagatgattcaggccaagctcttaaaggcagatcttcacggggctattatttcaggtaatttacctaagagcgtgtagcacatggccatccagaggttcactctgtcactctgtggagacccrgggcgtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactcacccacggcctgggatcttgaacacagaatccctttcatccaatgctgtggtttcaaatgtcagctacacctgacagcccccaa

SEQ ID NO: 34890 - DNA, 601 bp, Human
tcctgaagctttgctctttggggtggatctcaagcctctgatcattgtaaatgcggcttcaggaaccagcgttggtattgcctggctgcagacggttaaagacctagttgcttcttttggaactttttatcatgatgtaaaccaagggcttctgtttaccctgcaggcagccacagatgattcaggccaagctcttaaaggcagatcttcacggggctattatttcaggtaatttacctaagagcgtgtagcacatggccatccagaggttcactctgtcactctgtggagacccggggcrtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactcacccacggcctgggatcttgaacacagaatccctttcatccaatgctgtggtttcaaatgtcagctacacctgacagcccccaaggtga

SEQ ID NO: 34891 - DNA, 601 bp, Human
cggggctattatttcaggtaatttacctaagagcgtgtagcacatggccatccagaggttcactctgtcactctgtggagacccggggcgtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactyacccacggcctgggatcttgaacacagaatccctttcatccaatgctgtggtttcaaatgtcagctacacctgacagcccccaaggtgacatctccagcgtaggcctgtcccctgaactccaggctcaggcatccagctgcccacttgacatagccacctggatgttcagggggcatctcagactttacatagccaaagctgccaccgattctcctcacagcaacccctcctggtcttttccatctcagttaattactcagttatttacactggttgttcaggccaaaaacctaaacagt

SEQ ID NO: 34892 - DNA, 601 bp, Human
ctgtttaggccccaggagagggcctccacctgccccaaaggctgctgctcccagaggaatgtagccaaacaggcagcagggtagaaacaggagtggcgcctgtccctggagttctgagctgtgtccttggcgataacacttgggttccatccgtggccagcattgctctagcagatactttgggtcagccaggatttctacaccccgccttacccacaaatccagagatatcaaaccatagttagaaggttttgttcctttaatttttttttttttttttttggagacagtctcactcttycacccaggctggagtgcagtggcacaatctcgactcactgcagcctccactcccggattcaagggattcttctgcctcagcctcccaagtagctgggattacaggcacgcgccaccacgcccggctaatttttgtatttttagtagaggcagggtttcaccatgttggacaggctggtctcaaactcctgaactcaagtaattcacctgcctcagcctcctaaagtgctgggattataggtgtgagccaccgcgcccagccttcttcctttaatttttgagcttggtttttcttgttgct

SEQ ID NO: 34893 - DNA, 601 bp, Human
ctaaagtgctgggattataggtgtgagccaccgcgcccagccttcttcctttaatttttgagcttggtttttcttgttgcttcccttattttcctacatatccttctacctcacattgtaaacctcggaaagtggtgtaatagtttctccacagagcataaggccaggagcccatctgaaagttaatgtgggaaaaccagtttctggcaggtgttctgggactttctggttctgggaatttggtgtatagcctttgaccctgaagattaggtgccaagctacatttagcatgtgactagaktgacctgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaag

SEQ ID NO: 34894 - DNA, 601 bp, Human
gccaggagcccatctgaaagttaatgtgggaaaaccagtttctggcaggtgttctgggactttctggttctgggaatttggtgtatagcctttgaccctgaagattaggtgccaagctacatttagcatgtgactagattgacctgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaa

SEQ ID NO: 34895 - DNA, 601 bp, Human
tgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaagggaacrattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttg

SEQ ID NO: 34896 - DNA, 601 bp, Human
tgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacartacatatgtggacataaacagggatcaaataaaggaggtattgctgcagtccagccaggttgaaagggaaggggggtccccaaaggtccattggatggcaggtgtctacagaggctcgcctttgggtggaactctgacccacctaaggtttactttgctatttcaggaaggttgaagaggattgaagggtgagttgctaagtgacttagggtttattcacttcaggaatcacagctggggtggaccccaggagcagagtactgcatgcagctgtgcccatgcatggttgccccagcgtag

SEQ ID NO: 34897 - DNA, 601 bp, Human
gctggtgtaatagctcagcagtggaaaaacagcatatacttcctggtctaatacctgaaagaaattaggtgtatggataacagcaacccttggctaaatctgactgtagacatgtcacctcatctaatagtaatatacaggactggagcgggaagaaaagacttgttaaagatgattatagtggactgggattatttcaagcctaattagaagaccattttcattctaagtgaagcaaactcagtatgttgacaatgttattgctgcaattcactaacgaaagtgtgctaacatgaatcayaggattctgaagtcagcattctcaggtagtttaaaaggatgaaggatttgaaatctgtcatttcatttgttgcagaaatatgaccaagataaccacccttttcttcagtgcctcttaacatgaagcactgaaattttttctgaccttaaaggtaaacgaaagttccaagcctaatcttgtattgtaataattataatagctaatatttactgcattcttaggtgcactttgcaactaaataccttccatatattctcagattaatctctgcaactcaaagaagcattttgtggctcagga

SEQ ID NO: 34898 - DNA, 601 bp, Human
aagacttgttaaagatgattatagtggactgggattatttcaagcctaattagaagaccattttcattctaagtgaagcaaactcagtatgttgacaatgttattgctgcaattcactaacgaaagtgtgctaacatgaatcacaggattctgaagtcagcattctcaggtagtttaaaaggatgaaggatttgaaatctgtcatttcatttgttgcagaaatatgaccaagataaccacccttttcttcagtgcctcttaacatgaagcactgaaattttttctgaccttaaaggtaaaygaaagttccaagcctaatcttgtattgtaataattataatagctaatatttactgcattcttaggtgcactttgcaactaaataccttccatatattctcagattaatctctgcaactcaaagaagcattttgtggctcaggaaccaaggttcagagagatttctatctttcctgagattactttgctaacaagaccactaaacacatgggtgtctttgttacataatttgggattgttggagcccaccagttttggacaccagaagccctctgtggtcaaacaagattaggtttattta

SEQ ID NO: 34899 - DNA, 601 bp, Human
gcaaccactaatatgttctcgatctctatagttttggcattttgagcacaatatataagtgtaatcatatagcgggtatcctttgagtcacatcgtttccactctgtatatggtccttgagacccatctgggtcaatagcttgctcctatgtgttgcttagtatgtacagctattttttttttttttttttgagacagagtcttgctctgtcacccaagctcgggtgcattggcacaatctcggctcactgcaacctccgcctcccaggttcaagtgattctcggggttatcacttacagrcatgcaccaccacgcctggctaatgttggccaggctggttttgaactcctgacctcaggtgatctgcccacctcagcctcccaaagttctgggattacaggcgtgagccactgcacctggcctgaaatctgtttcttatcaggctgttagtttcaagtttaagaaaaagagtaagaaatagtatgtaggataaccccccgagttatcaagtgtaacctcccgagtagctggggttacaggtgggcaccaccacacctggctattttttgtatttttagtagagacagggtttccacatgt

SEQ ID NO: 34900 - DNA, 601 bp, Human
tggaggtcaagaggataagctactggcttatgaagacctctgttgtgccaggtgtgcagtgaaaaacacccactgccacagaaacagaagattctttaaatgtaatttattaatgcccatttttaatataattgtgctcatatctgttttaggtcagtctcattttatcttgaaatgatcagtgtttaaattttgttctgccatttttaatcaaactattttctcttctcctaaaatgcccagaacgttaaatgctgtttccttctaggaactggctgtaatacataattcatatttctgsattgtgatttagcaactactaactagaggctggatgataaaccgattaataaaaaacgaatttaaacagaattgttttgtataaggcaacatcaaattcagataatttcattggatttgatagatttgatgtaaaccttttcaaattgtatgtatttagggccaaacaagtggtgttatagagcagattttattttaacattggtttttattatgaagtcattgatatattgcattgcaggggcaagagactgtactgagttgactttgatgtatcatatttaacttgtattccttcatt

SEQ ID NO: 34901 - DNA, 601 bp, Human
tagaggctggatgataaaccgattaataaaaaacgaatttaaacagaattgttttgtataaggcaacatcaaattcagataatttcattggatttgatagatttgatgtaaaccttttcaaattgtatgtatttagggccaaacaagtggtgttatagagcagattttattttaacattggtttttattatgaagtcattgatatattgcattgcaggggcaagagactgtactgagttgactttgatgtatcatatttaacttgtattccttcatttatcaatattaagtgcttactctrtgctcagtatcatgctaggtgccagaaatacaatgctgcataaaacattctggtgaatgataaattgatctcatctccttgctgaaggaagtcatttataatggctttccaggagaaatataaatataaaagattcttgtttaaagaaaagggaagaggcaattgtagttattctctgcttacataaaaaactttaaaccggtaatactcttttttgttgttttttgagacggagtctcgctctgtcgcccaggctggactgcagtggtgccatctcggctcactgcaatcttcgcctcc

SEQ ID NO: 34902 - DNA, 601 bp, Human
catcctcagggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatggtaagtcagaggagaccccagctgtggggacggtaaccctgcgtgccatggcgcactagggaagcctagttaggaaaggggaatagggatcggggatctctaatttgtaccagtcctggtctcactggcccacctgtaccaattccaaggccttcttccttgttaattcttgcttttagtctacataaagaatctaagagcatagttaggaaattccagcagtggtctatacatatacctgtgaaaataggttgttcttattttctgtgtgatatttgaagacaccttggataaattttagctataccgatgtggtattttttttacaatatataatgtttttatgtagaaaataagctcaatctgcaattttagaaactgcaaataagaccattagcaccatggctttgatttttgtgaacttgtgc

SEQ ID NO: 34903 - DNA, 601 bp, Human
gagatgtttcacagcattgtttagaatactgaaaaccaggaaacaaatgtttaattaataacagattgcctataaattaataacatttatggtgcttgtacatgtgagaaatatgtgcaaccagtaaaaatgataatgtaaagaatgactggaaaagatatccatactaatattaagtgggaaaaataagattaagatatatagcattatcttgttttttgcaaaaagaaagtgaagtcagttataaagacaaaacctctgcaaatgtatatatgaatttaaaatacataaaaggatatayacaaaagagcttgagtggtagcatttgttttcttattcttgcttactaagacttctgtattggctgagtgtggtagttcctgtctgtaatcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattcaggttctctcattaatattttcttc

SEQ ID NO: 34904 - DNA, 601 bp, Human
aatttaaaatacataaaaggatatacacaaaagagcttgagtggtagcatttgttttcttattcttgcttactaagacttctgtattggctgagtgtggtagttcctgtctgtaatcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattyaggttctctcattaatattttcttccacttctctggctctgaagctcaaggctacttatgcttgaggacactcattcatcctcaactggccatagttaacctgtggctgtccaacctcatttcttcttcctctctccttatcctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgc

SEQ ID NO: 34905 - DNA, 601 bp, Human
atcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattcaggttctctcattaatattttcttccacttctctggctctgaagctcaaggctacttatgcttgaggacactcattcatcctcaactggccatagttaacctgtggctgtccarcctcatttcttcttcctctctccttatcctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgctctcgatggtaaccccttcttcccatttgctttgaaagattaaactatccctttttattctgaaatcagtttgctgcgagacttctgtggagatccagaaagatataataatgc

SEQ ID NO: 34906 - DNA, 601 bp, Human
ggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattcaggttctctcattaatattttcttccacttctctggctctgaagctcaaggctacttatgcttgaggacactcattcatcctcaactggccatagttaacctgtggctgtccaacctcatttcttcttcctctctccttaycctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgctctcgatggtaaccccttcttcccatttgctttgaaagattaaactatccctttttattctgaaatcagtttgctgcgagacttctgtggagatccagaaagatataataatgcattttaagatgaacattatgttatata

SEQ ID NO: 34907 - DNA, 601 bp, Human
tttgtgctttagccaagtccaagtgtactttctggtctctgtgttcctatgcgtggtcctctcaccatcaggaacttggtgcctttacccagctcagctaaacacagtattggagcttctgagccctgcctaccatacattatgttctgtgaggtatatccgtgcttctccccaccctagcatctgatgttatctctcctgggaggtagcatgatgtggttaaaggagcatatgccttggaaccaaaaatatctgagattgaccctccctaactaagcctttttccttcatctataaagcwcaaaaacaaaagaaacaaaagccccactctgcatttgcagaactgttttgaggatttagtgtttggttcagtgcctgtcccagggagggtgctccaccaataagggtttccttccacttcttgctttgaaccccattatatctactcttatggactctttaatggtccttcctgtgctctgcttttatacctttttggaatttttgtcgtcttacccactggtctgaaagcataaaggctgcacctttttcctcctaatattcctgtagtgcctgccatgttttacatgtagtaagtgct

SEQ ID NO: 34908 - DNA, 601 bp, Human
ctctttaatggtccttcctgtgctctgcttttatacctttttggaatttttgtcgtcttacccactggtctgaaagcataaaggctgcacctttttcctcctaatattcctgtagtgcctgccatgttttacatgtagtaagtgctcacaaacatctgctgaactaaattggattactgatcttctcagagcttcccagggctcttagattagtagactccttactagtctgtccatagatgaggtgaagagaactgagaggagtgagaggagaggacattgacctgtttggggaaactayggaatatttcccaaagttggtaacttcagtactggagagaaatactcaattggaaaagcctgtggagttctcttgtgttactttaaaaaaaatttttttttattattatactttaagttctgggatacatgtgcagaacatgcaggtttgttacataggtatacaagtgccatggtggtttgctgcacccatcaacccaccatctagattaggtatttctcctaatgctattcctcccctagttccccaccccctgacatgcctcggtgtatgttgttgttcccctccctgtgaccacat

SEQ ID NO: 34909 - DNA, 601 bp, Human
tttcctcctaatattcctgtagtgcctgccatgttttacatgtagtaagtgctcacaaacatctgctgaactaaattggattactgatcttctcagagcttcccagggctcttagattagtagactccttactagtctgtccatagatgaggtgaagagaactgagaggagtgagaggagaggacattgacctgtttggggaaactacggaatatttcccaaagttggtaacttcagtactggagagaaatactcaattggaaaagcctgtggagttctcttgtgttactttaaaaaaaawttttttttattattatactttaagttctgggatacatgtgcagaacatgcaggtttgttacataggtatacaagtgccatggtggtttgctgcacccatcaacccaccatctagattaggtatttctcctaatgctattcctcccctagttccccaccccctgacatgcctcggtgtatgttgttgttcccctccctgtgaccacatgttctcattgttcaactcctacttatgagtgggaacatgtgttgtttggtttttgttcctgttagtttgctgagaatgatggtttccagcttc

SEQ ID NO: 34910 - DNA, 601 bp, Human
ataaggactttgcgcttttggaatggtctccatctgtgagggacactaaccagtgcaagttaccgataatccaaatcgttattgtggtcagtattatttattatacattactagtgtatttcacatctgcacttggcgaggcctcattcagctacagaaaataaattgttaccaccatttcctatttttgaatgtttttctctcaagctactctctatggaagacaccgcatgtcaccttgaagcatgcagaattttgaaaaagtttgtcacaaccaagaaaacagttttagacttcatayaatgtttcttcttttaacctctgccattactagatccctagagactattcagaattcaaactgcagagtgactcattatgtacacagaagattgttcttcattgccctggtgcaaagacataaaagcacactaaactatctagttttattaattttcgctggaatagttcatgttagcctatggttgtaacattggttctgtgaaaattggaaagtgggaaaattgataattgagaagtaaaagtttcttaatatatcagtatgagtaagtttttccctgaaatttccccaggcagaaaa

SEQ ID NO: 34911 - DNA, 601 bp, Human
agctcagatccatctcacagtgggtccctaaactctttctgtggttacttccccacttctggagtgcataatcggaataggcataatcagcaactggcagaatccccacattggttcaaatgataaaattgtttaaccctctgtttttaaggaagaataacatgaaaattcacatgatagtctgaaatagcttctaaattgctatactaacattctccatatataaattaagattcctaaaaatatatttcactaacctgccaactgatggcataattagaatctattctgttgtatcagktcagagaaggttcttaagatgactttgtcttactccacagatgggcttttcaacctcggaagcatctgtgagaaacatctgggctttatctccttagcttagaaaaatgtgtgtatttctctaacctgaacttttattccctaaggaactttgaagtctttcctttctagcacgccttaagaaaaaaataatgaagtggaggtgtgtatataagaaatttcaacttaaatataaaactgaaggaagccatggtctgaagagacagttttgagaaagtagattgtaatttagacattcaaa

SEQ ID NO: 34912 - DNA, 601 bp, Human
tcagatccatctcacagtgggtccctaaactctttctgtggttacttccccacttctggagtgcataatcggaataggcataatcagcaactggcagaatccccacattggttcaaatgataaaattgtttaaccctctgtttttaaggaagaataacatgaaaattcacatgatagtctgaaatagcttctaaattgctatactaacattctccatatataaattaagattcctaaaaatatatttcactaacctgccaactgatggcataattagaatctattctgttgtatcaggtcrgagaaggttcttaagatgactttgtcttactccacagatgggcttttcaacctcggaagcatctgtgagaaacatctgggctttatctccttagcttagaaaaatgtgtgtatttctctaacctgaacttttattccctaaggaactttgaagtctttcctttctagcacgccttaagaaaaaaataatgaagtggaggtgtgtatataagaaatttcaacttaaatataaaactgaaggaagccatggtctgaagagacagttttgagaaagtagattgtaatttagacattcaaatag

SEQ ID NO: 34913 - DNA, 601 bp, Human
tggaccacaaacttctcaattgccagtactctattttctctatcctacaaagctttcctggagaagaggaaagggctatgtctacccatgttctattaacctctgttagcataagaacatgctgccataccttttgttcaacaaccactggagtttgcctgagaagttctcccttcatctatatgtgcccctccagatttgcatgactttgactccaggttgttgaaagtcaatctctgtttttctttctcctttaaccctcatagtgctatgcacatgtgaacataatttgatgacaacraattgtaatttaatatttgtagagtttgatgtacgtgtaagaaaaaaagagaaagcatccgtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccaagagtttaatgtgttttgttaatgaggaggggtagaaatttgca

SEQ ID NO: 34914 - DNA, 601 bp, Human
gctttcctggagaagaggaaagggctatgtctacccatgttctattaacctctgttagcataagaacatgctgccataccttttgttcaacaaccactggagtttgcctgagaagttctcccttcatctatatgtgcccctccagatttgcatgactttgactccaggttgttgaaagtcaatctctgtttttctttctcctttaaccctcatagtgctatgcacatgtgaacataatttgatgacaacgaattgtaatttaatatttgtagagtttgatgtacgtgtaagaaaaaaagaraaagcatccgtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccaagagtttaatgtgttttgttaatgaggaggggtagaaatttgcaatgggataaaatgcttgttaggtctaaaatggttccagaattaagttttag

SEQ ID NO: 34915 - DNA, 601 bp, Human
agaagaggaaagggctatgtctacccatgttctattaacctctgttagcataagaacatgctgccataccttttgttcaacaaccactggagtttgcctgagaagttctcccttcatctatatgtgcccctccagatttgcatgactttgactccaggttgttgaaagtcaatctctgtttttctttctcctttaaccctcatagtgctatgcacatgtgaacataatttgatgacaacgaattgtaatttaatatttgtagagtttgatgtacgtgtaagaaaaaaagagaaagcatccrtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccaagagtttaatgtgttttgttaatgaggaggggtagaaatttgcaatgggataaaatgcttgttaggtctaaaatggttccagaattaagttttaggactccgttg

SEQ ID NO: 34916 - DNA, 601 bp, Human
ccctcatagtgctatgcacatgtgaacataatttgatgacaacgaattgtaatttaatatttgtagagtttgatgtacgtgtaagaaaaaaagagaaagcatccgtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccargagtttaatgtgttttgttaatgaggaggggtagaaatttgcaatgggataaaatgcttgttaggtctaaaatggttccagaattaagttttaggactccgttgcacatatccaccagctctgcctttctagaacacttgtttaggttgtttttgacaatcttgctaaatatattagcactatacaagagaataccaggatttctgtaacttaaaaaggattttgcttatcctaaagtaaacaaatgtctttgtaaaactagttctcaaatacatgctaatgccctaggttacagctaca

SEQ ID NO: 34917 - DNA, 601 bp, Human
gtttaggttgtttttgacaatcttgctaaatatattagcactatacaagagaataccaggatttctgtaacttaaaaaggattttgcttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttrtggactaaactggtctgtgaatttgtgattgtcttgggcatatgtggtaaatattctcaaagggtaaaaatgtttgatactaatgcattcctaaaacgttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatact

SEQ ID NO: 34918 - DNA, 601 bp, Human
cttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgsattcctaaaacgttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaata

SEQ ID NO: 34919 - DNA, 601 bp, Human
gtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgcattcctaaaaygttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtg

SEQ ID NO: 34920 - DNA, 601 bp, Human
tcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgcattcctaaaacgttgaattatatatttgcatgccttgaartaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtggtattatattttcttaattttaagacaag

SEQ ID NO: 34921 - DNA, 601 bp, Human
taacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtggtattatattttcttaattttaagacaagtattgctttcaaattaacrtttctgtaattttttgtcatctatggctaaggaaattaggaaaagttttagatgtttctttttagttttagaaagctatgatgagctcagtggcaatatatggatggcattaagaaaatgtcatatttgaggagtctgtgccttatacaggtcatgcttattgattcatttattcgtgtgagtagaccagtgatataaacagatgtttacactaatattttctctcacctaatcctttgtgattgcacagtattaagtaggggtaaagagtaattctgaatatatgaaataaagtacaat

SEQ ID NO: 34922 - DNA, 601 bp, Human
ttggcaaagctaggcaactagttatgcctactcaatccaatggcagagcctacattgttagctctggaaagaatctttgagactacacagtttgatactcatttttcagatttggaagttcacattggtaagatttcagacagagggaaagaatggtagacccaaggacaattaatttttattccagaattcctttagtagatttttattaagcacctactatttcctagtgtcaaggatcaaggtggctgtcaacttctaggctagtatttatttgtaccacattgtaggtcatctacasgatactattcatctttaagaaactagtgtgacagtgtgtggccttagaagtagagcttaaggaaaaaaaaaaacttttttagtccaacttgatgtttgtctagtagtaccctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattggga

SEQ ID NO: 34923 - DNA, 601 bp, Human
tctttgagactacacagtttgatactcatttttcagatttggaagttcacattggtaagatttcagacagagggaaagaatggtagacccaaggacaattaatttttattccagaattcctttagtagatttttattaagcacctactatttcctagtgtcaaggatcaaggtggctgtcaacttctaggctagtatttatttgtaccacattgtaggtcatctacaggatactattcatctttaagaaactagtgtgacagtgtgtggccttagaagtagagcttaaggaaaaaaaaaaacttttttagtccaacttgatgtttgtctagtagtaccctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattgggaaagaattgcataattgtataaatgagctatcctaatttcaaattcatcctggaaaaaacttagttcatcttct

SEQ ID NO: 34924 - DNA, 601 bp, Human
cgccaccccctccccccaacttttggctattctaaatgagactgctatgaatattcatgtccaggttttttcatggatatatcttttcgtacaactgatttttgtatattgatcttgtatcctacaaccttgctgaactcattctaatcatttttagtaaatttcttgtgctgccatccgccttaataaataaagtttcactgaaatccagccacacattaatttatatatggtctatggctgctttcctgctgcagtggtagtgctgagtggttgtttcagagacccatagcctgcaaarctgaaaatatttgcctttttttttttcttttcgagatgaagtctcactctgtcacccaggctggagtgcagcagggcaatcttggctcactgcaacctcagcctcctgggttcaagcaattctgcctcagcctcccgagtagctggcattacagttacctgccaacatgcctggctcatttttgtattttttagtagagacggggtttcaccatgttgaccaggttggtctcgaactcctgacctcaagtgattcacctgcctcggcctcccaaagtgctgagattacaggcatgagcca

SEQ ID NO: 34925 - DNA, 601 bp, Human
ctattctaaatgagactgctatgaatattcatgtccaggttttttcatggatatatcttttcgtacaactgatttttgtatattgatcttgtatcctacaaccttgctgaactcattctaatcatttttagtaaatttcttgtgctgccatccgccttaataaataaagtttcactgaaatccagccacacattaatttatatatggtctatggctgctttcctgctgcagtggtagtgctgagtggttgtttcagagacccatagcctgcaaaactgaaaatatttgcctttttttttttcttttcgagatgaagtctcactctgtcacccaggctggagtgcagcagggcaatcttggctcactgcaacctcagcctcctgggttcaagcaattctgcctcagcctcccgagtagctggcattacagttacctgccaacatgcctggctcatttttgtattttttagtagagacggggtttcaccatgttgaccaggttggtctcgaactcctgacctcaagtgattcacctgcctcggcctcccaaagtgctgagattacaggcatgagccactgcacccagcccctactctctgact

SEQ ID NO: 34926 - DNA, 601 bp, Human
gggaaagaattacataattgtattaatgagctatcctaatttcatattcatcctggaaaaaacttagtttatcttctctctcctaaacttgcctgcttcttttcccacgtgtcatatttggatgagagctaaaaacacagaaaaatataagaagttctaacttagactaagctaagtcagctgctatcaagtgagctttagactcattgcctttccatgtaaatcaaagttcaagtgaattgaccattggtgattgtcttttaaccaactaacaaattttttacttctcagttcaagtgaygggagaaacattttcaccagctttgcttgctttctttccttcccactgagacagttgccttaagaagggtgattattcttctgaaaacatttatgaatctgacaactattggtaattgaaaatatcataattggctggttgtggtggttcatgcctataatcccagcactttgggcggctgaggtgagcggattgcttgaccccaggagtttgaaaacagcctggacaacatggcaaaacccatctctacaaaaaaatacaaaaaattagccaggtgttgcatgatcctgtggtcccagc

SEQ ID NO: 34927 - DNA, 601 bp, Human
taagaagggtgattattcttctgaaaacatttatgaatctgacaactattggtaattgaaaatatcataattggctggttgtggtggttcatgcctataatcccagcactttgggcggctgaggtgagcggattgcttgaccccaggagtttgaaaacagcctggacaacatggcaaaacccatctctacaaaaaaatacaaaaaattagccaggtgttgcatgatcctgtggtcccagctactctggaggctcatctgagcctggggaggttgaggctgcagtgagccttggtcacaccactgttctccagcctgggtgacagagtgagaccctgtctcaaaagcaagaaagaaaggaaggaagggaggggagaggagggtagggggagggaaaggaaggaagaaagaataataattacttgtaaacatcctaacttgactgtacaatgtattttctagtagaccaatgtttctaaacagatgaaccagctgtctggctgcccattgaaaagagatacatctctcttcctgggcattgacaaacagaaagaacaggtgaggggcatttaaagccaaatgaagcatcaacacatattaaag

SEQ ID NO: 34928 - DNA, 601 bp, Human
agctctcaggtctggggaccagaattgtaaccattcaacaaaataaacagatttctaaatatgaagtttagcccatggattcatgaggaggagagattcttgaccaatctaagtcatgactaccataggattttctaacaccccttccccaaaattaagtttcaaaaaaatttttttctcatttcttgtggttgcacagcacaaaatgagtcagaggaaccaggaattttctttttccccactttagttgacctttgtgttgtgcatatgccattttgtactttgagtaacgttgtctccraaggttctgctttggtttaatgccgaacattggccgtccttaaataagggccacagtccttgtgggtatctccttattggagaaattgcaggtaaactttgtaagcaaagaggatcttgccgattggtctcctttgtctacatgtgttgtttgcatctacctgggacttataattattgtttgcttttccttctctttggctgcttttggccaaacatgtttttatcatcctcatgaaagatttaagttccagagctagccttagatatttgtgtctcttccttttctttgggttagcag

SEQ ID NO: 34929 - DNA, 601 bp, Human
actacactaatgtttaagggttcactgtgtctgtgtagaatttaacaaacttttttctttagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggtaggaggttggtgtttgatggataactctactgtataaagttaaatttgactggttttctatttctgaatcatggaagtgatgagaggaactaaytgatttatctgaagtctggatatgtaataaagtcttcatgaactgcagttgaatgtggctgcattgttactaatgtacagaattttttccatattggcttaacaaaaccaaatagagcagggggaagaaatatttcactatttatttgggatggtagattatcctaagaaatcaatcttaagattttccttgacttaattaagctcaattaatgataattcctgggttgtcaatatttaaaaggtatttctttccccccatctcagcctgcaacttaacattgtacctttcaaaccaaaa

SEQ ID NO: 34930 - DNA, 601 bp, Human
ttcactgtgtctgtgtagaatttaacaaacttttttctttagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggtaggaggttggtgtttgatggataactctactgtataaagttaaatttgactggttttctatttctgaatcatggaagtgatgagaggaactaactgatttatctgaagtctggmtatgtaataaagtcttcatgaactgcagttgaatgtggctgcattgttactaatgtacagaattttttccatattggcttaacaaaaccaaatagagcagggggaagaaatatttcactatttatttgggatggtagattatcctaagaaatcaatcttaagattttccttgacttaattaagctcaattaatgataattcctgggttgtcaatatttaaaaggtatttctttccccccatctcagcctgcaacttaacattgtacctttcaaaccaaaatgtcatttttttctacaaag

SEQ ID NO: 34931 - DNA, 601 bp, Human
atctctttttaaccaaactatataaatagtacctgtttgagcttcttgttaggagtaaagaaatagtgcattagtgaacatagtgtcattattgactattaggacgtttgttagtttttgtttctctttttgggggaacatttgttattttaaataaaagaagaaactcatttagaaaagtctgcattaggtgaaaccccatctttactaaaaatacaaaaattagctgggcatggtggcgggcacctgtaatcccagctacttggaaggctgcatcaggagaattgcttgaacccaggaratggaggttgcagtgagccaagatcgcaccattgcactccagcctgggcgacaagagctacactctgtccctgggagggaaaaaagcccagaaaagtctgcgttagaatctcaggttcagatgctttttctcgttataaacaagactggctggagtctcaggggtcctcctgattcccccatgtgccttgtccattgtagtcctaattccctcccaaatattcagcaatttttatatatataggagcccagggctgaagtatttacaaaaaaagataacaagagcaaagctaggagaaaa

SEQ ID NO: 34932 - DNA, 601 bp, Human
agtgaacatagtgtcattattgactattaggacgtttgttagtttttgtttctctttttgggggaacatttgttattttaaataaaagaagaaactcatttagaaaagtctgcattaggtgaaaccccatctttactaaaaatacaaaaattagctgggcatggtggcgggcacctgtaatcccagctacttggaaggctgcatcaggagaattgcttgaacccaggagatggaggttgcagtgagccaagatcgcaccattgcactccagcctgggcgacaagagctacactctgtccckgggagggaaaaaagcccagaaaagtctgcgttagaatctcaggttcagatgctttttctcgttataaacaagactggctggagtctcaggggtcctcctgattcccccatgtgccttgtccattgtagtcctaattccctcccaaatattcagcaatttttatatatataggagcccagggctgaagtatttacaaaaaaagataacaagagcaaagctaggagaaaaagtacagccaaaagagctattttcagtttcagttctaggtcactgaatttcattcattttttagttgcccct

SEQ ID NO: 34933 - DNA, 601 bp, Human
ttaaaaagtgagtaatgcttcctaggaggaatactcttgaaggaatattcaccaacattgctttggatttaaaaacaaaaacaaaagttggacccaaaggatgtgaaacctgctgataatggatccacgcgtcataatatgtttaaagaggaaatactgatgataattaagttctattttgggaaaaaacaagaacacatatcttatagaatcgttaaaagtcagcatcaaagatatcgcagtgtggcagtattgcagacagaatcaccaatgcagtatttactaaaacttagaggaaaawaacatgatctgagtctgaccaatgctaccaaaaatacttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaatttatatgccatggttgaaaagatgtatcaaactataaagcagcagcatcgaagatttaaaatttagaataaaaattgatcatgtggcatcccaagatataccccaggtataact

SEQ ID NO: 34934 - DNA, 601 bp, Human
tgaaggaatattcaccaacattgctttggatttaaaaacaaaaacaaaagttggacccaaaggatgtgaaacctgctgataatggatccacgcgtcataatatgtttaaagaggaaatactgatgataattaagttctattttgggaaaaaacaagaacacatatcttatagaatcgttaaaagtcagcatcaaagatatcgcagtgtggcagtattgcagacagaatcaccaatgcagtatttactaaaacttagaggaaaaaaacatgatctgagtctgaccaatgctaccaaaaatayttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaatttatatgccatggttgaaaagatgtatcaaactataaagcagcagcatcgaagatttaaaatttagaataaaaattgatcatgtggcatcccaagatataccccaggtataactttttgttatatcaagcatcagtctgttaagattatta

SEQ ID NO: 34935 - DNA, 601 bp, Human
aaacaagaacacatatcttatagaatcgttaaaagtcagcatcaaagatatcgcagtgtggcagtattgcagacagaatcaccaatgcagtatttactaaaacttagaggaaaaaaacatgatctgagtctgaccaatgctaccaaaaatacttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaawttatatgccatggttgaaaagatgtatcaaactataaagcagcagcatcgaagatttaaaatttagaataaaaattgatcatgtggcatcccaagatataccccaggtataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctct

SEQ ID NO: 34936 - DNA, 601 bp, Human
cttactctgctgtcctaagcttagaactagtctcagctgtgagctgatgtgctctgctgtgtttaactggctacccccagagagggtgtccagatgagatctgaagggagggtgcctgacagtgccccagctccatgcggcctgagatgtgctctgctcttgcacttcctagataaattgggaaacttgctggtaaataattctataacccactcttttccttaggctttttggaaaggatataaacaacggaaggagtatatgcacaggcggcaaacgttcattgataatactgattctrttgtgaaggtaaataccctttcctaccataccaagtgcttggcttaaacgtttcccctcatttcatgtttaatctgaaagacagctatagaaagggagggtacatgtgagccttgaagtcagaaggcagtactggatttgaatcccagctctgctgctcatttacctaatcatttttcaagcaggttggttaaaccgctataaaacctcaagtcctttatgagtggttatgagaatcacaagtgaaagtgttctataaccaataaatgttctttgtctagaaagttcaagttgattattt

SEQ ID NO: 34937 - DNA, 601 bp, Human
gctgtgagctgatgtgctctgctgtgtttaactggctacccccagagagggtgtccagatgagatctgaagggagggtgcctgacagtgccccagctccatgcggcctgagatgtgctctgctcttgcacttcctagataaattgggaaacttgctggtaaataattctataacccactcttttccttaggctttttggaaaggatataaacaacggaaggagtatatgcacaggcggcaaacgttcattgataatactgattctattgtgaaggtaaataccctttcctaccataccaartgcttggcttaaacgtttcccctcatttcatgtttaatctgaaagacagctatagaaagggagggtacatgtgagccttgaagtcagaaggcagtactggatttgaatcccagctctgctgctcatttacctaatcatttttcaagcaggttggttaaaccgctataaaacctcaagtcctttatgagtggttatgagaatcacaagtgaaagtgttctataaccaataaatgttctttgtctagaaagttcaagttgattatttagactttaggtagaacccagctttttttcatgttt

SEQ ID NO: 34938 - DNA, 601 bp, Human
actttgggaggccaaggtgggaggatagcttgagcccaggagttcaagaccagcctgggtaacatagggggacctcatttgtattttaaaaaataataataaataaaaacaaatttaaaaaacgttttaaactgtgaagacagagaataatgtgacccagatccattgtgcagtagctccttgatgaaatagcatcctatggaacatatgcctattctgtcaaaaaccattggtagcaattggtccctcatgagacctcttcgatgttttcctgtaaaaacttaaaggatattggatgcayttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaatttagagtaacatgtaaagcgttttgaaccccttaagaaacctcagtgaaagatgaagagtaggctttagagattgattattcagtgggctgctttttttctttatcaagtatcattgtttttagaaaaacta

SEQ ID NO: 34939 - DNA, 601 bp, Human
cagtagctccttgatgaaatagcatcctatggaacatatgcctattctgtcaaaaaccattggtagcaattggtccctcatgagacctcttcgatgttttcctgtaaaaacttaaaggatattggatgcatttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaattwagagtaacatgtaaagcgttttgaaccccttaagaaacctcagtgaaagatgaagagtaggctttagagattgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaa

SEQ ID NO: 34940 - DNA, 601 bp, Human
gcctattctgtcaaaaaccattggtagcaattggtccctcatgagacctcttcgatgttttcctgtaaaaacttaaaggatattggatgcatttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaatttagagtaacatgtaaagcgttttgaaccccttaagaaacmtcagtgaaagatgaagagtaggctttagagattgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaa

SEQ ID NO: 34941 - DNA, 601 bp, Human
ggtccctcatgagacctcttcgatgttttcctgtaaaaacttaaaggatattggatgcatttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaatttagagtaacatgtaaagcgttttgaaccccttaagaaacctcagtgaaagatgaagagtaggctttagagaytgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaatgaatgctttattgaaagttagcattgaatga

SEQ ID NO: 34942 - DNA, 601 bp, Human
tgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaatgaatgctttattgaaagttagcattgaatgatttttattgaatggtgracatgaacacttaagaaataatggatcttagaacttcatatgataatatttggaggcttactgttttcattcagaaatcatgttgagagttagacttcaccagtcaggactcgatagaaaatgggtgaggggaaaactgtgggctagtaacaccaaagagaagactctagagaaatattttacagcattgcatatgtagttttttcaactgttaactgcttactttaaatagaagcccctgggagggatttcttcctgaatctttaaagaagagatatgggaacatagattggatcatct

SEQ ID NO: 34943 - DNA, 601 bp, Human
atttcagagatcatgtaagaaaaatgcctgtgggattttatccaggttgataatgacctaaatgaatgctttattgaaagttagcattgaatgatttttattgaatggtgaacatgaacacttaagaaataatggatcttagaacttcatatgataatatttggaggcttactgttttcattcagaaatcatgttgagagttagacttcaccagtcaggactcgatagaaaatgggtgaggggaaaactgtgggctagtaacaccaaagagaagactctagagaaatattttacagcattrcatatgtagttttttcaactgttaactgcttactttaaatagaagcccctgggagggatttcttcctgaatctttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttc

SEQ ID NO: 34944 - DNA, 601 bp, Human
attgaaagttagcattgaatgatttttattgaatggtgaacatgaacacttaagaaataatggatcttagaacttcatatgataatatttggaggcttactgttttcattcagaaatcatgttgagagttagacttcaccagtcaggactcgatagaaaatgggtgaggggaaaactgtgggctagtaacaccaaagagaagactctagagaaatattttacagcattgcatatgtagttttttcaactgttaactgcttactttaaatagaagcccctgggagggatttcttcctgaatmtttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttcttaaatgttctaaattcaaaaataatggagtaggtgggactctgggagatcaagacttgtcttaatcttttg

SEQ ID NO: 34945 - DNA, 601 bp, Human
aactgcttactttaaatagaagcccctgggagggatttcttcctgaatctttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttcttaaatgttctaaattcaaaaatratggagtaggtgggactctgggagatcaagacttgtcttaatcttttgcagaataatgaaattgtgaaaatacagtcactgttgagagcgaacaaagctagagatgactacaaaacattgggtaagtgagagctttctgaaacaaagcaaggattttttataaaccaggcaaggacatattggtccatattggtcacttcagaggctgctctaagaacagaggatacccattgtttccagtagattttgatcatctcaggccccaggttctaaaccagtacacagaggaacacatggtga

SEQ ID NO: 34946 - DNA, 601 bp, Human
attcaaaaataatggagtaggtgggactctgggagatcaagacttgtcttaatcttttgcagaataatgaaattgtgaaaatacagtcactgttgagagcgaacaaagctagagatgactacaaaacattgggtaagtgagagctttctgaaacaaagcaaggattttttataaaccaggcaaggacatattggtccatattggtcacttcagaggctgctctaagaacagaggatacccattgtttccagtagattttgatcatctcaggccccaggttctaaaccagtacacagaggarcacatggtgaaaggaaatgggccttcctattaaatggaagggatcagccacatggtataatttcttcttcaaagagagtggagttggcataaatgctgatttttttttttcaatctaagcgagagtcaaaaatctaatgcaaaagagttagccagaaaataaccttatatttaaattgtttaatttgttagacatagtctcatctcccaaaaatgacaactgcaaatatcttcctacaatttcattttgaacttttcacagaataatttttaatttttgtttgtttttgttttgagacag

SEQ ID NO: 34947 - DNA, 601 bp, Human
aaatttttaacattctaattatcacgggaacatgcacagtcaaggagagcttgatgataaatttactagtacttacagtgcctagtaagtttagccagcaccttttattgtctaaagtttgtctgaattaagggatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggrgttttttgttggttttttttgtttgttttttgttttttgttttttttttttcttgagacagagtctcgctctttcgcccaggcaggactgcagtggcgctatctcctgcctcagccttccaagtagctgggactacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgttttt

SEQ ID NO: 34948 - DNA, 601 bp, Human
atttactagtacttacagtgcctagtaagtttagccagcaccttttattgtctaaagtttgtctgaattaagggatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggggttttttgttggttttttttgtttgttttttgttttttgttttttttttttcttgagacrgagtctcgctctttcgcccaggcaggactgcagtggcgctatctcctgcctcagccttccaagtagctgggactacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgtttttggtttttttttaaagaaggctaaagaggatttttttttctgagccctaacactaaaatat

SEQ ID NO: 34949 - DNA, 601 bp, Human
gatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggggttttttgttggttttttttgtttgttttttgttttttgttttttttttttcttgagacagagtctcgctctttcgcccaggcaggactgcagtggcgctatctcctgcctcagccttccaagtagctgggastacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgtttttggtttttttttaaagaaggctaaagaggatttttttttctgagccctaacactaaaatatgtttgctgttgcttttatatatgaaagatgacttcaaaataaattttccaaatgaacacaggctagttttcat

SEQ ID NO: 34950 - DNA, 601 bp, Human
caggctagttttcattttattcaaggtaaagtgtttttttttaagcagttatagtgatgttttttgtttgtttacttttttattacaaagacaaattccaattttaaaatctaggcaactttatattggggcataaaaggtaaatagagaaaccatctcggtgagtgagttagatctaagcttctctgggcttcagcaaattgggtgcttttatggtaaccaaaacataaattttcatttctttcttagttcagcatctttagaaaactaaggctttgggattttctaatttaaaaaaaaataacttttctaagtttgttatcatctgttctcacccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatggcaaaaagcctagtattgatagaggaaatattaaattcgagccataacaattagtaaagctaaaatactaatttagttttttccgatgggactgttaatacatatgaagagacacaacc

SEQ ID NO: 34951 - DNA, 601 bp, Human
tttttttttaagcagttatagtgatgttttttgtttgtttacttttttattacaaagacaaattccaattttaaaatctaggcaactttatattggggcataaaaggtaaatagagaaaccatctcggtgagtgagttagatctaagcttctctgggcttcagcaaattgggtgcttttatggtaaccaaaacataaattttcatttctttcttagttcagcatctttagaaaactaaggctttgggattttctaatttaaaaaaaaataacttttctaagtttgttatcatctgttctcmcccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatggcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctg

SEQ ID NO: 34952 - DNA, 601 bp, Human
ttctctgggcttcagcaaattgggtgcttttatggtaaccaaaacataaattttcatttctttcttagttcagcatctttagaaaactaaggctttgggattttctaatttaaaaaaaaataacttttctaagtttgttatcatctgttctcacccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatrgcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctggccacagtgggagggctcatgttcccctaacttggctgcatggatgagcggtggtgcattgctaaggccttccctgaagtggtcatgtcagtggcagcatctttgctggaaatagaaggaaaataaattgatgtgcttcagtggtcag

SEQ ID NO: 34953 - DNA, 601 bp, Human
cgcattccagcttgaaagatgctgaaactaagatgtggtcagttgtaggagcagactataaagtggtctgatttcctgaaattaaaatacctgtaccacaaagtcattctcagatgaagatggcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctggccacagtgggagggctcatgttcccytaacttggctgcatggatgagcggtggtgcattgctaaggccttccctgaagtggtcatgtcagtggcagcatctttgctggaaatagaaggaaaataaattgatgtgcttcagtggtcaggaaataaagggtcccatgatccaaggaaaattctccaataaaggccatttatgcagttgtttgtggtttatgcagttgttttggtgttagttttcttactcctttagtgtcaaaacaccacagaactaaggtggaagtaaaaggaagactgtcaagggcctaggtgtaaaggagggcaa

SEQ ID NO: 34954 - DNA, 601 bp, Human
gggctcatgttcccctaacttggctgcatggatgagcggtggtgcattgctaaggccttccctgaagtggtcatgtcagtggcagcatctttgctggaaatagaaggaaaataaattgatgtgcttcagtggtcaggaaataaagggtcccatgatccaaggaaaattctccaataaaggccatttatgcagttgtttgtggtttatgcagttgttttggtgttagttttcttactcctttagtgtcaaaacaccacagaactaaggtggaagtaaaaggaagactgtcaagggcctaggygtaaaggagggcaactaatgagatggccatggctggactagctcttccaagtcatctttctattactgggtctaatcattcgtcctcaatggaccagacaatttattcttacagtttacccagatctgatctccctaagcatgttaaaaatatttttccaagagtcagagtgccaggaaattaaagcctaaagttccaggtactaaggggaaaacccttttagaatttatgtgagaatgtccctctcaataacaggggctgacccctagattctgagcaccctcccttggccggtgctca

SEQ ID NO: 34955 - DNA, 601 bp, Human
ccttttctaattcagctttcacctacttccggctccttcccaaagatcctttgggctgggagaaaccactttctgcttcctgcagcaagaatgtaagtcacttatctagctcaagcacaaggtctcagggtcgaggtaacttatgttaactttctttcccaggttcctgaggaatgaggcacagataggactatcttcttagcgcatgagtccagggaacagtgtgagagagagctgataaaagggataaaaggggagttgataactagaaaagagtggggccagatatctgttttgtgcrtttatttattgatcagtttccttgtccagattttaaattgtgtgggggtgggtagaatgattctcaccctagaccaagtactttcattggtatatttttctagtaattatttaagaccttgtttctttcctgttgataatcattccaagctttcctaattaaagtatacctgttcctgtcactgcagttggctctgaaaacccaccattaacagtaattcgcaaatttgtatacctgctggaccaaagtgatttggatttccaggaggaactagaggttgcacgattaagggaagaagta

SEQ ID NO: 34956 - DNA, 601 bp, Human
cattccaagctttcctaattaaagtatacctgttcctgtcactgcagttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggtcagtggggtttttgggactgtcagctcccagaagagggaagaygcctacatacagtcaagagtcacttaatgacagggatacattctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttatagga

SEQ ID NO: 34957 - DNA, 601 bp, Human
actgcagttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggtcagtggggtttttgggactgtcagctcccagaagagggaagacgcctacatacagtcaagagtcacttaatgacagggatacrttctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttataggacttatgtcttatatgaggtccactgttgactgaaacatta

SEQ ID NO: 34958 - DNA, 601 bp, Human
ctacatacagtcaagagtcacttaatgacagggatacattctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttataggactwatgtcttatatgaggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatataccttcagaataagactagggcctttatatgaatacaaaagagatatttaaagagtaattaat

SEQ ID NO: 34959 - DNA, 601 bp, Human
agactattttaaagcaggaggaaaggtttgcgatatagtagaggagaaaatagtgcctaaggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggcaaaaagaatggtttggagaaagaagacagagcaactgaaataagaggtttcctggaggcacaggagccaaaaaataaaaaataaaaaagtataggtcagcctagctggaaggaaagcctaaattaagagactgaagctaatctaaaactagtgctaaaattcccattcatgagtatgatgtatcatctaggagcccagatttgcaggccagtactacctgaaactcaggactgag

SEQ ID NO: 34960 - DNA, 601 bp, Human
aggtttcctggaggcacaggagccaaaaaataaaaaataaaaaagtataggtcagcctagctggaaggaaagcctaaattaagagactgaagctaatctaaaactagtgctaaaattcccattcatgagtatgatgtatcatctaggagcccagatttgcaggccagtactacctgaaactcaggactgagatttttaactattaatacttaattatactacttcactgcttatattaacatgtggccttgagcatgtttcttaacctctctctgagtgtgttttcttccctggaaaatgktctaggtgatttacatatatttttaatcttcacagcaactcagtaaaattgctgttattacactcactctacagatgaggaaactgaagcttaggttaacctgtgtaggtttaccaagctaattatactctgcagatacccatatcttttatgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggac

SEQ ID NO: 34961 - DNA, 601 bp, Human
gatgtatcatctaggagcccagatttgcaggccagtactacctgaaactcaggactgagatttttaactattaatacttaattatactacttcactgcttatattaacatgtggccttgagcatgtttcttaacctctctctgagtgtgttttcttccctggaaaatgttctaggtgatttacatatatttttaatcttcacagcaactcagtaaaattgctgttattacactcactctacagatgaggaaactgaagcttaggttaacctgtgtaggtttaccaagctaattatactctscagatacccatatcttttatgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaagtgagttttgatgaataaaaagtatctgcccctgtttgttatccttgtct

SEQ ID NO: 34962 - DNA, 601 bp, Human
gatttgcaggccagtactacctgaaactcaggactgagatttttaactattaatacttaattatactacttcactgcttatattaacatgtggccttgagcatgtttcttaacctctctctgagtgtgttttcttccctggaaaatgttctaggtgatttacatatatttttaatcttcacagcaactcagtaaaattgctgttattacactcactctacagatgaggaaactgaagcttaggttaacctgtgtaggtttaccaagctaattatactctgcagatacccatatcttttatractccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaagtgagttttgatgaataaaaagtatctgcccctgtttgttatccttgtctgggttggctcttgtgtccatc

SEQ ID NO: 34963 - DNA, 601 bp, Human
actgaagcttaggttaacctgtgtaggtttaccaagctaattatactctgcagatacccatatcttttatgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaartgagttttgatgaataaaaagtatctgcccctgtttgttatccttgtctgggttggctcttgtgtccatcttcaagcttcccaaagcaaacctccattcacacaagcacattctggagcaagtcagaacctcacagggagaaggaagaggggctatccccattgctgtgccgggctctgtccttggagctccagcagacaggtgctgttccatcagcacagccaccggcccgtcctctctcttcccctttctgggttcagcattgcctccgttgcttccctccctccattcctctcatta

SEQ ID NO: 34964 - DNA, 601 bp, Human
atgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaagtgagttttgatgaataaaaagtatctgcccctgtttgttatccttgtctgggttggctcttgtgtccrtcttcaagcttcccaaagcaaacctccattcacacaagcacattctggagcaagtcagaacctcacagggagaaggaagaggggctatccccattgctgtgccgggctctgtccttggagctccagcagacaggtgctgttccatcagcacagccaccggcccgtcctctctcttcccctttctgggttcagcattgcctccgttgcttccctccctccattcctctcattatcctgccttcaccaactctctctgtttctaatgcagaggaatttagatctgccccagatcttgctcac

SEQ ID NO: 34965 - DNA, 601 bp, Human
taacaagactttcctgtcgtatatttaaaatcaaggtgatagatttattctgtgtatttgagggagttgaacgatttacatacatgtcgccagctatctgaagaggaaaaatgtggattaactggcactgtaagccacatttattctagtgatgtcttaggacttcttatagataaggattatcagacagccgcctgcctagattcccccttgacctctatctggtggtaactgcacttcctttctttgtactgaagacattttatatattggtaaaacaagggggaaatgttgctttttwaaaaatgttatcggaatgtaaatcaactcccctccctccttctctataaaagcaattggggtgacagaagtaagtgggtaagtcaaggctgcctctctctgaattgagaatgagaaagaataaaatcatggacctggaaggcaacagatgtagccacatggaactgtcttactccagagcttcctagagctctggaccccagctgctcaatgggctgaccccagctatgggagaatggggtgccaggaagtaaacagatttagagcttgccatttaggcaagacctgacggtggttctca

SEQ ID NO: 34966 - DNA, 601 bp, Human
tgagaatgagaaagaataaaatcatggacctggaaggcaacagatgtagccacatggaactgtcttactccagagcttcctagagctctggaccccagctgctcaatgggctgaccccagctatgggagaatggggtgccaggaagtaaacagatttagagcttgccatttaggcaagacctgacggtggttctcatccccaggggcaactggaaatgggggcgggcccatgtccgcttgtgaaaatgactaggggcccctgctgatagccggtggtgggaaggggccagggtgatagacrctggtagtgcatgcagagcaaaacactgttgtccacactgcccatagtgcccctctaaggacactgggccagcattcctgatgtgcaaatagagtcctcacgtggaggtccagctaagagctcagtcaaaaatctgaaaaaagttttaggaaaagcaactttcttgccacttactctgggacagtgaactaatgttaagtggcaggggaggtgttctagaacagcgactttcaaatatgaaagtcgcatgccattagggtcatgaaatcaatttagtgtgtcacaatgagcaacctttaa

SEQ ID NO: 34967 - DNA, 601 bp, Human
ccattttgtctttttaatcattcatgtgttcactgaagtagcatttttaatttctctcaagaaatttttctttgcattcatgacttggctgtttggtgcaagaggcctagcattacgcctgtcctagcttttgatatgccttcttcactaagcttaataatttctagcttttgatttaaagtgaaagatgtgtaactttcacttgaatactttgaggctatcatatggttattaattaacctaatttcaatatcattgtgtctcaggaaatagggggcccaagaagagaagagaaaaaggraagttggtgaagcagtcagaacagacacatttattggttaagttctatgggcgtggtttgtggcaccccaaaacaattacaatagtaacatcgaagatcactgataggctgggcacggtggcttacgcctgtaatcccagcactttggaaggccaaagcgggtggatcaagagggcaggagatcgagaccagcctggccaacatggtgaaaccccgtctctactaaaaatacaaaaattagccaggtgtggaggcgcgtgcctgtagttccagctactcaggaggctgaggcagtggaat

SEQ ID NO: 34968 - DNA, 601 bp, Human
atgtgaagggaggagataaagagtatgagaattaaaaaagcagtaatctcatcaaattttttacaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacaggtgagaacaatttatcgttcactctgagtttgggagtaatactatgttacatgtttgtggcttacagggagtattttgtcatgcktcagctataatagcatacatgttttgagcatctactaagtaccaagtgctgttgttggtgctttacatacattatctcatttaattcttaccataaccctgggagccgtgagagaatgagtactgttgttattcctgcattacagatgagaaaactgagacacagccagtaaatgataaagcaggggttttgaaacgcaggcagtttgacttcagagaccatgctctttacagtattatactacggttaccttcagaaacaatataaatctgataataacaaaacaaaaacaggtgctgt

SEQ ID NO: 34969 - DNA, 601 bp, Human
gaacaagaaaaaaggaggagaaatggaaatactgaataacaccgacaaccaaggaataaaaagtttgagtaaggagaggagaaaaacactagaaacatatcagcagctgttttaccttttacaggtgagaacaatttatcgttcactctgagtttgggagtaatactatgttacatgtttgtggcttacagggagtattttgtcatgcttcagctataatagcatacatgttttgagcatctactaagtaccaagtgctgttgttggtgctttacatacattatctcatttaattcttacmataaccctgggagccgtgagagaatgagtactgttgttattcctgcattacagatgagaaaactgagacacagccagtaaatgataaagcaggggttttgaaacgcaggcagtttgacttcagagaccatgctctttacagtattatactacggttaccttcagaaacaatataaatctgataataacaaaacaaaaacaggtgctgtcatccatgaaaaaattaaaataactgtatgtgaaaaacagatatttaccagaaccagtctccccttctatgggggaagagccagagggtttg

SEQ ID NO: 34970 - DNA, 601 bp, Human
gtggatccatagttctcccttgtaagagtcagatgtctctcagagtggggccactgctgggattccttcaaagcctggagatgcttagatctttgtttgaggatgtcactggcagtagatgtatagagagcacattacacaaaccataaataagaggcgtggctaacctcatggagaaacacgatgttaattttggtaggtttgaaaattctctacttggaataagagattggagaacatcttcaaacatacgaacatcttcacacaagtggccaccacatggcggcacagaaggaaaagsttaacagtacttagaattgtctgtggaacccactgtttcacgccagcaaacctagaaagaaagggggctcactttaaacaggaaaggactttggtctgcctaatttagtagtcaaccaccagtttgaaatttaatcttaggcacttatcattttttacacccatgaaatttcaagcatattgaagattctttagaatttagttttctcaatttgacagaatttgtcataagttaaaatctagtcattgtttattatataggtggaggcacatttatgggaagaagaaaaagtgcaggagc

SEQ ID NO: 34971 - DNA, 601 bp, Human
cctgagtagctgggactacagacacctgccacaatgcctggctaattttttcatggtttttgtagagacagggtttttccatgttgcccaggctgatctcaaacacctgagctcaagtgatccacccatctcagcctcctcctaaagcactaggattgcaggcatgagacaccacacctgacctagcaaaaattcttaaccaaagccgcagtcagctagtataggtttttggggggtttgtctcttcagtatgaacctaaatttaaaatttttaggtaaccttaggaggaatggtgagtaagcatctttctttagttatagagtaagtttcctttctcctaattcctatatacttcacattgaaaaacagtcactacagagctatcaagaaaaagtactgagctgcttatttataaaatttcaaccaatcattatgaacttaaaagtaaacctaagtgataaagtaaaccagaatttaaggcttcttaaaagctgcccaaactgcttgagtatattagatgaataccagttttcaagtatggaaaaattttcttctcttgtcagaaagaagatgaagattaggagtattaaatttctcttt

SEQ ID NO: 34972 - DNA, 601 bp, Human
ctgagtagctgggactacagacacctgccacaatgcctggctaattttttcatggtttttgtagagacagggtttttccatgttgcccaggctgatctcaaacacctgagctcaagtgatccacccatctcagcctcctcctaaagcactaggattgcaggcatgagacaccacacctgacctagcaaaaattcttaaccaaagccgcagtcagctagtataggtttttggggggtttgtctcttcagtatgaacctaaatttaaaatttttaggtaaccttaggaggaatggtgagtagtcatctttctttagttatagagtaagtttcctttctcctaattcctatatacttcacattgaaaaacagtcactacagagctatcaagaaaaagtactgagctgcttatttataaaatttcaaccaatcattatgaacttaaaagtaaacctaagtgataaagtaaaccagaatttaaggcttcttaaaagctgcccaaactgcttgagtatattagatgaataccagttttcaagtatggaaaaattttcttctcttgtcagaaagaagatgaagattaggagtattaaatttctctttg

SEQ ID NO: 34973 - DNA, 601 bp, Human
ttataagtgtgagccaccatgcccaagctttgccagtgtctttggacaccagattctactggctacccgccctgttttctgcgtctctacaataaatattaatatgtggttcaaaaaggtcaacagtgaaaagtagatataatatgttaagtgtatcatatagtgtgtatcatttaaatcctatcataattttctactatagcttcctatagtatgatatgaataatattaagtaattaatatttgatattaatattttaaaatattaatatatgataggaagctaaagtagaaagttatrtaatatcagtctataggaaactgtagtagaaagttacactatatactaatagcatagagatgagtacctggcatataaaaattattttatatactcatctatatgcttttagtgacattaagtcattgaagagcagggaatcagatactgctttgtgctttaataatatattaacttattgttttgtgggatttttttgttttctttttccttctttccttctagaccaaccctttatacttggctaagctgattttccagatgccacagaacaagtccactaaatttatggatactgtt

SEQ ID NO: 34974 - DNA, 601 bp, Human
atcataattttctactatagcttcctatagtatgatatgaataatattaagtaattaatatttgatattaatattttaaaatattaatatatgataggaagctaaagtagaaagttatataatatcagtctataggaaactgtagtagaaagttacactatatactaatagcatagagatgagtacctggcatataaaaattattttatatactcatctatatgcttttagtgacattaagtcattgaagagcagggaatcagatactgctttgtgctttaataatatattaacttattgwtttgtgggatttttttgttttctttttccttctttccttctagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaagtatgtatacaaatatgtatgtaaaaataccagtgaatcaatccttttgttagtggtggctgtctttgatttactaaaattatttttaaattc

SEQ ID NO: 34975 - DNA, 601 bp, Human
gtcattgaagagcagggaatcagatactgctttgtgctttaataatatattaacttattgttttgtgggatttttttgttttctttttccttctttccttctagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaagtatgtatacaaatatgtatgtaaaaataccartgaatcaatccttttgttagtggtggctgtctttgatttactaaaattatttttaaattcttataagttattcccacatattaaaatatatcaagtttcttgagaatacttctatattattagagctatattcaagtaccattttctcccaccagtgatactttctctagtgttaaattaacttttgattttgtatgcctgtaacaactgaaaatcaatagcatattgaaagtcagtgaaaacatttaacttaattaaaattctgagtagtaaagccattaacaggtgggaatgcagagt

SEQ ID NO: 34976 - DNA, 601 bp, Human
ctttgagtgggatttgaaaaagtgaaaacagttcattcaatcaagaaagttgtttttgaaatttgataactacaggggcatggtacttgtaccgtgtcacccagtattgctagtcctggtccattttcagctcatacctgccttctagattgaaattgaggctgtgactttattttcagatcctcaaattgctcatctaagaaacatacacgttataaactgggaacagtggctcacgcctgtaatcccagcactttgggaggccaaggcgggtagatcatttgaggtcagaagttgggascagcctggccaacatggtgaaactctatctctctgaaaatacaaaaattagctgggcatggtggcatgtgcctgtaatccgagctactcaggaggctgagataggagaatcgcttgaaccctggaggaggaggttgcagtgagccaagatggcgctactactctccaacctgggcagtagagtgagactctgtctcaaaaagaaaaaaagaaatatacaccttataaatgattgcttgtttttaaagcacaccaacttagattttcatagagaaaagtataattccatgaagtccttgcc

SEQ ID NO: 34977 - DNA, 601 bp, Human
agagtgagactctgtctcaaaaagaaaaaaagaaatatacaccttataaatgattgcttgtttttaaagcacaccaacttagattttcatagagaaaagtataattccatgaagtccttgccttccagagggagaatacattgtttaaaactgtatccaggcccagaaccatggctcaggactgtatttccagcactttgggaggccaaggcaggtggatcacctgagatcaggagttcgagaccagcctggccaacatggtgaaaccccgtctctactaaaaatacaaaaagtagccccrggcatgtggtggtgcacacctgtagtcccagctactcaggaagctgaggcaggagaatcgcttgaacctgggaggtggaggttgcagtgaaccaagatcacaccactgcactccagcctgggtgacagagcaagactgtctcggggaaaaaaaaaaaaaaaaaaaatctgtatccatggaagcaaaccattttgttttgtcttgggcttttttagatcaaaagtggaccaggtacaggacatagttactggtaaccctacagtcatcaagatggtcgtcagcttcaatagaggtgcccgg

SEQ ID NO: 34978 - DNA, 601 bp, Human
gttttgtcttgggcttttttagatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccaggtaatagaatcaggaaggtgttggtcttctgttatgttttatgatatttttacrtgtgtatttattgatactcttaaactttgttaggcgaactgtacaaagtcagttatcaatccaaaatgttacctccctttaacatatccatgcaaattacatcttgatactaaatggtattttcacatttcagagccaggtgatccccaatgccacaacttccataattctctcccttgtttattttctttgtgtatttctaaacctagacctagagatggtgtagactctctcttcacctgataatacgtacttttctttacagttaccaggcaagtaactttaaggtgtaaggtttaa

SEQ ID NO: 34979 - DNA, 601 bp, Human
ttcctggaacgttcttggaatacgatgtaaaataagcccctgtagtgaagacagcagttttcccttatattgtgtttactattttaaaagattgcctacatttaccttttaaattcctgactgttctctaaagaaggggcaatacttcagtagcaaacacagctcagttattatcatcagtggaagtcctgtgattccattaccatctcatcttatgtttaatttttagaaaaactactcagctgaagttgactggaacaattgctgtgtgttttttcctcactccgccttttttccattrttttcttttgtcatctgttttatatgtagttatggattgaggtatatagccaaagtactgaagaattcgatccatgagaaattccccgatgcaacagaagatgagctattaaaggtagattttcaagggtaatctcaccatagcttctcctgggggtatgaatcaaaattaccaacatataactttgtaagattattccccatgtatgattatttataataagctgcaggtcttctgtttctaatgactctcaagataattgattaagctgaggttaatttggagatcctagacattatt

SEQ ID NO: 34980 - DNA, 601 bp, Human
ccaacatataactttgtaagattattccccatgtatgattatttataataagctgcaggtcttctgtttctaatgactctcaagataattgattaagctgaggttaatttggagatcctagacattattgaaattctttgcattagagcattttgggggcaatgagcattttttcatcaaaaataactttgcaaattatgctattaataatgtgtgattatattcattgcctttattaaactccttgttaggatttacatcagaaaatgatctgctttctcttgggaaatgtaggagaatmtatatctttaaaaaaaaaaagaaaactaaaactcttgagttttctctcttaaaaatggtcatgcacttctgcgtcactccagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagac

SEQ ID NO: 34981 - DNA, 601 bp, Human
acccttgattaacacaggtttgaactgctcgggtctatttatatatggattttttcaaccaaagacagagagaaaatacagtattcatgggatgcagaacccacatatacaaacagatgacttttcacatacatgggttccacaaggccaatttcaaacttgagtatgcacaaattttggtgtgtatgggggtcctggaaccaatcccccaaacataccaaggaacgactgtagtaggaaatggaatacttgattttgaaaggttaggaaaacccagattttatatttgttgatgattgtrtatgtgaatatgttctgttctattctcaagcctttcttaatgacacatgtaagaagatttaattctattgattttgtgtttccaaattatatcactaatcattaacaagaaaggcatgagtctggtagtcagattcactcctcctggagctctgaggaaacactttcctcttgtcatgtttgttctcatgtctgccatttaatcaacaggccatagaagtgtaacatcagtttggcctcttttaatcctcacttggaaactcatttctcattcctcggtctcccttggagtgagtgactt

SEQ ID NO: 34982 - DNA, 601 bp, Human
ctaattgcttttttttctattgtattcctcacacagacttgattcttagatcaagaattatcatttttgactttttaagtttcagggaccatttttaaaataacatttttaagatgacctacgcataggtcactatatcactaagtcacaaacagggcctgaggcccttgccactctctccaatcctgtttgaggagctgggtccaatatccagaaacatggatgcagctccgacagccaggagccagcctggaagaagctgtaacacgtcctctcaaggtttgagatgggaacaaagtayatgtcatcattcaaaatttcctagctattttgatgaaactgtttaatgcacatgtttgagtctgtcttaagacttttcccccctttattaggaaatatttcaaagaagcatgtaatgtccctgagccagaagagaagtttaatatggacaaatacacagacctggtgacagtcagcaaaccagtcatttatatttcaattgaagaaatcatcagcacacactcagtaagtggggatggggagccatcttagcaatggacccatgatttaggcatctgttatcttgaaaatgcttaatctc

SEQ ID NO: 34983 - DNA, 601 bp, Human
gccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatytggtttgcatgcagacatcactgccgtcagccattagcatgtattaagtatctgttgggtgcagggcactgtgctcagtggcatggggaaggaattgggaggctttagatgacttttcaaacattaaaattaaaaaaaaaaaagctaagcattgaggggtttgcattgttttctttttaagatcaattggaacttatttcatgaaaaaatcttggtttttaaaaggtaaccatttcaagaatagtttcagaccttgtgagttgaagcaaggtcctggggatatgttagcaatgcaccctg

SEQ ID NO: 34984 - DNA, 601 bp, Human
caattacacatcaaaggacataatcaactgagtgaaaagataatgtatggaatgggagaaaatatttgcaaatcacatgtctggtaaagggttaatatctagaatatataaagaattcctacgaatcgacaacaaaacaacccaattataatataaacaaaggactttaacagatgtttttccagagaagtatacagatggtcagcatcactaataattagagaaatcaaaactgaaactgcaaggagataccactcacacccagtaggatgattaatatcaaaatttaaaaaaaaaaaaacagaaaataagtgttgagaaggatgtgaagaaaatgcaacccttgcaccccgttggtgggaatgtaaaatggtgcagctgctatggaaacaggatggtctttcctcaaaaatttaaacagagaggctggagtatggcggcacgatcaattaaaaaaaattaaacatagaattacctcataatctaacagttccacttctggaagtatacccataaaaaattgaaagcagagtcaaagagttatttgttcactcatgttcatagcagcattgttcacaacagccaagcgtctatcactaga

SEQ ID NO: 34985 - DNA, 601 bp, Human
gattagtgaggaaattcagttaaccaacgtttatttccggtataaaatcataatataaaaacacgtacctacaataagacattatgatagcatctgatttattggccttccttcctgttaaactgatcctggatatatttaccagctttgacttttatttgtaccctgcttcctgccgctaaagatttcaagtgaagcattcacactttaaataatactatcttttctccatcaaagaatcaaggatattccacatccatcctttacacacagagtaagaaagagaatgagattcatgatwcaacaccataaatcaaaagcacccgctgaccaagcagtgcagttttcaagaacttatacaaacccaagaatgcatatcagtacattagaacagttatgtattggggtgagatggagactggaagtggaaaaatgaggacaaagggaacaagtatgtgttgaaacaatacgaaacatattacttccaagctacctgtcctgagttctgaggttttaatttgtggcaagagctttctctcctgccactgatgtgctgaagtgtgcttgaagtgtgaatgaagacagcattcatctccacttg

SEQ ID NO: 34986 - DNA, 601 bp, Human
acagcattcatctccacttgatttttttttttaaacattcaatcatctgtgaaaacaacaggaagagcttcttcactgtgctgtgttgatatgttcctctcttaggcttgttgattttgtcctcagatcatctgaggctccattcggtcatgcagcaaatgcttgactacctactctgtgttcatgcgctgggcttgaggctgggatacaacagtgggtaagctggaaacagcccctgtcttacaggggtggagagcacagttcgacagtaggaccgcaaccaagttgcaggactaggacwcacccttggcctcacaagagttgagggcggttctttttgactacagattaccaaggcagatgaaaatttcagggagacaattcagggcagggcaggagagaaagggggagaaagtctacaccctgggttcctctgaacaagtgccaattataaagataactggaaatacagattgtgtggttttgccatgtaaatgaaattaggccaagtatcccatgatctcataagctttgtcctttagaagtaatgggaagaaattttttcttaattagttttgtctgctatttgaacatcattttc

SEQ ID NO: 34987 - DNA, 601 bp, Human
tgtcgcccaggctggagtgcagtggcatgatctcgggtcactgcaagctctgcctcctgggttcatgccattctcctgcctcagcctcccaagtagctgggactacaggtgtctgccaccatgcccagctaattttttgtgtttttagtagagacggagtttcatcatgtcagccaggatggtctccatctcctgacctcatgatccgcccacctcagcctcccaaagtgctgggattacaggcgtgagccaccactcctggccccaccttcattcttttgcatgtggatgtccagttgtyctagcactattagttaaacagactattctttcttcatagaatggtctaggcacccttgtcaaaaactaattgacaatacatgtatggctttatttctggattttcaattctactccattcacttatatgtctatccttgtactagtgccacaccatattgatcactgtagctttgtaatgagttttgaaatacggaagtcctccaacttctttcttctttttcaagattgttttagtcttgcagttgaataggtctcttgcagttatatgtgaattttaggatcaacttttccatttatg

SEQ ID NO: 34988 - DNA, 601 bp, Human
atgtaggtaacaatttgaaatcaacactgactggttagccatccctgaaagtgaaatttggatattgcccaaaaggttcaatagaattagttctatgattttagccaagccctgcttctaaatatacttcctttaaagtacatatttgaaaaaatcttgatactaacagataattacaaagtgcagcattgacagggaacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccacctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgc

SEQ ID NO: 34989 - DNA, 601 bp, Human
gcccaaaaggttcaatagaattagttctatgattttagccaagccctgcttctaaatatacttcctttaaagtacatatttgaaaaaatcttgatactaacagataattacaaagtgcagcattgacagggaacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccrcctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgcaataataatagaaacaaagtgcacaataaatgtaacgcacttgaatcatcttcccgaaaccatccc

SEQ ID NO: 34990 - DNA, 601 bp, Human
catcctgtatttacagctgctccccattgctggcattaacacctgagctccacctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgcaataataatagaaayaaagtgcacaataaatgtaacgcacttgaatcatcttcccgaaaccatcccccaccctgtccatggaaaaattgtcttccacaaaacctgtccctggtgccaaaagggttggggaccactcctttaaaatattgatttgaactctcatgaggatgacttttttgatttgaacactctcatcaggatgacttttttccaagctaataaaccgaatttgtaactcaagcataagatatagttcttgagattcattagagaaccaaatttaactaaaatcggacaatgacttttataagttat

SEQ ID NO: 34991 - DNA, 601 bp, Human
agtataagcagatgacagagggggagcttcaggaatgctactggtaataatagataccatatgaatggagtggccaaacccaaggggccacaccagcttacaagcgccgtatgggctcatttatctacagtggggtttgagcacagctatgatgaataaactccctggtgtatttctttctctttttttcttaattctttttcaaaattagatacctcctcattcagggagagcaagacccgtggtttggatcaacctatcttacatatttgaagagccctggcgccagtactctaagcarttgatttatgctggtcagaccatatccagaatgttatatttggactggggtgggaagggggatgcatattaaggtcattggtaactggaatgtgagcaggactgtgagctctctgcagatgccattgtgaggagctttaagggactgagtggtttcacttggaaaaaggaaagatggtggaagaggggatagaggaacacagtcttggcatttctctataggtttttcaggagctgctgatttggaaagggaattggacttgtttcctgcagctctagtctcttaggtcttagttgccac

SEQ ID NO: 34992 - DNA, 601 bp, Human
aaaaggaaagatggtggaagaggggatagaggaacacagtcttggcatttctctataggtttttcaggagctgctgatttggaaagggaattggacttgtttcctgcagctctagtctcttaggtcttagttgccacatttgtacaatcagggattggattgtttttcaaaggtctctctccgggccacagtcctaagactaaccaggtttcatgactgggtggccctggaaggcaggcctctcagagtgagctcctgtttgagaatggaatgtgccaatattgtactctccaaaagaaawttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattttacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtg

SEQ ID NO: 34993 - DNA, 601 bp, Human
ggattggattgtttttcaaaggtctctctccgggccacagtcctaagactaaccaggtttcatgactgggtggccctggaaggcaggcctctcagagtgagctcctgtttgagaatggaatgtgccaatattgtactctccaaaagaaatttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattktacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtgagtgcttaccatgtgccagacctcacagaaggctttagatcttttcatccaatccttgcatcagtcctgagagattcctgttttataaacgaaaaaacaaaacctacaaggattatataacttgcacaaatccacatggctaatatgcaac

SEQ ID NO: 34994 - DNA, 601 bp, Human
taaacgaaaaaacaaaacctacaaggattatataacttgcacaaatccacatggctaatatgcaacaagagtccaagccaagacagatttggctttaaatctgtccgtccccgtcgtccttaagcactagacacactgtagtgggagggaggtgggttccctgtcatgggactggatggttacttatgtctgaggtagaactttggcaatgaattccacaggcctggtgtacagtagaagtccaagggaaacaggctgtgtgagcagtttgtcctccagcaactcttgagcaaataaacaytctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatgccatcccccacgtgg

SEQ ID NO: 34995 - DNA, 601 bp, Human
tatatttgtaattaacttgaagggttttctctgtcatttgggagtagttgcccatatccttcaaaatgtgaaaattttgttctcatttctaaatttcatgctacatgaacatttcctgctagagtttaggaagaaaaattagtcattcagtgatatcatgtaatgactctgaaataactaaagttaaatgcaataacgggactacagtaaaagtgaaacttcagatgtcaattagaccagtgtatgtataatttaaacaaacttttgtctgtgtttccttttcttctttcttttctttctktctatctatctatctagatatctatctgagatggtatctcactctgtcacccaggctggagtgcagtggcacgatttcagcttactgcaacctctgcctcccgggtttaagcaattctcacacttaggcctcctgagcagctggaattacaggcacatgccaccatgcccagctaatttttgtatccttagtagggatggggtttcgccatgttggccagggtggtctggaacttctgaccgcaggtgatccgcccacctcggcctcccaacatgctgggattacaggagtgagccaccg

SEQ ID NO: 34996 - DNA, 601 bp, Human
tttgtaattaacttgaagggttttctctgtcatttgggagtagttgcccatatccttcaaaatgtgaaaattttgttctcatttctaaatttcatgctacatgaacatttcctgctagagtttaggaagaaaaattagtcattcagtgatatcatgtaatgactctgaaataactaaagttaaatgcaataacgggactacagtaaaagtgaaacttcagatgtcaattagaccagtgtatgtataatttaaacaaacttttgtctgtgtttccttttcttctttcttttctttctttctrtctatctatctagatatctatctgagatggtatctcactctgtcacccaggctggagtgcagtggcacgatttcagcttactgcaacctctgcctcccgggtttaagcaattctcacacttaggcctcctgagcagctggaattacaggcacatgccaccatgcccagctaatttttgtatccttagtagggatggggtttcgccatgttggccagggtggtctggaacttctgaccgcaggtgatccgcccacctcggcctcccaacatgctgggattacaggagtgagccaccgcgcc

SEQ ID NO: 34997 - DNA, 601 bp, Human
ctccctaaacaaaagttaattatttaattaactatttcttagcacagctacacataattttcctggatcattcttaatttaattgattgccaaggaatccttgtaatagtttttaatttaaaaaatataaaaggctgggcatggtggctcatgtctgtaatcccaatactttggaaggctgaggtgtgtagatcacttgagcccaggagttcaacaccagcctggacaacacagtgagacccccatctctaatttttaaaaatttttaataaaaaatgtaaagcaaaacttcaaatcacaygtttgttaatatgtgggtatgttttaaacaatgtgggtaaaatattatactaggttagtataaaagacttttactccttactatttttcattttcccctaaatgtatcatgaataagtgactaagaacacagacttctgagatcaactatacctctgcacctcctaggtgtgtaactctgtgcacttagaagcattgctgtgccgcagtttcctcaactgtaaaatgggtataataatagtacccagctcacaggcaggattaagtcaattaaacatgttaagtgggtacatctgtatct

SEQ ID NO: 34998 - DNA, 601 bp, Human
ccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggtttttggaaacagtattctttcttccttcacttagcagacatttgctaatcaccagtcaagtgctgggcactctgtgaggtggcattagggattcatggktgcatatgctgtggttactgccctcttcaatgctacagatttttcaaggtttcaaagcagttgatgactttttttttttttttttttttttgagttggagcctcgctctgttgcccaggctggagtgcagtggcacaatctcgactctctgcaacttccgcctcccaggttcaagcgattctcctgcctcagcctcctgagtagctgggactacaggcacgcaccaccacgcccagctaatttttgtatttttagtagagacggggtttcaccatgctggccaggctggtctcgaaatcc

SEQ ID NO: 34999 - DNA, 601 bp, Human
tagcatagctcttgtaagctataagcagcttatgcaacttaatgttctaggaattctatttaaatccaagtaatagttatcaatgttgaatcttttcactcagtcttgacagcccagtgttgttttttcaaaccttgggaaatatttgtcagatgaaaaagtttgttcttttcttattttaaaaatgaatttaacaattaaatgtaaacttttttagtttaaagtactattcaaagaggaatattcaaaatagtctgaagaggccgggcacaatgtctcatgcctataatcccagcacttygggaggccgaggcgggcagatcacttgaggtcaggagttcaagaccagcctgaccaacatggtgaaaccctgtaactactaaaaatacaaaaattagccaggcatattggcacgggcctgcagccccagctactcaggaggctgaggcaggagaatcgcttgaacctggaggtaaatgttgcagagatcaggccactgcactccagcctgggtgacagagcaagactatgtctaaaaaaaaaagtctgaaaaaattgcatttctgctactttgtgccccttttaaaacgcaatttttcct

SEQ ID NO: 35000 - DNA, 601 bp, Human
gtaagtgaaagcttttcaattccccaccagcactagaattaaagtggcttacctgttgtatattgagcaaatagcattagtaagttagggaagcactttcattattccttttgtcttttttagccaaagatttttttaaatactattatttttaaagtctcttgtttttggaatgtattttatataattgataatattagataatgccaggtgtttgctaattgcacagagcagctgaatgtttttaaattgcttcatggttttaaaaaattattgacacaactggcaaaatttggcagcygtctattatccattagcataagtattataggtttttatatacagtatagccatttttaatgaatatcctttgcttagtaattattcttatcactagactatgatcaatgctagttaaattttaattacccatttaaatatgtagtacaatatttttatataatccttgtcatcaaattggcaggaggaaatggtgctgtatggaaaaatctattgcattaatcatagatcttttaaattttattgcaaattgactataattttatgtattcctggggtacaaggtgatgttatcatttat

SEQ ID NO: 35001 - DNA, 601 bp, Human
attatttttaaagtctcttgtttttggaatgtattttatataattgataatattagataatgccaggtgtttgctaattgcacagagcagctgaatgtttttaaattgcttcatggttttaaaaaattattgacacaactggcaaaatttggcagccgtctattatccattagcataagtattataggtttttatatacagtatagccatttttaatgaatatcctttgcttagtaattattcttatcactagactatgatcaatgctagttaaattttaattacccatttaaatatgtartacaatatttttatataatccttgtcatcaaattggcaggaggaaatggtgctgtatggaaaaatctattgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactgtgcaataga

SEQ ID NO: 35002 - DNA, 601 bp, Human
gtttgctaattgcacagagcagctgaatgtttttaaattgcttcatggttttaaaaaattattgacacaactggcaaaatttggcagccgtctattatccattagcataagtattataggtttttatatacagtatagccatttttaatgaatatcctttgcttagtaattattcttatcactagactatgatcaatgctagttaaattttaattacccatttaaatatgtagtacaatatttttatataatccttgtcatcaaattggcaggaggaaatggtgctgtatggaaaaatctrttgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactgtgcaatagatttcaaaaaaaaactgattcctcctaagatttcatatcctttgaccatcatctccccgtttcccccac

SEQ ID NO: 35003 - DNA, 601 bp, Human
gctagttaaattttaattacccatttaaatatgtagtacaatatttttatataatccttgtcatcaaattggcaggaggaaatggtgctgtatggaaaaatctattgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacaytattattagctatattcaccacactgtgcaatagatttcaaaaaaaaactgattcctcctaagatttcatatcctttgaccatcatctccccgtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgt

SEQ ID NO: 35004 - DNA, 601 bp, Human
aaatatgtagtacaatatttttatataatccttgtcatcaaattggcaggaggaaatggtgctgtatggaaaaatctattgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactrtgcaatagatttcaaaaaaaaactgattcctcctaagatttcatatcctttgaccatcatctccccgtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgtgtgtatatataccacattttctttac

SEQ ID NO: 35005 - DNA, 601 bp, Human
ggaaaaatctattgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactgtgcaatagatttcaaaaaaaaactgattcctcctaagatttcatatcctttgaccatcatctccccrtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgtgtgtatatataccacattttctttacctgttcatctgttagtagattcttaggttgatttcataacttagctaacgtgtgagtagtgctgcaa

SEQ ID NO: 35006 - DNA, 601 bp, Human
actttcagtagaaatgagattgttagggatttactttaaggcatttcacacaagatccacagtcgggcgaattggatttgggttctgattctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccrggaggcagaggttgcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctagccacatagtgtttgttaaatagattaaaacagtcctagtaatatcgtta

SEQ ID NO: 35007 - DNA, 601 bp, Human
tgagattgttagggatttactttaaggcatttcacacaagatccacagtcgggcgaattggatttgggttctgattctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccgggaggcagaggttrcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctagccacatagtgtttgttaaatagattaaaacagtcctagtaatatcgttatctaggaatacaca

SEQ ID NO: 35008 - DNA, 601 bp, Human
ctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccgggaggcagaggttgcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctagccacatagtgtttgttaaatagattaaaacagtcctagtaatatcgttatctaggaatacacagttcatgttattgcaccaaagctacttctgaaatgactaaagatagccacttggttcaatatacctgagaaaatag

SEQ ID NO: 35009 - DNA, 601 bp, Human
tgtgcctgtaatcccagctggaggttgaggcaggagaatcacttgaacccgggaggcagaggttgcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctrgccacatagtgtttgttaaatagattaaaacagtcctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaaagtgtatattcagcgctctgagggccag

SEQ ID NO: 35010 - DNA, 601 bp, Human
tatttataaggcacttagaacaatgctagccacatagtgtttgttaaatagattaaaacagtcctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaargtgtatattcagcgctctgagggccaggtatgaacagcgatgtcactctgagtatggtaatcgcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacacgcatgc

SEQ ID NO: 35011 - DNA, 601 bp, Human
cctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaaagtgtatattcagcgctctgagggccaggtatgaacagcgatgtcactctgagtatggtaatygcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacacgcatgccatttgatttcttgtggccttggagagagctccatttggtctagcaaggcttaacctcaatt

SEQ ID NO: 35012 - DNA, 601 bp, Human
acaaaataaaaaagtgtatattcagcgctctgagggccaggtatgaacagcgatgtcactctgagtatggtaatcgcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatrgaacacgcatgccatttgatttcttgtggccttggagagagctccatttggtctagcaaggcttaacctcaattactgatgggtgacaagggaagaatacacaaattgttatggctactcttcccttggcctcagcatctggtgctgtcagtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagca

SEQ ID NO: 35013 - DNA, 601 bp, Human
taaaaaagtgtatattcagcgctctgagggccaggtatgaacagcgatgtcactctgagtatggtaatcgcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacaygcatgccatttgatttcttgtggccttggagagagctccatttggtctagcaaggcttaacctcaattactgatgggtgacaagggaagaatacacaaattgttatggctactcttcccttggcctcagcatctggtgctgtcagtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagcacctttc

SEQ ID NO: 35014 - DNA, 601 bp, Human
atcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacacgcatgccatttgatttcttgtggccttggagagagctccatttggtctagcaaggcttaacctcaattactgatgggtgacaagggaagaatacacaaattgttatggctactcttcccttggcctcagcatctggtgctgtcrgtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagcacctttctcatttaaaataggctgtgccaacccctggatcagagccatttccaaagcatgctgtgagtgtgtgtattcggtgtagtggaaaaaacaaaccctccttcacagccccacatcaggcaccatgtgctgcctccttttaaagggg

SEQ ID NO: 35015 - DNA, 601 bp, Human
aggattttctcaacaagccattatttaaaaatgattatttgagattccattagtttgtttcagctttaagcacatctgtatttgtaatttctcatgtatgaatgttcctttcttcacaggtttaagaatgttacatttgatatcatagctactgaagatgtaggcattttcgatgtaagatcaaaattccttggtgttgagatggaaaaggtgcaactcaatattcaggtaagctgctggaatttctgcacattgatgataaattttatatgtggatcatacattgctaccctggctctckctcttcaggacaacaataaagtttaacagaaaaccagtgccagccttatttgccaatatttgttaagtgttgatgatttttaagagctgtgacttttcaaatgattggaaattgatatgcttctagctggcaaaccatagcagtcagtttctctaagccatgtttccattttaaagcttagacaaaagaatataatttaaaagtattcagagctattaaataaatgctataaattttccttttattggaaacttgcatttctttctaagactatgtatgcccaggactggaactttcatg

SEQ ID NO: 35016 - DNA, 601 bp, Human
cacaggtttaagaatgttacatttgatatcatagctactgaagatgtaggcattttcgatgtaagatcaaaattccttggtgttgagatggaaaaggtgcaactcaatattcaggtaagctgctggaatttctgcacattgatgataaattttatatgtggatcatacattgctaccctggctctctctcttcaggacaacaataaagtttaacagaaaaccagtgccagccttatttgccaatatttgttaagtgttgatgatttttaagagctgtgacttttcaaatgattggaaattratatgcttctagctggcaaaccatagcagtcagtttctctaagccatgtttccattttaaagcttagacaaaagaatataatttaaaagtattcagagctattaaataaatgctataaattttccttttattggaaacttgcatttctttctaagactatgtatgcccaggactggaactttcatgatctcatttttccctctctcctagaatggtttttcttttttgtggggggagggggtgggggtggggcattgagaaggggtcttgctctgtcgcccaggctggaatacagtggca

SEQ ID NO: 35017 - DNA, 601 bp, Human
ccaggctggaatacagtggcatgtatgcccaggactggaactttcatgatctcatttttccctctttcctagaatggtttttcttttttgtggggggagggggtgggggggggcattgagaaagggtcttgctctgtcgcccaggctggaatacagtggcacaatcatggttcactgcagcctcaacctcctgggctcaagcgatcctcctgcttcagcctctcgagtaactggtactacaggcacacaccaccacatctggctaatttctgtattttttgtagagacagggtttcaccaygttgcccaggcttgtcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaa

SEQ ID NO: 35018 - DNA, 601 bp, Human
agtaactggtactacaggcacacaccaccacatctggctaatttctgtattttttgtagagacagggtttcaccacgttgcccaggcttgtcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcrttattttatcataagagccacatttaagccaaatacacgtaaatgaaaaccgagaaatccagtttctgtgcaaaaaaaaaaaaaaagagagcactgcaaacaaatgttcatctgcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtga

SEQ ID NO: 35019 - DNA, 601 bp, Human
tcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaaaaaaaaaaaaagagrgcactgcaaacaaatgttcatctgcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtgaattctggcctcactgtctgtgcagcccagggctccatgcactggaattacttccccatcatgggagtgtgtgccagagcccttcttttct

SEQ ID NO: 35020 - DNA, 601 bp, Human
tctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaaaaaaaaaaaaagagagcactgcaaacaaatgttcatctrcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtgaattctggcctcactgtctgtgcagcccagggctccatgcactggaattacttccccatcatgggagtgtgtgccagagcccttcttttctggcagcccttgtaagtttaaaaga

SEQ ID NO: 35021 - DNA, 601 bp, Human
agacttctatttatatatgcagctttcagtcaattgcatgaatgtgtaaattgtcaaagagaaatgtgatggccaggtccttactgtgagtaaaggaccaggaacaggaccaaagtttgaaaggactaaagaaagccccttctaacattacagctctatgtctcttggttatcttcagcccattttcccttcagttcctaaagaaaaccataggatagaattatatcctataattataggccatataggtaacaggaggatatgacttatgtgatatatattcttcttgtaaaaataatgkcaggtatttatcggggactgcagggtgggccttcttcctctcctagatgaagaactgaggttcagacagctaattatggaagataattagctgggataattatggaagataatgcagctgggatccaagttcttcatcactctagtccactgcctgtctcataggattccagttgatcctgcaagacaagagtagcttacaaagggtttgcatataccttaatctcatatctcattcccagtagcacccttgtgaaattggcagtgttatccccaatttacacacagggaaacagaactt

SEQ ID NO: 35022 - DNA, 601 bp, Human
cggggactgcagggtgggccttcttcctctcctagatgaagaactgaggttcagacagctaattatggaagataattagctgggataattatggaagataatgcagctgggatccaagttcttcatcactctagtccactgcctgtctcataggattccagttgatcctgcaagacaagagtagcttacaaagggtttgcatataccttaatctcatatctcattcccagtagcacccttgtgaaattggcagtgttatccccaatttacacacagggaaacagaacttcagagaagttawgtcatgttgcaaggtcttaagatagcaaatggcagagctaaaactaaagtctgcttttcaagtcatgagtccagccatgttttctctgctccctactttggggacccagctacttcccctacatatgccattccttttcaatctaactctattggtttaattcttttccactagactttgtttaacagatgttgcatttcccagaggaaaagtgaatctcctctacactctaaatagctaaaagtattattgatgaaaggacttcaattccctatagaattttagttctagaagcatatc

SEQ ID NO: 35023 - DNA, 601 bp, Human
ctgcctcagcctcctgagtagctgggattacaagtgtgcaccaccacgcccagctaatttttgtatttttagtagagatggggtttcgccatgttggccaggctggtctcactctcctgacctcaagtgatccacctgcctcagcctctcaaactgctggtattacaggaatgagccaccacacccagccagaaaacactgctttctaaagaatatgcatctagccagaactttgtgttttaacattttcgattaaaaattgaaattatatatctgacattaacttaatgatcatcatttwctttcatacagcccttatcaattccaaaaagctattttctttcatctaagtcacaatcacttgggaatttattaaaatgcaaattgatgggccccaccagagagctacataacaagaaattcctgtgggaggagcccaggcagcctttattttaactagcctatgtttttaaccagatgattctgatgtacacttaagttttagaacccccatctatggcctggtgccatggcatgcgcctgtagtcctggctactcgggaggctgaggtgggaagatagcttaagccaggagtttgaga

SEQ ID NO: 35024 - DNA, 601 bp, Human
ctcctgacctcaagtgatccacctgcctcagcctctcaaactgctggtattacaggaatgagccaccacacccagccagaaaacactgctttctaaagaatatgcatctagccagaactttgtgttttaacattttcgattaaaaattgaaattatatatctgacattaacttaatgatcatcatttactttcatacagcccttatcaattccaaaaagctattttctttcatctaagtcacaatcacttgggaatttattaaaatgcaaattgatgggccccaccagagagctacataayaagaaattcctgtgggaggagcccaggcagcctttattttaactagcctatgtttttaaccagatgattctgatgtacacttaagttttagaacccccatctatggcctggtgccatggcatgcgcctgtagtcctggctactcgggaggctgaggtgggaagatagcttaagccaggagtttgagaccaacctgggcaacatagttagaccccacctaggtgattaggtcaattgaatctgacttttgtcaacaaattcttctaatatgttttttaaatgcacaaaatgtcaaagttga

SEQ ID NO: 35025 - DNA, 601 bp, Human
atgttacagatgagaaaaccaggacccagagaggcagagggattcacacactgtcatggcaccagggagctgtgatgctagaacgggaccccagatccctcaggcccacacgcccctcctggacaggggtcccgagatgctctgggtggctgacctgtggtgagaggcgccgggtcctcaagaagaagccgaggaggcagcccacgatgacagacagcacagacaggatgaggagtccattccgcctgcacacgtccctcccccgtgccaagatggcatgcggcaccatggtgagcctggmctgctggcaaggggcacagcaccattccacgcatgagagcccggccgggggcacagggtctgggctgagggctctagcccctcagcaggcaggtggtcggagttgctaaacaccagtcgccagccccacggccatgcccgtgtggccgccttagagggaagccacaatcctattaccagctgcatcattaggagctgggagcagattagggcctgggaaattagagcagaccacgtggtctgggagttcaggcctcaaagccaagcgttcctcttaaacagttgagtggaccaggtactg

SEQ ID NO: 35026 - DNA, 601 bp, Human
tgtctgcactgccgcatctcccccaggctgccccttctcggccccctgcctgccccagaatcaccccctctccactcagcacctgaggggtctcccaagctccaaactggcctgtcgctcttctgcccaaaagcatctcatggttgccgcaagcccacgtgtggcgatgggacctatgggcctgctggcctctgcgctccggccgctgcacctggcatctgctgtcacctctgcctagagcacccttcctggatctcttgtcatttgagcagcctttaggaggtgttctctggtgcctgtytgaactcacacaagacccccctctttccccgccacagctcttggccctgtgtttgtcgtcatgaggcaccctcgcctctcctcacctgatggtgctgggtttgtaatcactccccagccacatcactggttcttccctctagtcctgcaaagtgtttatcacacccatgttacagatgagaaaaccaggacccagagaggcagagggattcacacactgtcatggcaccagggagctgtgatgctagaacgggaccccagatccctcaggcccacacgcccctcctggacaggggtcccg

SEQ ID NO: 35027 - DNA, 601 bp, Human
cccccttttgaaaacagttctcacgtctgtcccttttgtctgcactgccgcatctcccccaggctgccccttctcggccccctgcctgccccagaatcaccccctctccactcagcacctgaggggtctcccaagctccaaactggcctgtcgctcttctgcccaaaagcatctcatggttgccgcaagcccacgtgtggcgatgggacctatgggcctgctggcctctgcgctccggccgctgcacctggcatctgctgtcacctctgcctagagcacccttcctggatctcttgtcatytgagcagcctttaggaggtgttctctggtgcctgtttgaactcacacaagacccccctctttccccgccacagctcttggccctgtgtttgtcgtcatgaggcaccctcgcctctcctcacctgatggtgctgggtttgtaatcactccccagccacatcactggttcttccctctagtcctgcaaagtgtttatcacacccatgttacagatgagaaaaccaggacccagagaggcagagggattcacacactgtcatggcaccagggagctgtgatgctagaacgggaccccagatcc

SEQ ID NO: 35028 - DNA, 601 bp, Human
ggaaacccggggcctggctccccttcctgtcccccagcccacatccaatcggcccccacatcctgaagctcccccttttgaaaacagttctcacgtctgtcccttttgtctgcactgccgcatctcccccaggctgccccttctcggccccctgcctgccccagaatcaccccctctccactcagcacctgaggggtctcccaagctccaaactggcctgtcgctcttctgcccaaaagcatctcatggttgccgcaagcccacgtgtggcgatgggacctatgggcctgctggcctctgsgctccggccgctgcacctggcatctgctgtcacctctgcctagagcacccttcctggatctcttgtcatttgagcagcctttaggaggtgttctctggtgcctgtttgaactcacacaagacccccctctttccccgccacagctcttggccctgtgtttgtcgtcatgaggcaccctcgcctctcctcacctgatggtgctgggtttgtaatcactccccagccacatcactggttcttccctctagtcctgcaaagtgtttatcacacccatgttacagatgagaaaaccaggaccca

SEQ ID NO: 35029 - DNA, 601 bp, Human
ggcctgccttcaacaagaatccccctaccctgatgtctcctgtagtcattttctgtccccgaccccctccctctgctcgctggctataaatctccagccatctttgttgtatttgtggttgggtcccatctctctccccaggaggtcttgataactacccccctaccacaatagtcctgaatagagccttccttaccagtttaactagtggcagaatgattttgtccttaacaccatgggaatgtccctccctctcctgtaggagatgggggctgacagggaaaggggctctttcccaggmaacgcagcttcttcatggcagttacacaggctggaaacccggggcctggctccccttcctgtcccccagcccacatccaatcggcccccacatcctgaagctcccccttttgaaaacagttctcacgtctgtcccttttgtctgcactgccgcatctcccccaggctgccccttctcggccccctgcctgccccagaatcaccccctctccactcagcacctgaggggtctcccaagctccaaactggcctgtcgctcttctgcccaaaagcatctcatggttgccgcaagcccacgtgt

SEQ ID NO: 35030 - DNA, 601 bp, Human
attcctcatcccagatcaatgtctgatcaccctggcctgccttcaacaagaatccccctaccctgatgtctcctgtagtcattttctgtccccgaccccctccctctgctcgctggctataaatctccagccatctttgttgtatttgtggttgggtcccatctctctccccaggaggtcttgataactacccccctaccacaatagtcctgaatagagccttccttaccagtttaactagtggcagaatgattttgtccttaacaccatgggaatgtccctccctctcctgtaggagatrggggctgacagggaaaggggctctttcccaggaaacgcagcttcttcatggcagttacacaggctggaaacccggggcctggctccccttcctgtcccccagcccacatccaatcggcccccacatcctgaagctcccccttttgaaaacagttctcacgtctgtcccttttgtctgcactgccgcatctcccccaggctgccccttctcggccccctgcctgccccagaatcaccccctctccactcagcacctgaggggtctcccaagctccaaactggcctgtcgctcttctgccca

SEQ ID NO: 35031 - DNA, 601 bp, Human
gagcgttctctctgtgcctgacacagggctaggctcacgttttggttaaaaaaaaaaacaaacccatatgttgttcagcaatatgcagcttggtgggagaaagagacacccatataaccagctctgaagccaggcagccagcagcggggttacagttactttcatcagctatggatgatgagatggttcctgatgtagataggactttaacaggtacataagggagggagggggaagtaacacgtagtaagcacctactgtatgctgggcattgatgaatccttggtttattcctcataayaattctagtagacatatactgccccacatcccattttacagacaaggaaactgaggcccagggaggagagaggatattgcctagccatttgctagcagagtcaaagttcagggtttctctgcctccagagtccatgcttcttcctaaataactgctcgaggcttaacagggtcactatagtcgtggctcagttctccaggagtgggtgttttccttttaatggaagacaaagtctaatgcctgaccccagttgtagagatggcattagacattagtgagctgcgggaagaggactttctg

SEQ ID NO: 35032 - DNA, 601 bp, Human
atcccagatttcaaagtaagatgctgagaaagccagtttctgccaaataattgttctaagcctctacatccttccttcaatttatctggcaggttaatccagaccggaatacatttgcatttccaaacagatgggaaaggcagctttggcaaagtaggccccagatgagtttggcttttaataataggcattccaatttgttttcacaaaataatcttcctgcaggagatatatttttgttgctgaggaaaattaaagagaacagattgcagatttttttgttccattgccagtttaatgyagcagatagttgagcgttctctctgtgcctgacacagggctaggctcacgttttggttaaaaaaaaaaacaaacccatatgttgttcagcaatatgcagcttggtgggagaaagagacacccatataaccagctctgaagccaggcagccagcagcggggttacagttactttcatcagctatggatgatgagatggttcctgatgtagataggactttaacaggtacataagggagggagggggaagtaacacgtagtaagcacctactgtatgctgggcattgatgaatccttggttt

SEQ ID NO: 35033 - DNA, 601 bp, Human
aatgctcagtatttttaaatgagacactcatacaccaagataaaatcctgtgattttatcaaggataaaagttctttttcacaaatagaacattctaccattttccatattgtttatgatttttgcctgttgcataagcttacaaaacaagaagtgtttagtttctgagtcacaggcaaagagatcaaacagagaaatcccagatttcaaagtaagatgctgagaaagccagtttctgccaaataattgttctaagcctctacatccttccttcaatttatctggcaggttaatccagacyggaatacatttgcatttccaaacagatgggaaaggcagctttggcaaagtaggccccagatgagtttggcttttaataataggcattccaatttgttttcacaaaataatcttcctgcaggagatatatttttgttgctgaggaaaattaaagagaacagattgcagatttttttgttccattgccagtttaatgcagcagatagttgagcgttctctctgtgcctgacacagggctaggctcacgttttggttaaaaaaaaaaacaaacccatatgttgttcagcaatatgcagcttgg

SEQ ID NO: 35034 - DNA, 601 bp, Human
aacttctgcatgtatgagtagggtttgtcaactgacggccctcagggcagggtgacaggtgctgatctggctttttcactggggctgggtgggatggtagaggagtctcctttatagcagaatttagagatcttttctctgaggcctcagtgagagaagtctcttcctgcctttggctgaggaatgacatggtgcctaagctcagctgacagcgatctgaaaccgtgctggggaccccactcagacaaggatgtctgttaattagtttgaagtaggtgcctcagcatggccctctccccaacacacacaggggtggcccaataccctcaagtccagcttctctggttccttggggcaggcagtgggtggagatgggtggatgagtcccccaactgaattggaaggtccctaggggtctaactgctctggttacaaaactccaaaccatgcccaggctttcaaccccagcctcaccctgcctagtgcagcatcttgctctgttacgttctggagtctgcaagacaaactgacttggtatcaacttccacagactaagattccagctttctgtgaacgaggtcatcagctccacccacctcca

SEQ ID NO: 35035 - DNA, 601 bp, Human
accccgtctctactaaaaatacaaaaattagctgggcatggtggtgcacgcctgtagtcccagctactcaggaggctgaagcacaagattcgcttgaacccaggaggcggggattgcagtgagctaagatcgcaccactgcactccagcctgggcaacagagggagacgctatctccaaaaaaaaaaaaaaaaaaaaaaggtgctctactgataaaaaggcagctcttgcctcacctctctctatccctatcttgcaacttcccagtagtgaacatgctcagttcttctagctgtttcccrtagtatcactatttctagataatatggtcataatgctatttcttgattcatcattttgacatctatcaatttccctgccatgattgatgaggagttagttcttactccctttctctccacctatttcagcattatatttatatcaattttttagtaaatcaagatttacaatgttttgatcgccaaacagtgtttaccattgagccaagtaatgtactacaaccatgtctccttgcttgtagcctaaagttaattgactgatttttatttgtcttgttttctgggaatcacccactaatt

SEQ ID NO: 35036 - DNA, 601 bp, Human
ggctcggtggcttatgcctgtaatcccagcactttgggaggccaaggtaggtggatcacttgaggttaagagttcgagaccagcccagccaacatggcaaaaccccgtctctactaaaaatacaaaaattagctgggcatggtggtgcacgcctgtagtcccagctactcaggaggctgaagcacaagattcgcttgaacccaggaggcggggattgcagtgagctaagatcgcaccactgcactccagcctgggcaacagagggagacgctatctccaaaaaaaaaaaaaaaaaaaaaargtgctctactgataaaaaggcagctcttgcctcacctctctctatccctatcttgcaacttcccagtagtgaacatgctcagttcttctagctgtttcccatagtatcactatttctagataatatggtcataatgctatttcttgattcatcattttgacatctatcaatttccctgccatgattgatgaggagttagttcttactccctttctctccacctatttcagcattatatttatatcaattttttagtaaatcaagatttacaatgttttgatcgccaaacagtgtttacca

SEQ ID NO: 35037 - DNA, 601 bp, Human
aattgttgtacttgcaactatttttttttaaccaaagccaaacatactcggttgatgatctgatgctttaaaaatctccaaatcatcaaatgttggtgctatgaggggactcttgagatcttctagcccagcccactcatgtgatagatgaggaagctgaaccgcaaaagggaggtgacagacccacccaatgttaaccgcagcacaggaccaggactgctaacatttccaatgcaccagaaaatctgctttttaaagaaatatgcccatcatgactctctctctctctatatatatatatataaaataatatatataattatatattatatatatatattttttagacagagtcttgctctgtcaccaggctggagtgcagtgcagtggtgccatctcggctcactgcaacctccgcctcccaggttcaaccaatccccctgcctcaccctcccaagtagctgggactacaggtgcgcgccactatgcccggctaaatttgtgtattttagtagagatggggtttcaccatgtttgccaggatggtcttaatctcctgaccttgttgatccgcccgcctcggcctcccaaagtgcttgga

SEQ ID NO: 35038 - DNA, 601 bp, Human
aggcaaatggactttcaaacatcatccaagttgaattgttgtacttgcaactatttttttttaaccaaagccaaacatactcggttgatgatctgatgctttaaaaatctccaaatcatcaaatgttggtgctatgaggggactcttgagatcttctagcccagcccactcatgtgatagatgaggaagctgaaccgcaaaagggaggtgacagacccacccaatgttaaccgcagcacaggaccaggactgctaacatttccaatgcaccagaaaatctgctttttaaagaaatatgccyatcatgactctctctctctctatatatatatatataaaataatatatataattatatattatatatatatattttttagacagagtcttgctctgtcaccaggctggagtgcagtgcagtggtgccatctcggctcactgcaacctccgcctcccaggttcaaccaatccccctgcctcaccctcccaagtagctgggactacaggtgcgcgccactatgcccggctaaatttgtgtattttagtagagatggggtttcaccatgtttgccaggatggtcttaatctcctgaccttgttg

SEQ ID NO: 35039 - DNA, 601 bp, Human
ggtgtgctgtttataaaattttttaacttaattcagttctgctacttctggcaaccctggcatggggccactttcttcagagggtgaggttgtgggcgaggcaggcaaatggactttcaaacatcatccaagttgaattgttgtacttgcaactatttttttttaaccaaagccaaacatactcggttgatgatctgatgctttaaaaatctccaaatcatcaaatgttggtgctatgaggggactcttgagatcttctagcccagcccactcatgtgatagatgaggaagctgaaccgcraaagggaggtgacagacccacccaatgttaaccgcagcacaggaccaggactgctaacatttccaatgcaccagaaaatctgctttttaaagaaatatgcccatcatgactctctctctctctatatatatatatataaaataatatatataattatatattatatatatatattttttagacagagtcttgctctgtcaccaggctggagtgcagtgcagtggtgccatctcggctcactgcaacctccgcctcccaggttcaaccaatccccctgcctcaccctcccaagtagctggg

SEQ ID NO: 35040 - DNA, 601 bp, Human
tgctgagagagagaggatcagattgaatgggtgcaacaccacgcggtagaaacagccccctttggcagagttcttacgcctgaccccttcctaggccgctggctccagcctgtccacggatctctgactaaggcgccaactccttgcccaataagctgtctcgcaagtaacagtcacgtgaccaggacctgacaactgaagcagaagggctgctaagcccagttaaatcagactttcagataacaacatatagttcattcttatactaaaaaaaaaaaatgctgtttatctgaaactccartttaactgggtgtgctgtttataaaattttttaacttaattcagttctgctacttctggcaaccctggcatggggccactttcttcagagggtgaggttgtgggcgaggcaggcaaatggactttcaaacatcatccaagttgaattgttgtacttgcaactatttttttttaaccaaagccaaacatactcggttgatgatctgatgctttaaaaatctccaaatcatcaaatgttggtgctatgaggggactcttgagatcttctagcccagcccactcatgtgatagatgaggaagc

SEQ ID NO: 35041 - DNA, 601 bp, Human
ggtaccccaacatgaactaggcagggttcctgtcctgagaagttcccagcctagctggtgaggagacccactcctaagcagaccatggccgccttgcgagtcagtttctccatctgttttgggtccattctctagtgcttctcctcgaaaatgctgagagagagaggatcagattgaatgggtgcaacaccacgcggtagaaacagccccctttggcagagttcttacgcctgaccccttcctaggccgctggctccagcctgtccacggatctctgactaaggcgccaactccttgcccrataagctgtctcgcaagtaacagtcacgtgaccaggacctgacaactgaagcagaagggctgctaagcccagttaaatcagactttcagataacaacatatagttcattcttatactaaaaaaaaaaaatgctgtttatctgaaactccagtttaactgggtgtgctgtttataaaattttttaacttaattcagttctgctacttctggcaaccctggcatggggccactttcttcagagggtgaggttgtgggcgaggcaggcaaatggactttcaaacatcatccaagttgaattgt

SEQ ID NO: 35042 - DNA, 601 bp, Human
ttccagtactgttctcacccattttcagaccatcggtaactgaaatcacagaaagcgaaatggcggataaggggggactgctctgcctcacagggtcattggggggcttaaacgggagaatgcacgcaagcacttagcacagcgcctggatgacagccaatgtttggtaatcctgaaaataacagctctcctccatctgcaccacgcatctgcctagccatggaataaaatctctctcgtgtagcagatggcaggtgaccagaggacagagccgagtactgttcatgcattcattcaaccygcatcgtgccacgcatcacagtgggtaccccaacatgaactaggcagggttcctgtcctgagaagttcccagcctagctggtgaggagacccactcctaagcagaccatggccgccttgcgagtcagtttctccatctgttttgggtccattctctagtgcttctcctcgaaaatgctgagagagagaggatcagattgaatgggtgcaacaccacgcggtagaaacagccccctttggcagagttcttacgcctgaccccttcctaggccgctggctccagcctgtccacggatctctg

SEQ ID NO: 35043 - DNA, 601 bp, Human
tatccgttgattccaaatcacctgttctatccactaaaaattctactggatggaaccaacaactggggccactgaatgactcagaagccggcagcccacggcactgcccataaaggccccacggtcacactcatcccagggcctgtggttgctctccagccacccacagcaggagcagggcagcaacagaagccatcctctaccctcctggttccggaccacctggtcaaacccccgctctcacctggagaccaccagtggcaggatcatcatcttcagcatcctcatcaggagctctccrgggaactggaagtaactaatttcctgaaaacacagtaagaactggggttatagcaagagatgcagactgcacagtggttccgttcttcacagtctttgaagcactatcccatctgactcccctgtctagcacatggcagcagagaccatggagaaagaactggctttggagccacagaactgggttccaatcctggtaaacaccccgcctccaccaatcccccacaagctgtgtggccttaagcatcttctgtgaccactctgagttttgtgtttttctcatctgtaacatgagggtaat

SEQ ID NO: 35044 - DNA, 601 bp, Human
tggccctgtccctggctctgccttcccctcctacctcccctgcaactctgatccctggtcagattgaaccttctgaattggatcatgccgcttctctgtataaaactcattttctgtggtctttaggatgcaacttagcttttggcctggttcacggtgcactttgaggccggtccccacctgaattctccagcaggggtttctgcctgcctctcaccccttctgctgtgtcacactgatggtgctatgccttctccccccagacggttccctgcagctcaggaccttcgcacagctatcrcccccaggcctgccctccctgcctccccatcttcccctcccttagaagggcagtggcttcctgctctcaccggcagccccagcttccccattgcagccccaggcccccatgttgtccctgtctgctcgtgggtctgaccactcctccagggcaagggctggctctgagtcccctggtccagggcctggcacagaactggcactggtgagggagcgaatgcacgaaggagaggagcaggggtgacctgcaggggacccggggaaagggagtggaaggtggctgtgccgctgggtctgcagt

SEQ ID NO: 35045 - DNA, 601 bp, Human
tagcctgtggagcccagcacaccattcctgggtggggcttcccaggctccatcccaatccctgctctctcaccacctgtcctgcaagagcccctctgccactagggtagcacctaacacctctccctggcgatttccaaacctccgtctccagcttagactcccccatgagattctcatccactggccaaccatcagttgacacctaccccaggatgcctgcacctgctccagaccatccatcgcttggtgaccacaccaccatccacttggatgcgtgggccagaaatcttcatgctggrtgatcagcacacctcacctcctactcacccacctcctgctaaggatccctcctgagcagccctgccatctgcccccttccccatccccagggccaccacttggccctgtccctggctctgccttcccctcctacctcccctgcaactctgatccctggtcagattgaaccttctgaattggatcatgccgcttctctgtataaaactcattttctgtggtctttaggatgcaacttagcttttggcctggttcacggtgcactttgaggccggtccccacctgaattctccagcaggggt

SEQ ID NO: 35046 - DNA, 601 bp, Human
atcaagagttgagcttgggcctgttaattttgagatacctctagacactttatgtgagaatctggaactcaggtgagagttttccaggctggagactaaattcggaagtgccagagtccagaaggtgttcaaagccctggtattggatgaagtcttgccagccaagtaagcaaacacagaacagaccctgcctggatctctttctggctccagaccctataggtgacagccacgcgataggaacagcatggcaaatatttgatgatccttagttcatcacacactctaaagggtaaaagaraagctgaagatcttcctggagaaatgaagggagtggtagactgattgcattgatggcctcggtttgtagactccatttcccttgtaacattgtggtcccttcccaccctgagtctgggcttggccacctgacttgctttggccaagagggtattagtggacttgctgaaagcagaggcttgagaaacatttgcatgttttgatttcctctcttgctcctctacctttgttattaaaaaaaatgcctgggctagctctctcctggaatcctgtcgccaccatgaaacaaatctaggctggc

SEQ ID NO: 35047 - DNA, 601 bp, Human
gcagggaaagggagagttggggcggaggtcagagtctgatgtgtgtcagcaagtgcctgtaagctgcggtgcaggctacgactttgttgccatgtgctgggttgagagcaggttttgaaaaggatgcctctggctgcagtgctgagaacagaggacaggaagcagagaggaagcggaggccaggccagacactggagtgggcggcaatggcgggagtggcaggggaggtggaagggccatggcttgggatttggttttcaaggtagagctcacagaatttgctgaggaactggctgcaggrtatgagagaatgagagatgtcagaccaagatgggcagggcgagaaaagggcagatttatggagaaatcaagagttgagcttgggcctgttaattttgagatacctctagacactttatgtgagaatctggaactcaggtgagagttttccaggctggagactaaattcggaagtgccagagtccagaaggtgttcaaagccctggtattggatgaagtcttgccagccaagtaagcaaacacagaacagaccctgcctggatctctttctggctccagaccctataggtgacagccacgc

SEQ ID NO: 35048 - DNA, 601 bp, Human
tccttccaccatgtggagaagccgttctgaatcataagacccaagaaaccatgaatcacagttaccagatcctagaaataacagatcttacaaatgaggtttcttgaagttcctctttcctcgtctttaggatgttcactctcctagttctcctcctgcctctctgcttgcccctgctctgtttgctgtgcaaagcccacagtgcggccgtgagccaaggcccgtcctaggcctctgcacctgcttgctgggcacattctccctggaccattccagttcctcctggggatcagaccccaaygccactgatgaccttaaaccccacgtgtgcattcagcaaactctgcgcacccactcggtgccaggtgctgtcctaggctccaggatacagcagggaacggaggttaaagagccaggcttcacagggcatattacattccagtggatgtgggaggaaaagaaacacgtagatatgatcatgttgggtagtaagaaaggctatgaggagaagtgactcaagagaagacaacagagaggcagagcctgggaggtctcaggagaggcgacacccaggagagatgtaaatggagtgagggaagga

SEQ ID NO: 35049 - DNA, 601 bp, Human
ctctggaacatttgactgtggcacgtgtttctgatctggagccccgcagcccctgagtaagggcaggcagtggtgaaggaggcagcaccgatacctccttccaccatgtggagaagccgttctgaatcataagacccaagaaaccatgaatcacagttaccagatcctagaaataacagatcttacaaatgaggtttcttgaagttcctctttcctcgtctttaggatgttcactctcctagttctcctcctgcctctctgcttgcccctgctctgtttgctgtgcaaagcccacagtgcrgccgtgagccaaggcccgtcctaggcctctgcacctgcttgctgggcacattctccctggaccattccagttcctcctggggatcagaccccaacgccactgatgaccttaaaccccacgtgtgcattcagcaaactctgcgcacccactcggtgccaggtgctgtcctaggctccaggatacagcagggaacggaggttaaagagccaggcttcacagggcatattacattccagtggatgtgggaggaaaagaaacacgtagatatgatcatgttgggtagtaagaaaggctatgagg

SEQ ID NO: 35050 - DNA, 601 bp, Human
cccttctaggagtgtgtcttgtgagaaatgccaactctgaggtgagcatctggtaagaggcttccgttgcatgcctgctcttcctccaacctgccgccccacactcacactgcctccacctgggtcgcctcccactcactcttgtcctcggtaaccctcttcccctctttcaagactcagtttacacacacggagaacatttggaagctcgtaagaagccaaatggaacttatacctatatagacatttctttacaacttcctttacaattacaatcattttaaatgtgggccttggcagrgacagctagttgcctatgcagtctccattctcccgtccttccttaatagaagtcctattatgttgtggggaccaaatgggacctgccatcaagctctgattctcttgctaatggggtggccatcgagaggtgagtggaagtcgttgggtggtgattcctggaaaactcttaaggaggtgcccattcagccaggaccctttggtccgttcctccaactttcttctttctgcctggaacatggggataatagctagagcttgagcaaccttcatggaccatgagactcagatgaaagccagg

SEQ ID NO: 35051 - DNA, 601 bp, Human
atggaaagatactaccaggcaattcgtgttacaaaagaagaaaagtcagtggccaaaaatgctttttaaaatgtttagtttcatcaacaaattcaagatatttccacctgtcaaactgacaaagtatttttcaaatgacagtgcacaatgtgggaggtttggtgagatgggcaccctcacatggtcctggcagcaacctttctctaaaagcatttgtatctttgtcttcacagtccccttctaggagtgtgtcttgtgagaaatgccaactctgaggtgagcatctggtaagaggcttccrttgcatgcctgctcttcctccaacctgccgccccacactcacactgcctccacctgggtcgcctcccactcactcttgtcctcggtaaccctcttcccctctttcaagactcagtttacacacacggagaacatttggaagctcgtaagaagccaaatggaacttatacctatatagacatttctttacaacttcctttacaattacaatcattttaaatgtgggccttggcagggacagctagttgcctatgcagtctccattctcccgtccttccttaatagaagtcctattatgttg

SEQ ID NO: 35052 - DNA, 601 bp, Human
agaaaaaggacattcgtggaaaaactgatggaatccaaacgagatccgtaacttagttaatagtgttgtaccaatttaatttctcagttttgactaacgtaccctagttatgtaaaccgctaacatcaggggaggccaggtgaagggtgtgtgggatctctctgtactgtctacaacttttccgtaaacctaaaactatgctaaaatggaaagctgaatgcttgagaagctctctaagacagattgcaatacaaataaaaccacaaagcaagtgacgagctggagagactgcgtgaccaascactaccatcctaaatctactaagagcttttacaaatcttggcctggtttctaccttcactatctcctctcatcagaatatcagctccctggagggcggaagctctgtgtttgttcactgttgtgtctccagccccgggaagagttcccggcacataccaagcactcagtaaatatttgctgcgtaaaccaatagaccacaaaaacccgacaggaaaacgatggaaagatactaccaggcaattcgtgttacaaaagaagaaaagtcagtggccaaaaatgctttttaaaatgtttagtt

SEQ ID NO: 35053 - DNA, 601 bp, Human
atgcctgtaatcccagcactttgggaggccaaggtgggcacatcacctgaggtcaggagtttgagaccagcctggccaacatggcgaaaccccgtctctactaaaaaatacaaaaattagctgagtgtggtggtgctcgcctgtagtcccagctactcaggaggctgaggctgcagaattgcttgaacccgggaggcggaggttgcagggagctgagatcgcaccactgcactccagcctggggacagagtgagactctgactaaaaaaaaaaaaaaaaaaaaaaaaaaggcaaagaaaccataaaaagctagaagaaatataggttgagatcttatcatgtctcagtataggaaatgactctctaagaacaaaatgagcaataaatcaatagattttactacatgaaaataaagaaatccctaagcgcaacatagcatcctggattggatcctgcaacagagaaaaaggacattcgtggaaaaactgatggaatccaaacgagatccgtaacttagttaatagtgttgtaccaatttaatttctcagttttgactaacgtaccctagttatgtaaaccgctaacatcaggggaggccagg

SEQ ID NO: 35054 - DNA, 601 bp, Human
ttcatgcctgtaatcccagcactttgggaggccaaggtgggcacatcacctgaggtcaggagtttgagaccagcctggccaacatggcgaaaccccgtctctactaaaaaatacaaaaattagctgagtgtggtggtgctcgcctgtagtcccagctactcaggaggctgaggctgcagaattgcttgaacccgggaggcggaggttgcagggagctgagatcgcaccactgcactccagcctggggacagagtgagactctgactaaaaaaaaaaaaaaaaaaaaaaaaaaggcaaagagaccataaaaagctagaagaaatataggttgagatcttatcatgtctcagtataggaaatgactctctaagaacaaaatgagcaataaatcaatagattttactacatgaaaataaagaaatccctaagcgcaacatagcatcctggattggatcctgcaacagagaaaaaggacattcgtggaaaaactgatggaatccaaacgagatccgtaacttagttaatagtgttgtaccaatttaatttctcagttttgactaacgtaccctagttatgtaaaccgctaacatcaggggaggcc

SEQ ID NO: 35055 - DNA, 601 bp, Human
gcacagtagttcatgcctgtaatcccagcactttgggaggccaaggtgggcacatcacctgaggtcaggagtttgagaccagcctggccaacatggcgaaaccccgtctctactaaaaaatacaaaaattagctgagtgtggtggtgctcgcctgtagtcccagctactcaggaggctgaggctgcagaattgcttgaacccgggaggcggaggttgcagggagctgagatcgcaccactgcactccagcctggggacagagtgagactctgactaaaaaaaaaaaaaaaaaaaaaaaaaaggcaaagaaaccataaaaagctagaagaaatataggttgagatcttatcatgtctcagtataggaaatgactctctaagaacaaaatgagcaataaatcaatagattttactacatgaaaataaagaaatccctaagcgcaacatagcatcctggattggatcctgcaacagagaaaaaggacattcgtggaaaaactgatggaatccaaacgagatccgtaacttagttaatagtgttgtaccaatttaatttctcagttttgactaacgtaccctagttatgtaaaccgctaacatca

SEQ ID NO: 35056 - DNA, 601 bp, Human
aaaaaaaaaaaaagtaactgtcaaactgtgatactgacacagcagtcgatggaaaagtccatgtaagctgtagcctagaaacagaaactagcacctctaagtgtttcgtacttgataaaagttgtttcacaaatcagtgaggaaacgaaggattcattatagaatgctgtgcagctgaccaacggtttggaaaaaatagatgttagatgcttacaccaaaataaattccaaaaggtttaaagaaataaataagtctttgaaaaatgaaaccagctgggcacagtagttcatgcctgtaatsccagcactttgggaggccaaggtgggcacatcacctgaggtcaggagtttgagaccagcctggccaacatggcgaaaccccgtctctactaaaaaatacaaaaattagctgagtgtggtggtgctcgcctgtagtcccagctactcaggaggctgaggctgcagaattgcttgaacccgggaggcggaggttgcagggagctgagatcgcaccactgcactccagcctggggacagagtgagactctgactaaaaaaaaaaaaaaaaaaaaaaaaaaggcaaagaaaccataaaaagcta

SEQ ID NO: 35057 - DNA, 601 bp, Human
cactggctcacctgtctgcctcccccatatagtggccgccttgcaggtgggacttggttgttcatgtcctatctgtggggcctaacacgggacctcgcacataggtgggctcattattcttagtaacatattttattataaagctaaaggtggaggagtctttcctactagataaaaaacggtggctcacgcctgtaatcccagcactttgggaggccaaggcgggcggatcacgaggtcggagatcgagtccacggtgaaaccccgtctctactaaaaatacaaaaaattagctgggcayggtggcgggtgcctgtagtcccagctactcaggaggctgaggcaggagaatggcgtgaacccggcggagcttgcagtgagccgagatcgcgccactgcaccccagcctgggcggcagagcaagacaccgtctcaaaaaaaaaaaaaaaagtaactgtcaaactgtgatactgacacagcagtcgatggaaaagtccatgtaagctgtagcctagaaacagaaactagcacctctaagtgtttcgtacttgataaaagttgtttcacaaatcagtgaggaaacgaaggattcattatagaa

SEQ ID NO: 35058 - DNA, 601 bp, Human
cctgactgccccacgagaccctgcggcccttctgtgtgtaggtcgctgctgctccgccacaccaccgtgcggtcactggctcacctgtctgcctcccccatatagtggccgccttgcaggtgggacttggttgttcatgtcctatctgtggggcctaacacgggacctcgcacataggtgggctcattattcttagtaacatattttattataaagctaaaggtggaggagtctttcctactagataaaaaacggtggctcacgcctgtaatcccagcactttgggaggccaaggcgggcrgatcacgaggtcggagatcgagtccacggtgaaaccccgtctctactaaaaatacaaaaaattagctgggcacggtggcgggtgcctgtagtcccagctactcaggaggctgaggcaggagaatggcgtgaacccggcggagcttgcagtgagccgagatcgcgccactgcaccccagcctgggcggcagagcaagacaccgtctcaaaaaaaaaaaaaaaagtaactgtcaaactgtgatactgacacagcagtcgatggaaaagtccatgtaagctgtagcctagaaacagaaactag

SEQ ID NO: 35059 - DNA, 601 bp, Human
agccctccctgactgccccacgagaccctgcggcccttctgtgtgtaggtcgctgctgctccgccacaccaccgtgcggtcactggctcacctgtctgcctcccccatatagtggccgccttgcaggtgggacttggttgttcatgtcctatctgtggggcctaacacgggacctcgcacataggtgggctcattattcttagtaacatattttattataaagctaaaggtggaggagtctttcctactagataaaaaacggtggctcacgcctgtaatcccagcactttgggaggccaasgcgggcggatcacgaggtcggagatcgagtccacggtgaaaccccgtctctactaaaaatacaaaaaattagctgggcacggtggcgggtgcctgtagtcccagctactcaggaggctgaggcaggagaatggcgtgaacccggcggagcttgcagtgagccgagatcgcgccactgcaccccagcctgggcggcagagcaagacaccgtctcaaaaaaaaaaaaaaaagtaactgtcaaactgtgatactgacacagcagtcgatggaaaagtccatgtaagctgtagcctagaaacag

SEQ ID NO: 35060 - DNA, 601 bp, Human
ctggtgccaccttgggggacttgacaactggggtggtcttggtgcggtactggtgggtgacaccccacccagagagaagtcagggccaagggttgttactaatattaacgacaacaataatagcatcttgaaggcacatttgtatccattcctatcctatttgattgacagtaaccctgtgaggcaggcagagcagggattgctatcgatattttacccaaagaaagctgcaactccttcctctaccaccacaccacccagccacgctgcctcctgccttcattcctcttcttacttctayacctcatcaccccatctgggtccctcttaactgcctgcccagccccttatccacccaagtaaccctttatccacccatctgtcccctcccaatcatccagtatccatccacctggtggcctgctggccctgctgcccaccaggtggaaacttggaccttctttttgaagaagcatagcctgccccaagccttgttaatgagatgaagcccatgcacaagaaaatgaccttcctgagccacgtacctttccctctctgcccccagagcattcatgggtctcaccccatcatccctcaggta

SEQ ID NO: 35061 - DNA, 601 bp, Human
gcggcggggtcaggtccagggcgaagttctgcacatgggagccattctcctcctggaccccgtagatgaggatccgccgaggaggggcctcctctggtgccaccttgggggacttgacaactggggtggtcttggtgcggtactggtgggtgacaccccacccagagagaagtcagggccaagggttgttactaatattaacgacaacaataatagcatcttgaaggcacatttgtatccattcctatcctatttgattgacagtaaccctgtgaggcaggcagagcagggattgctatcratattttacccaaagaaagctgcaactccttcctctaccaccacaccacccagccacgctgcctcctgccttcattcctcttcttacttctatacctcatcaccccatctgggtccctcttaactgcctgcccagccccttatccacccaagtaaccctttatccacccatctgtcccctcccaatcatccagtatccatccacctggtggcctgctggccctgctgcccaccaggtggaaacttggaccttctttttgaagaagcatagcctgccccaagccttgttaatgagatgaag

SEQ ID NO: 35062 - DNA, 601 bp, Human
ttgcctcggtacactgacacataccacctcagtacactcatacccattgcctcagtatactcacaccaccttggtacactcacacaccccgtctgagtacactcacacaccttgcctcagtacactcacactgcctcggtacactcacacacaccacctcggtacactcacacccctccttgttacacacacaccttaccttggcacacaccctgtctcagtacacacacacaccatctcggtacacttacacaccccaccttggtacactcacacaccctgcctcagtacactcacacayaccaccttggtacactcgcattgccttggtacattcacacaccccaactcagtacactcagaaaccatgcctctgtacattcacacaccacaccacctcgttatactcacaccatctcagtacactcacacactccatctgagtacactcacacaccttgtcttggtacactcacaccaccttggtacacacacaccttgcctctctgtacactcacacacccccaccttgataccttcacatacaccacctcgacacactcatacaccccgcctcagaacactcacacatccacataca

SEQ ID NO: 35063 - DNA, 601 bp, Human
tcacacacccctcctcggtacactcacactgcctcagtacctcacataccgtctcggtacacacacataccccgccttgatagactgacacacaccacctcggtacgctcacactgcctcagtacctcacataccgcctcggtacacacacataccctgccttgatagactgacacacaccacctcagtatgctcacacagcccgcctcggtatactcacacaacctgcctcggtacactcacacacctcgcctcagtacactcaaccgcctcagtacactcactcacaccaccttggtayactcacacaccccaccacaataccctcactttgcctcggtacactgacacataccacctcagtacactcatacccattgcctcagtatactcacaccaccttggtacactcacacaccccgtctgagtacactcacacaccttgcctcagtacactcacactgcctcggtacactcacacacaccacctcggtacactcacacccctccttgttacacacacaccttaccttggcacacaccctgtctcagtacacacacacaccatctcggtacacttacacaccccaccttggtacac

SEQ ID NO: 35064 - DNA, 601 bp, Human
gcctcagtacgctcactttgcctcgatacactcacacgacctgcctcggtacactcacacacaccccctcagtacactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacacctacacgccccgccttggtasactcacatgccccacctcagtacactcacagataccacctcagaacattcacacaccctgcctcagtacactcacgcaccctgcctcggtacactcattttttctcggtacactcacacaccccgccttggtacactcacacaacccacctcggtaccctcacacactgccttggtgcactcacacaacctgcctccgtgtactcacacacaccccctcggtacactcacacacactgcctcggaacactcacacaacccaccttggtacaatcacacacaccacctcggtacactcaca

SEQ ID NO: 35065 - DNA, 601 bp, Human
acactcacacaccctgcctcagtacgctcactttgcctcgatacactcacacgacctgcctcggtacactcacacacaccccctcagtacactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacacctacaygccccgccttggtagactcacatgccccacctcagtacactcacagataccacctcagaacattcacacaccctgcctcagtacactcacgcaccctgcctcggtacactcattttttctcggtacactcacacaccccgccttggtacactcacacaacccacctcggtaccctcacacactgccttggtgcactcacacaacctgcctccgtgtactcacacacaccccctcggtacactcacacacactgcctcggaacactcacacaacccaccttggtacaatcacacacaccac

SEQ ID NO: 35066 - DNA, 601 bp, Human
cagaacactcacacaccctgcctcagtacgctcactttgcctcgatacactcacacgacctgcctcggtacactcacacacaccccctcagtacactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacaccyacacgccccgccttggtagactcacatgccccacctcagtacactcacagataccacctcagaacattcacacaccctgcctcagtacactcacgcaccctgcctcggtacactcattttttctcggtacactcacacaccccgccttggtacactcacacaacccacctcggtaccctcacacactgccttggtgcactcacacaacctgcctccgtgtactcacacacaccccctcggtacactcacacacactgcctcggaacactcacacaacccaccttggtacaatcacacaca

SEQ ID NO: 35067 - DNA, 601 bp, Human
accctgcctcaatacactcacagataccacctcagaacactcacacaccctgcctcagtacgctcactttgcctcgatacactcacacgacctgcctcggtacactcacacacaccccctcagtacactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctyggcacactcacagaacccgcctcagtacacctacacgccccgccttggtagactcacatgccccacctcagtacactcacagataccacctcagaacattcacacaccctgcctcagtacactcacgcaccctgcctcggtacactcattttttctcggtacactcacacaccccgccttggtacactcacacaacccacctcggtaccctcacacactgccttggtgcactcacacaacctgcctccgtgtactcacacacaccccctcggtacactcacacacactgcctcggaacac

SEQ ID NO: 35068 - DNA, 601 bp, Human
cacacacaccgcctcaatacactcacacacagtgccttggtacactcacataccccgccttgatacattcacacacccagccttggtacactcacagatactgcctcagaacattgacacaccctgcctcaatacactcacagataccacctcagaacactcacacaccctgcctcagtacgctcactttgcctcgatacactcacacgacctgcctcggtacactcacacacaccccctcagtacactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacacctacacgccccgccttggtagactcacatgccccacctcagtacactcacagataccacctcagaacattcacacaccctgcctcagtacactcacgcaccctgcctcggtacactcattttttctcggtacactcacacaccccgcctt

SEQ ID NO: 35069 - DNA, 601 bp, Human
cacacacacaccgcctcaatacactcacacacagtgccttggtacactcacataccccgccttgatacattcacacacccagccttggtacactcacagatactgcctcagaacattgacacaccctgcctcaatacactcacagataccacctcagaacactcacacaccctgcctcagtacgctcactttgcctcgatacactcacacgacctgcctcggtacactcacacacaccccctcagtacactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacacctacacgccccgccttggtagactcacatgccccacctcagtacactcacagataccacctcagaacattcacacaccctgcctcagtacactcacgcaccctgcctcggtacactcattttttctcggtacactcacacaccccgcc

SEQ ID NO: 35070 - DNA, 601 bp, Human
ggtacactcacacatccacacacactgcctcagtacacacacacaccgcctcaatacactcacacacagtgccttggtacactcacataccccgccttgatacattcacacacccagccttggtacactcacagatactgcctcagaacattgacacaccctgcctcaatacactcacagataccacctcagaacactcacacaccctgcctcagtacgctcactttgcctcgatacactcacacgacctgcctcggtacactcacacacaccccctcagtacactcacatacaccacctyggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacacctacacgccccgccttggtagactcacatgccccacctcagtacactcacagataccacctcagaacattcacacaccctgcctcagtacactcacgcaccctgcctcggtac

SEQ ID NO: 35071 - DNA, 601 bp, Human
tcagtacacataccacttcggtacactcacacatccacacacactgcctcagtacacacacacaccgcctcaatacactcacacacagtgccttggtacactcacataccccgccttgatacattcacacacccagccttggtacactcacagatactgcctcagaacattgacacaccctgcctcaatacactcacagataccacctcagaacactcacacaccctgcctcagtacgctcactttgcctcgatacactcacacgacctgcctcggtacactcacacacaccccctcagtrcactcacatacaccacctcggtacactcacataacctgcctcggtacactcacacaccccgcctcagtacactcacacaacccaccttggtaccctcacacacactgtcttggtgcactcaacctgcctcggtacaatcacacgcactgcctcagtacgctcacacacactgcctcggcacactcacagaacccgcctcagtacacctacacgccccgccttggtagactcacatgccccacctcagtacactcacagataccacctcagaacattcacacaccctgcctcagtacactc

SEQ ID NO: 35072 - DNA, 601 bp, Human
tcacacatcccgcctaggtacactcacacgcctcgcctcggtacactcacacaccctgcctcggtacactcacacaccttgcttcattacaattacacaccccaccttagcacactcacacactccacctcggtacactcacacgcacataaaccccagctcagtacactcacaccccatgcctcagtacactcacacactccacttcgatacactcacacaccctgccttggtaaacttacacaccacttcagtacacataccacttcggtacactcacacatccacacacactgcctcrgtacacacacacaccgcctcaatacactcacacacagtgccttggtacactcacataccccgccttgatacattcacacacccagccttggtacactcacagatactgcctcagaacattgacacaccctgcctcaatacactcacagataccacctcagaacactcacacaccctgcctcagtacgctcactttgcctcgatacactcacacgacctgcctcggtacactcacacacaccccctcagtacactcacatacaccacctcggtacactcacataacctgcctcggtacact

SEQ ID NO: 35073 - DNA, 601 bp, Human
tcaaaccatgcatctgtacactcacacacaccgactcggtacactcacactgtctcggtaaactcaccccatcttggtacactcacacaccctgtctcagtacactcacaccaccttggtacactcacacatcccgcctaggtacactcacacgcctcgcctcggtacactcacacaccctgcctcggtacactcacacaccttgcttcattacaattacacaccccaccttagcacactcacacactccacctcggtacactcacacgcacataaaccccagctcagtacactcacaccscatgcctcagtacactcacacactccacttcgatacactcacacaccctgccttggtaaacttacacaccacttcagtacacataccacttcggtacactcacacatccacacacactgcctcagtacacacacacaccgcctcaatacactcacacacagtgccttggtacactcacataccccgccttgatacattcacacacccagccttggtacactcacagatactgcctcagaacattgacacaccctgcctcaatacactcacagataccacctcagaacactcacacaccct

SEQ ID NO: 35074 - DNA, 601 bp, Human
cacatgccccacgttgttactttcacgcgcctagcctcgatacactcacacaccctgccttggtacactcaaaccatgcatctgtacactcacacacaccgactcggtacactcacactgtctcggtaaactcaccccatcttggtacactcacacaccctgtctcagtacactcacaccaccttggtacactcacacatcccgcctaggtacactcacacgcctcgcctcggtacactcacacaccctgcctcggtacactcacacaccttgcttcattacaattacacaccccaccttrgcacactcacacactccacctcggtacactcacacgcacataaaccccagctcagtacactcacaccccatgcctcagtacactcacacactccacttcgatacactcacacaccctgccttggtaaacttacacaccacttcagtacacataccacttcggtacactcacacatccacacacactgcctcagtacacacacacaccgcctcaatacactcacacacagtgccttggtacactcacataccccgccttgatacattcacacacccagccttggtacactcacagatactg

SEQ ID NO: 35075 - DNA, 601 bp, Human
acaacccgcctcggtacactcacacaaactgccttggtacagtcacaccacctcggtgcattcacacacaccaccttggtacacacacaccccgcctcagtacactcactccacctcagtacactcacacaactcgcctcggtacactcaactgcctcggtacactcacactgccttggtatgctcacacccccccacctcattacactcacacaccccacctcagtacattcaccccgccttggtacactcacacacaccacctcggtacacccacatgccccacgttgttactttcacrcgcctagcctcgatacactcacacaccctgccttggtacactcaaaccatgcatctgtacactcacacacaccgactcggtacactcacactgtctcggtaaactcaccccatcttggtacactcacacaccctgtctcagtacactcacaccaccttggtacactcacacatcccgcctaggtacactcacacgcctcgcctcggtacactcacacaccctgcctcggtacactcacacaccttgcttcattacaattacacaccccaccttagcacactcacacactccacctcggta

SEQ ID NO: 35076 - DNA, 601 bp, Human
cggcccagggctgagcctgggcacagctttctgctcactttacgggagaagagggtggggtcttgtcttccctccatccacccagggctggccggggtgaggtgggtaaatgaggaggcttaccacacagccaccgccacgatcttcatgaccgactcattgaggcactggcagaagctgaccaggggggccccgctgtcacccatgcggcccagcatgatgcctgcgggtcagggacacagtgctgtggtaaagcagggacagacccacaggcccacatgggtctcagcatggctggctycccagcagccttgatgctccagcactccccccactccccccactctctctctccctctctcctcctccactctactaccgatcccacagtgctctcacgcttcctcctctctcaccttcctccacgcagcagccaatgtcacctcctcaggataaaagtgctccctgccaagtgcacccctggcttcgctgtgcgcttaggccatgacaagctccccgctgcctcacccagctcgatgcctcagccccactcgagtgggccctgcctgcctctccctcctgctcctgcccatctcactgt

SEQ ID NO: 35077 - DNA, 601 bp, Human
ggcaggcagacacaccccggccccagccccgcatcgctgcgcggccttccccctgagcttcctggggctcctgcgaggacagagcgagactgtgccaaggtgcccggcccaggctcagcacatggcgtccttcataccgttacttccaccgccccagctccagacaacctctgccactccttcccccgacctgccttcaggaggcccccatttcaggcccaacaacgccagagtctacacagtgcgcctgggcagccctccctctgcgttccccactgagctcctggactctgaactgtgrgccgaggactctgaactgtgggctagtccttaccgccagctttcctttctccaaaagctgagctgataaggctccatgtgatggagaaactgagcccaggagagcagcagagccgggcagagctcttagaccaggctggaaggggcaggcccagggccggagccaggcctggctggggctgggggacccatggaaacacatgtagctccggaggccccggcccagggctgagcctgggcacagctttctgctcactttacgggagaagagggtggggtcttgtcttccctccatccaccc

SEQ ID NO: 35078 - DNA, 601 bp, Human
ctggcgcgtcgaggccgcccccatgcggactcagtgagcttgaggactggggccgtgggggaaggagaggcctcgacaaaggccaaaagtcccccacgtcagtcttgttaccccagcaccagccgtccccgcatttgtgaggtgggccacactggcgttttggtggttctgtggctatgaaccaatgatggctggacagacggacagggctcagcccctcccagctccccaccgtcctgcccgtccccggggctacctggaggaggtggccagcgcgatgagcagagcctgcaggatgccrcggatgaagacgatgggattcttcttggtgatgaagaagtagagcaggggcaggataaagagcccgtggagcaccagcccgcacaccacggtgactgagtagaagcccagcttcttgccgacggccctggggtcgtccatctccaggatcttacccgcaatgaggaacacaatgccgaaggggaaatacctgggggcggcggggcagccaggctcaggaaccaggcaggcagacacaccccggccccagccccgcatcgctgcgcggccttccccctgagcttcctggggctcctgcgag

SEQ ID NO: 35079 - DNA, 601 bp, Human
cacctggcccagcctggcaaggaggggctcgacctccactgcaaccctgtgagctggaagctggagtctcccccagtctgtgcatgaggaaagcaatgcccaggcacagcgagtgagtgacagagccatggctcaagtccctgaggtctagggacactgccaaggttgtgacagggcacccagccaggacatcccagcggcagtggacaggccgagctcctagagcaacacagggcccgactccaggagaagcaccttgtggggcaaaaggcagcagcagtgcgttgccaatgtgatttcycactgactctactgtgctgtctgccctggcgcgtcgaggccgcccccatgcggactcagtgagcttgaggactggggccgtgggggaaggagaggcctcgacaaaggccaaaagtcccccacgtcagtcttgttaccccagcaccagccgtccccgcatttgtgaggtgggccacactggcgttttggtggttctgtggctatgaaccaatgatggctggacagacggacagggctcagcccctcccagctccccaccgtcctgcccgtccccggggctacctggaggaggtggccagcg

SEQ ID NO: 35080 - DNA, 601 bp, Human
tctgctgccaggggtgggtgtcatatgactgctgggtacagaggcctgcagggcattttacagatggaaaaactgagacccaagtgagggctagagggaagagtgaggccttcagtgccagaaagatgtggcttaagttcctgcgactcccttaatgtggagctcagacacttgccatggggagagccaaactgccttcacagcactagatgctccataagggaccacttccttcctgccccctccaccaacgacatggtttgcacaactctaaattcctgaggtctctgcactgggctgmggtttgggatccttaaggccaagtgctggttcacctggcccagcctggcaaggaggggctcgacctccactgcaaccctgtgagctggaagctggagtctcccccagtctgtgcatgaggaaagcaatgcccaggcacagcgagtgagtgacagagccatggctcaagtccctgaggtctagggacactgccaaggttgtgacagggcacccagccaggacatcccagcggcagtggacaggccgagctcctagagcaacacagggcccgactccaggagaagcaccttgtggggcaaaa

SEQ ID NO: 35081 - DNA, 601 bp, Human
gcatgggagctggcatgtttggggctttgtcctgccctctgaccccctatctgcgggagggtgttcctggcaatggctcctgggcttttcttcactggggtctgctcctgaatcctgcaggaggtgcatctgctgccaggggtgggtgtcatatgactgctgggtacagaggcctgcagggcattttacagatggaaaaactgagacccaagtgagggctagagggaagagtgaggccttcagtgccagaaagatgtggcttaagttcctgcgactcccttaatgtggagctcagacactygccatggggagagccaaactgccttcacagcactagatgctccataagggaccacttccttcctgccccctccaccaacgacatggtttgcacaactctaaattcctgaggtctctgcactgggctgaggtttgggatccttaaggccaagtgctggttcacctggcccagcctggcaaggaggggctcgacctccactgcaaccctgtgagctggaagctggagtctcccccagtctgtgcatgaggaaagcaatgcccaggcacagcgagtgagtgacagagccatggctcaagtccc

SEQ ID NO: 35082 - DNA, 601 bp, Human
acctgggtcacagagctactaggaggattaaacgactacgggcttggacagcacctggcccattgtacccactcagtcaatggtgaccatgactattattattactatgtttgtcatgagagttcccagtggcagtgctgggactaaaacaggccggtgtggcccctgtgtcttcctctcccccgggcctctgcctggaaggccggttctactcgccagagcctctcaggagctccagacctgctgggcttgaggctgcggttcctgctggcaggagatggccagggggctgctggctctsgctggcttggcccctggcatgggagctggcatgtttggggctttgtcctgccctctgaccccctatctgcgggagggtgttcctggcaatggctcctgggcttttcttcactggggtctgctcctgaatcctgcaggaggtgcatctgctgccaggggtgggtgtcatatgactgctgggtacagaggcctgcagggcattttacagatggaaaaactgagacccaagtgagggctagagggaagagtgaggccttcagtgccagaaagatgtggcttaagttcctgcgactcccttaat

SEQ ID NO: 35083 - DNA, 601 bp, Human
tggcttcctggctcctcccaagcccaccctttggcatcattgaagcagcttcttggcatgcagctgtgggttccacaggtccccatgcttagaagggttaggtttggtttaatcctctgctgtttctgtcttgaaattctttataggtttgttttttgtttgtttgtttgtttgtttgttttttgagacagagtcttgctctgtcactcaggctggagtgcagtggcgccatctcggcttactgaaacctccatctcccaggttcaggtaattctcgtgcctcagccacctgaatagctgrgattacaggcacatgtcaccagtcccagctaattttttcttttctaatttttagtagagatggggattttactgtgttgcccaggctgggctctggaattcctgggctcaaggaatgctcctgccatggcctctcaaagttctgggacatataggcgtgagtcatcatgcctggcctttacagtttttggactgggttccacattttcatttttgaacactggaccccacaaattatgcagccaggcctgtgctaatgagtagggcactcccacagtgccaagcggggcagtccccagcc

SEQ ID NO: 35084 - DNA, 601 bp, Human
acagcctgcacagacctacaaatgctcacatgttggctaaactggacagaccatcccgacacgagggcggggaattttatcatatcttgttctactgttcctcctgtgtctatatcagcgccagccacagcgggtgctcaataaatagatgttagaggaatcagtcattctgtaacggatgaggagaccgaggcccagaggcatggagggagggattggctggaggctgccgagctggttggtggaagatctggtgccctgcccaccctgcgtggctccaccctcctggcagcctctggatctcactgctctcacctcggtgcctgtgtcccgggcaaaatccttccgacatatatgggccatgatccccgctgccagcgcatcacccagcacgttaatcatggtgcggaaacggtccctggtgagccaaggttgggggtgagtggtgggcacttgaaggggagctggaagagggcagtgctcaacccagcacagtacagcacggccggtgaccagctgtcatgcaaagcctgcagccagatggcttcctggctcctcccaagcccaccctttggcatcattgaagcagcttcttggcatg

SEQ ID NO: 35085 - DNA, 601 bp, Human
tagaggaggggacttaatccacagggtccatctggggaattggtggatcccctgcctgacctcagcttcttccccatgatgtggggacagccttctccatttgcctgtagaaggagcctgaagcccacacagcctgcacagacctacaaatgctcacatgttggctaaactggacagaccatcccgacacgagggcggggaattttatcatatcttgttctactgttcctcctgtgtctatatcagcgccagccacagcgggtgctcaataaatagatgttagaggaatcagtcattctgyaacggatgaggagaccgaggcccagaggcatggagggagggattggctggaggctgccgagctggttggtggaagatctggtgccctgcccaccctgcgtggctccaccctcctggcagcctctggatctcactgctctcacctcggtgcctgtgtcccgggcaaaatccttccgacatatatgggccatgatccccgctgccagcgcatcacccagcacgttaatcatggtgcggaaacggtccctggtgagccaaggttgggggtgagtggtgggcacttgaaggggagctggaagag

SEQ ID NO: 35086 - DNA, 601 bp, Human
gcctcaggcaatgccgggcccatcactccctagatggggctcccccatgcagcctttcccttctctgaaatacattttccgtcaagcggggttaattccagcctctcaagggtgagaagaatgtgtgatcctggcccctgccggctgctcaggagggttggagagtcgagttcctgcctcaggaccctgcccctggaggcctcgcctgcccctgcagctccgcaggctcagacattggtctccagctcgctgatctggatggtgcagtggttcagactcgcagcgggcagctcctcatccygctccacttgaacggggacgtggtgggggcaggtggggcccagggtgagctcggaggcctcggctacactcttcacacagccattctgctgggctgccacgatctcctggaggctcactggcttggtctcgcagggcagcagtttctggtgaagggaaacaggtctttgtagcagcaggagggaccaaggttagatacgagggaggactgagggccagtggggcagaatgagctcagggctaggaaccacaagatggattttcctgcagacacgctgtgtgacctcggcaggtcacggcc

SEQ ID NO: 35087 - DNA, 601 bp, Human
ggcccgggacacacctagccatgggtgttgctccagccagggcttcagagtcggtaggcaccctccacactcgctgcttgtccatatcctgttcagttaaagcctagtgaggccacagcccttcctcacccatccctcctcttcatccccatctgagttttgggaagaactgtcactttgcccataaggcatactcatcctatccacatgagactcagttcccagaactgtgtatttctgagcagaagcaactctaacctctaaagagagagaccagaagtactttcagaattttttttttctttttttttgagacagagtcttgctctgttacccaggctggagcacagtgacgcgatcttggctcactgcaacctctgcctctgggttcaagtgattctcctgcctcagcctcccaggtagctgggattacaggcacgtgccaccatgtctgactaatttttgcatttttagtagagatggggtttcaccatattggccaggctggtcttgaactcctgatgtcaagtgatccacccgcctcagcctcccaaagtgctaggattacagacgtgagtcaccgcacctggccactttcaga

SEQ ID NO: 35088 - DNA, 601 bp, Human
ggaactttctcaatgtcacagagttaataagcggcagagcccagtgtctgaacccaggtctttctcattccatagtttccactggctcatggttttctgtggcctcccatcgaaacaccccatgataacccatcttgcggggtcttgttctcgataaccagccctcaacacagactacacaaaactactgaggtgcgagaatcccttgaaccagggagtcagaggttgcagtgagccgagatcgtgccattgcactccagcctggcaacagagcaagactctatctcaaaaaaaaaaaaaatcttgctttatttgctcgtctccaaaccacgagcaagacattcattcttactttagttcagcaagcttcagcttatggagctccactgtcttggtcgccatcttgttacccctctggctgtgctcttttaataattgtatgtgggccgggctaatccatcagaagtatcactaggggtcaggcgtggtggcttacgcctgtaatcccagcactttgggaggccgaggtggatggatcacctgaggtcaggagtttgagaccagcctggccaacatggtgaaacatcgtctctactaaaaa

SEQ ID NO: 35089 - DNA, 601 bp, Human
cagagttaataagcggcagagcccagtgtctgaacccaggtctttctcattccatagtttccactggctcatggttttctgtggcctcccatcgaaacaccccatgataacccatcttgcggggtcttgttctcgataaccagccctcaacacagactacacaaaactactgaggtgcgagaatcccttgaaccagggagtcagaggttgcagtgagccgagatcgtgccattgcactccagcctggcaacagagcaagactctatctcaaaaaaaaaaaaaatcttgctttatttgctcrtctccaaaccacgagcaagacattcattcttactttagttcagcaagcttcagcttatggagctccactgtcttggtcgccatcttgttacccctctggctgtgctcttttaataattgtatgtgggccgggctaatccatcagaagtatcactaggggtcaggcgtggtggcttacgcctgtaatcccagcactttgggaggccgaggtggatggatcacctgaggtcaggagtttgagaccagcctggccaacatggtgaaacatcgtctctactaaaaattcaaaaattagctgggc

SEQ ID NO: 35090 - DNA, 601 bp, Human
gcccaggctggagtgcagtggtgtcatcttggttcactgcaacttctgcctcctgggttcaagcaattctcctgcctcagcctcctgagtagctgggattacaggtgcacaccaccacgcccagctaattttttgtatttttagtagagacagggtttcattatgttggccaggctggtctcgaactcctgacctcaggtgatgcacctgccttggcctcccaaactactgcgattgcaggtgtgagccactgtgcctggtccccaagcttgcttggctggcttacttacttacttacttctttatttatgtagtgaagacaagatctcaggctgatctcgaacttcttggctcaagtgattctcctgtcttggccttccaaagtgctaggatcatagatttgagctcctacacccggccaagttcctttctttttttttttcttttttttttttttgagacagagttttgttcttgtcatccaggctggagtgcaatggcgtgatctccggtcactgcaacctccgcctcctgggttcaagcgattctccagcctcagcctcccaagtagctgggattacaggcacccacccgcaagccg

SEQ ID NO: 35091 - DNA, 601 bp, Human
cccgggaagcagctctgtgggtcagcgtgaggctggctctggtcctgtgcagggagcccggcaggaggctggaatcctgcagggagccagggagtgcagggtatgcttcatgctttcaaagcactgctgttggaggagacattaattatttcagcatcccatcaggcgtggcctgctggcttatcaatgagagctgtggcttgttttgtggaggtggcataagctgagaagaaataggacccaagcttcccagctccccaagtgctgtccctgtcattgtgcaatgtagcatgttccccccgatgccttgcccatagcagcactggggcagcactgggatggggcagtggcctcccatctgtccccagaggcagcagctggctctcctgggcaggctcttaaggcaccgctatacaagtggcctgagggtcgctccttccttgctgacagccctggtgcaggacgcactgtctgcagcttctgtcacctgcaccacagacattgggttgagggccccctttccaggcactggagggacaatggtgaagaggtccttgccctgtgaagccttcactcttgtggtccagggaaagaggtagct

SEQ ID NO: 35092 - DNA, 601 bp, Human
ttagatgtgaagagccaatcagaatggaacttcctggtctcaatgggtgcatttccatcacagctccgctgcacaggaagctggggctcagaaacactcttccctggctctcagggctcgtcaggccaaaactggacaccagaacctcttttccttggatgaagccaaggtgggcctggccccggccttcccagtggtctcacgtctgagtttccctgcaggggagtgcagcaacaaggaatgtcccttcctgcacatcgaccccgagtccaagatcaaggactgtccttggtatgaccgyggcttctgcaagcacggtaggtgccagggtgggctgggccccgggcaagaagccagtcctcccttctctgcccacgaccctggaggctgccagctggtctacctgtcccagcaaaacctgacattctgcagctagcggctttctcacactcctcatctcccttgcctctcccaagaatgctgggtgggtggtggtccacccgcttttttgataaggaggccagtgttgggaggtgaggtccctgccccgtctcccatgaatgggggacagccagcatttgaaaccatgctccagctctct

SEQ ID NO: 35093 - DNA, 601 bp, Human
gatcagacaaagttgaaaacacagggacagctgggtgcggtggctcacgcctgtaatcccagcactttgggaggccgaggggagcaggtcacaaggtcaggagttcgagaccatcctggccaacatagaagaaagaaaacaggaattgcagagccagggaatagagctggcaagagtgttgggtgccaactgggcagagcccctcagggcagcagggactcaggggtgggtgtcagtacagagtcagtgcccccagctgcctcctgacccttttgttcagtgcttgaggctgccgttttasgagtcatagagtaaagagaagctatggaagggcctggataatcaggactgggatgaggcagggtcagggctggatttgtcatgtggctctgcaggctccccttacccaagtctaagcatcgtcccatctctctgatcctgtaatcaaaacctgtccccaaggtagcttaggtgtgtcacagccacgagggaaaacgttgggtacagcccaccctctgtccccagcagtggctccccaagggaggggaggctgggacacttctgatgctgttccctcccatctcctgccagggaaccccag

SEQ ID NO: 35094 - DNA, 601 bp, Human
tgaaaactgcatttgaacagtgttgttgtctgtctctcctcttcccccacttcctgctgttcccagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccktagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtga

SEQ ID NO: 35095 - DNA, 601 bp, Human
tcttttattaaaatttaaacgtagaaagttgtatgatccaagatgggttattatctgggaagaatttaatattcttagaaccatattgttgaaaatagctcttagtaattcccactagactgtggcctcctttgagggcagagactaatttatttatcattatctcagcacctagcacaatacttgaaacataataagtattccgtagtatttgataaatgcatgaatatatttaatattatatttgagaacatgtgatatatcatataccatgtaataaattaattttgtctgttttcttgtaattttctttaaaactattttgacttttgcttaattttttccaaaggaaaaaaattgtatttgtcattgttttttttaatcatacatgctttgaaaggcatgataactgctttgaaagttaaccttataaattcacactatttttcatgaatcatctgctatatgttatgtatcttgtaaatatttctgtacttgctttcttttccctgtttttattagttttattagtttattaaatcaagaataggtacctaataaatgttttttaataacagttgatcagctttcactttgagac

SEQ ID NO: 35096 - DNA, 601 bp, Human
tattgttgaaaatagctcttagtaattcccactagactgtggcctcctttgagggcagagactaatttatttatcattatctcagcacctagcacaatacttgaaacataataagtattccgtagtatttgataaatgcatgaatatatttaatattatatttgagaacatgtgatatatcatataccatgtaataaattaattttgtctgttttcttgtaattttctttaaaactattttgacttttgcttaattttttccaaaggaaaaaaattgtatttgtcattgttttttttaatyatacatgctttgaaaggcatgataactgctttgaaagttaaccttataaattcacactatttttcatgaatcatctgctatatgttatgtatcttgtaaatatttctgtacttgctttcttttccctgtttttattagttttattagtttattaaatcaagaataggtacctaataaatgttttttaataacagttgatcagctttcactttgagacatgatctcaagtatgcagtctttgcagtgttaattattttcaaaaactattctattagcgtattataaaataaatgacatatg

SEQ ID NO: 35097 - DNA, 601 bp, Human
gtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactggtaagaatattaataaggctaattatatagtctaaaataatctctaagttaaaaatgtgttcagcaataagaaggagaatatataggcactttttacttccaaatagtttacaccaayaaggcaaatcattttcttaagaacttgaattttaattctggaaatgtgtctctgcattattttttaaattctgaattctgctgctgtttctgttaaagattttgaagtaattgttttaaagacaagaatcgtggggtatttgggaatatatggaataacttttaatataagaatctatttttgccatttcagcttctataaaaacagttacttaaaagaacataaaattgactgacttcagttatattgccttgcctatcctcttgtgataagaagaataaccaaaagataacaatattt

SEQ ID NO: 35098 - DNA, 601 bp, Human
atgagtcatatgacagaactggtaagaatattaataaggctaattatatagtctaaaataatctctaagttaaaaatgtgttcagcaataagaaggagaatatataggcactttttacttccaaatagtttacaccaacaaggcaaatcattttcttaagaacttgaattttaattctggaaatgtgtctctgcattattttttaaattctgaattctgctgctgtttctgttaaagattttgaagtaattgttttaaagacaagaatcgtggggtatttgggaatatatggaataacttytaatataagaatctatttttgccatttcagcttctataaaaacagttacttaaaagaacataaaattgactgacttcagttatattgccttgcctatcctcttgtgataagaagaataaccaaaagataacaatatttatctttattggtatctggctaactagtagtttttcaattagttcaccagtagtttttggaattgtttatggctttaactaaaaagatcctctgacattgcattgggcaaatattttctgaacttcagtgtccttacttggaaaaggagatgattcctaaatg

SEQ ID NO: 35099 - DNA, 601 bp, Human
tgtctctgcattattttttaaattctgaattctgctgctgtttctgttaaagattttgaagtaattgttttaaagacaagaatcgtggggtatttgggaatatatggaataacttttaatataagaatctatttttgccatttcagcttctataaaaacagttacttaaaagaacataaaattgactgacttcagttatattgccttgcctatcctcttgtgataagaagaataaccaaaagataacaatatttatctttattggtatctggctaactagtagtttttcaattagttcacyagtagtttttggaattgtttatggctttaactaaaaagatcctctgacattgcattgggcaaatattttctgaacttcagtgtccttacttggaaaaggagatgattcctaaatggtgacaaaaattgttttggttggggctgagaaaatttttactctttttatgtataaagcacagatatacatatagtcataaatagatacacagtatatatttggtattaaaattttatggagggagaaggcaattaggcttttttaaaaaagacaaaaggtttcttaggggtgcagtaatgaaaa

SEQ ID NO: 35100 - DNA, 601 bp, Human
acttaaaagaacataaaattgactgacttcagttatattgccttgcctatcctcttgtgataagaagaataaccaaaagataacaatatttatctttattggtatctggctaactagtagtttttcaattagttcaccagtagtttttggaattgtttatggctttaactaaaaagatcctctgacattgcattgggcaaatattttctgaacttcagtgtccttacttggaaaaggagatgattcctaaatggtgacaaaaattgttttggttggggctgagaaaatttttactcttttyatgtataaagcacagatatacatatagtcataaatagatacacagtatatatttggtattaaaattttatggagggagaaggcaattaggcttttttaaaaaagacaaaaggtttcttaggggtgcagtaatgaaaagggggctgaaaaacactggactagaccttccaaggttttctctggctttaaaaacatgagtttctatatgaagtaatagataatgagctccctgaaagccaaaaaactagaaatttctatttgatttcggaagttgaattgttgattttattaaataacaatt

SEQ ID NO: 35101 - DNA, 601 bp, Human
tgagaaaatttttactctttttatgtataaagcacagatatacatatagtcataaatagatacacagtatatatttggtattaaaattttatggagggagaaggcaattaggcttttttaaaaaagacaaaaggtttcttaggggtgcagtaatgaaaagggggctgaaaaacactggactagaccttccaaggttttctctggctttaaaaacatgagtttctatatgaagtaatagataatgagctccctgaaagccaaaaaactagaaatttctatttgatttcggaagttgaattgytgattttattaaataacaatttctgttttagggttaatttatcatcagataccatgaaacaaatatgattgacctaaaatttatgctagttcataaatctgtcaagttatttttatacagtaaggaattaaacttatggcaaaattgattcttcagttctcattaactaaataagggttccatttcttgaaagaatataagtcaagaggacggtgaagtagtgttattttagggtagtttaagtgttgttgtataatacatataatggcagcgatctgagttcaaaatagaggctaaatt

SEQ ID NO: 35102 - DNA, 601 bp, Human
gtaacaaagcaaaaggatctgattgtaatccacaaattggtgggtttgggagaccacagccataacctaggaataatgtgagatcttgaactaaggggagtacacttatttttcacctgtcattcagacctagatagtcctgctggactttaacaataagagcatattaatggaaacaagtggttacacaggacaggaacagatgcagcatttattgatgctgcttttccttggccccttggctccagaattgggagcacagctactagtgaaattctctgtgtaggagggtgctgccacrgttgagaagacagccaaactattgccacagtggtttgggaatagaatacacacacacttctattgttagcagtggcttactaatgcttccgtaaattaagcactctttcatgtaagggaaataggtaaaataatcatataatgaatctgtttcacttgaatgtcccctgatatttaatgctccttatttacaggaatgagggggatatgtctgaatcacgtgaggagtggaaagtggtggcagaagcactttttgtcattgaggaatactttaggataattcatccttttcctaatgtcc

SEQ ID NO: 35103 - DNA, 601 bp, Human
gccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaartgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctga

SEQ ID NO: 35104 - DNA, 601 bp, Human
agactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagayccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcattt

SEQ ID NO: 35105 - DNA, 601 bp, Human
gaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagyggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccata

SEQ ID NO: 35106 - DNA, 601 bp, Human
tctttgaaactagctgaggcaacagatcccctccacacttcgcgggccccacgatcgccccatcaaacaccattatccctcttcccatcacactcccgtccgcccgaggccggcggacctgcagcggcggcgggatggggttggatagaatgcggcccggtcccggcccagcggagctgggggagccgttcccttcggtcctgtgcccaccttggtactggggtccgcgtcggagcagcaactgagggcggcctcgtccgtgaggccgccggacgggggctgcggttctgccatggctgcrctgcagtatcacagacgacgggacccaaggaacggaggagtcacccacactacgcctcggccctgtgccgccttaactaggaatggcgcgatggcgccgcgggcgggagaccgctgacttccagccaatcgctgcgcggagagcaagttgactctctgctgattgggtcccagtgagtcagcgcctccacccacaggactatgcctcagactacaactcccaaggagccttgcgcataaaggaggcaaactcatacaaaaaaaaaaaaaaaatgcaggctgggcagagtggtttctctgt

SEQ ID NO: 35107 - DNA, 601 bp, Human
gcgtagtggcgggcgcctgtagtcccagctacttgggaggctgaggcaggagaatggagtgaatccgggaggcagagcttgcagtgagccgagatcgcgccactgcactccagcctgggcaacagagcaagactctgtctcaaaaaataaataaataaataaataaaaataaaagacaaatgggccaggcgtggtggctcatgcttataatcccagcagtctgggaggccgaggcgggcggatcacttgaggccaggagtttgagaccagcctgggcaacatagtgagaccttgcctctaygcctctaccaaaaacaaacaaacaaaaactagctgggtgtggtggcacacatgtgtagtccaaggtgctcaggaggctgaggcaggaagactacctagaagttagaggcttcagagagcctgtctctaaaaaaaacacatctcatttgcccaagaacaatacaaagatcaaaagatgcatgaaaaacacttcaatatattattaaaaatgtgaagtcataggcagatctggtttgaattatactggtcagtaaacaaaacaaaaaagatttttaaaaactaccttaaaaaatctataata

SEQ ID NO: 35108 - DNA, 601 bp, Human
atagtacctaaaaattagttagagacaaacaggcaaatatcttacaatttcagggtcttatattctcttatctaaaagacaaatggaggccgggcgtggtgggtcacgcctgtaatcccagcactttgggcggccgaggcagacagatcacgaggtcaggagatcgagaccatcctggctaacatggtgaaaccccgtctctacaaaaaatacaaaaaattagctgggcgtagtggcgggcgcctgtagtcccagctacttgggaggctgaggcaggagaatggagtgaatccgggaggcrgagcttgcagtgagccgagatcgcgccactgcactccagcctgggcaacagagcaagactctgtctcaaaaaataaataaataaataaataaaaataaaagacaaatgggccaggcgtggtggctcatgcttataatcccagcagtctgggaggccgaggcgggcggatcacttgaggccaggagtttgagaccagcctgggcaacatagtgagaccttgcctctatgcctctaccaaaaacaaacaaacaaaaactagctgggtgtggtggcacacatgtgtagtccaaggtgctcagg

SEQ ID NO: 35109 - DNA, 601 bp, Human
tcacacaaatctacatatatcacataaaaacaggcaaacttaccgaatcctcgagggtctgaattgccattgtggtaactctgggtctcatcatcttcagtgccccaattgctacaaaaggaaggaaaacatagctacaatgtcctagggaatagatattctgaaaagcaagtaacatctttgaaatcttaccacgtttatatgctactttacataattggcctaacccctgctacaaaaatattaagttttcaactatagaaaggacaaatggccaaagtatgattttaacgagactaargagacagtaaatacaggtactggacaagaacaataataagaataataataatgctcatttattgtgctaagtactttatatttcatttaaacccttaaaacagctccatgggctaggtgtgaacatctccattctattgatgaaactgccacttacttgtttagagtcacagactcatatctaagcctgcctgattccaaagctttattttgaatcaagggacacacgaaatcacacactctgaaatcaatctcttttaaagtatgcagataaacaatgtaaagaaattgcctacatttt

SEQ ID NO: 35110 - DNA, 601 bp, Human
aaagtctactggaaattaattctgagacttaaaagtaaatcatggtgagatggtaagtgtaattttagatcgagactctgaaattaaacaactcctaaataagattatttgtggaaaataaaaataatcatatctctaataaattgatcatacttaattaggacattaatgttttaggtttattaaaatcataattatatacataatacaaaatcacacaaatctacatatatcacataaaaacaggcaaacttaccgaatcctcgagggtctgaattgccattgtggtaactctgggtckcatcatcttcagtgccccaattgctacaaaaggaaggaaaacatagctacaatgtcctagggaatagatattctgaaaagcaagtaacatctttgaaatcttaccacgtttatatgctactttacataattggcctaacccctgctacaaaaatattaagttttcaactatagaaaggacaaatggccaaagtatgattttaacgagactaaagagacagtaaatacaggtactggacaagaacaataataagaataataataatgctcatttattgtgctaagtactttatatttcatt

SEQ ID NO: 35111 - DNA, 601 bp, Human
gaaactgggattagtattaactacagcttttttaaaaaaaaaagtctactggaaattaattctgagacttaaaagtaaatcatggtgagatggtaagtgtaattttagatcgagactctgaaattaaacaactcctaaataagattatttgtggaaaataaaaataatcatatctctaataaattgatcatacttaattaggacattaatgttttaggtttattaaaatcataattatatacataatacaaaatcacacaaatctacatatatcacataaaaacaggcaaacttaccgaawcctcgagggtctgaattgccattgtggtaactctgggtctcatcatcttcagtgccccaattgctacaaaaggaaggaaaacatagctacaatgtcctagggaatagatattctgaaaagcaagtaacatctttgaaatcttaccacgtttatatgctactttacataattggcctaacccctgctacaaaaatattaagttttcaactatagaaaggacaaatggccaaagtatgattttaacgagactaaagagacagtaaatacaggtactggacaagaacaataataagaataata

SEQ ID NO: 35112 - DNA, 601 bp, Human
cagtgagctatgatcacaccactgcactctagcctgggcaacagagcaagactctgtctcaaaaaaaaaaaaaagtaataaacaatatgaaatattaccaatatgaaaaaaagaacaagaacatattaagcaaactaagcgaaaattagagatcaaaattataacaggtgtttaagaacaaaatagatgaattaaatatcagaacagatacatttgggagaaaattagctaattggtattccagtttgaggaaatctcccagaatgcaggcagtgacaaagaaataatataaaaagcttcyagaataaaacagaagaatatacaaaggaacatgaattgacagatttttcaacagcaacatcatatgcaaaaagaaaatagaagagtattttcaagactgaaggaaattaaacctaggcttttccataaaactgtccttcagacataaaggcatcatcctcagttacacagaatctcaaaagttttgccttaaaaaccctttaaagggctgggtgcggtggctcatagctgtaatcccagcactttgggaggctgaggcaggcggatcacctgaggttgggattttgagaccagcctgacc

SEQ ID NO: 35113 - DNA, 601 bp, Human
cccagccctctctccacgcccagggctagggaataacactatcggaagtgtctcctactaatactcttccctgagggatgaagtgggaagatccaacctgaagaggtgttttgtggaaggtgaaataaatttaagtctcatttctaggtgcctaggaatctctggcctaggcttatccagcccattgtcctgagatcatgtgggttgttaaggacagggatctggccattctcctattcacactgcttgatgtgttagaatagcgaacagttgcaggggaaaaaagctcagaggcaaaaaataataatttgagaaacataaccataaaacacccccaaagcaatggactgtagattcaaacagaagaaatattagaataatggaccaagagctatttttgttttttttctggagacagggtcttgctctgtcgtttatactgaaatgaagtacagtggatcatagctcactgcagcctccaactcctgggcccaagcaatcctcccacctcagcctcccgagtagctaggcatacagactacaggcatgtgccaccatgcccagataatttaaaaaaaaacctttttgtagaaacaaggtc

SEQ ID NO: 35114 - DNA, 601 bp, Human
atctccccagccctctctccacgcccagggctagggaataacactatcggaagtgtctcctactaatactcttccctgagggatgaagtgggaagatccaacctgaagaggtgttttgtggaaggtgaaataaatttaagtctcatttctaggtgcctaggaatctctggcctaggcttatccagcccattgtcctgagatcatgtgggttgttaaggacagggatctggccattctcctattcacactgcttgatgtgttagaatagcgaacagttgcaggggaaaaaagctcagaggcraaaaataataatttgagaaacataaccataaaacacccccaaagcaatggactgtagattcaaacagaagaaatattagaataatggaccaagagctatttttgttttttttctggagacagggtcttgctctgtcgtttatactgaaatgaagtacagtggatcatagctcactgcagcctccaactcctgggcccaagcaatcctcccacctcagcctcccgagtagctaggcatacagactacaggcatgtgccaccatgcccagataatttaaaaaaaaacctttttgtagaaaca

SEQ ID NO: 35115 - DNA, 601 bp, Human
agtgcataatggctgcgagagaacagagttttgctcttgctcctccctcactgctgtgtgcatcggcacctgccctctcacttgttcagatgtccttaccagtaaacaagggcagtgcaggagccttgtgcttgtgagaaactgagaaaaactggtagggccgaatgatctccccagccctctctccacgcccagggctagggaataacactatcggaagtgtctcctactaatactcttccctgagggatgaagtgggaagatccaacctgaagaggtgttttgtggaaggtgaaataartttaagtctcatttctaggtgcctaggaatctctggcctaggcttatccagcccattgtcctgagatcatgtgggttgttaaggacagggatctggccattctcctattcacactgcttgatgtgttagaatagcgaacagttgcaggggaaaaaagctcagaggcaaaaaataataatttgagaaacataaccataaaacacccccaaagcaatggactgtagattcaaacagaagaaatattagaataatggaccaagagctatttttgttttttttctggagacagggtcttgctct

SEQ ID NO: 35116 - DNA, 601 bp, Human
cacaatcctttattccgtattcactttcttcttcccacctttcccacactcccttatccatagacactacctgctttacgggctgtacagaatcacaattgttctctcttcagaatgagcctacaagccttttcaaatcctttcagtactcactaaggggagttgtttttttttttttttaaagaaagaacatgatggacaaaggtttacaaattaaacatagtcttatttgaagtttcattttatttcagtctataagtattgctatttgtttaaagcactcacataaatccatttcacycaaaaaggaaacataaagtgcttctagcagtacaagcacggttggcatggcctttccaaaggtcttccactagagtctagagaaatctaaatatagtcatccacaaactggatgtttttattttctgagccattagagattttcaaaatcactttgatttttaaaaactcatcaaatgtgaatcatggcggggaagaccactgagctgatttctgataactaagttatcactgaacataatttatcatatatggctactggcatcatgaagaccttgggatagggaagactctttatgag

SEQ ID NO: 35117 - DNA, 601 bp, Human; identical to SEQ ID NO: 24747

SEQ ID NO: 35118 - DNA, 601 bp, Human; identical to SEQ ID NO: 24748

SEQ ID NO: 35119 - DNA, 601 bp, Human; identical to SEQ ID NO: 24749

SEQ ID NO: 35120 - DNA, 601 bp, Human; identical to SEQ ID NO: 24750

SEQ ID NO: 35121 - DNA, 601 bp, Human; identical to SEQ ID NO: 24751

SEQ ID NO: 35122 - DNA, 601 bp, Human; identical to SEQ ID NO: 24752

SEQ ID NO: 35123 - DNA, 601 bp, Human; identical to SEQ ID NO: 24753

SEQ ID NO: 35124 - DNA, 601 bp, Human; identical to SEQ ID NO: 24754

SEQ ID NO: 35125 - DNA, 601 bp, Human; identical to SEQ ID NO: 24755

SEQ ID NO: 35126 - DNA, 601 bp, Human; identical to SEQ ID NO: 24756

SEQ ID NO: 35127 - DNA, 601 bp, Human; identical to SEQ ID NO: 24757

SEQ ID NO: 35128 - DNA, 601 bp, Human; identical to SEQ ID NO: 24758

SEQ ID NO: 35129 - DNA, 601 bp, Human; identical to SEQ ID NO: 24759

SEQ ID NO: 35130 - DNA, 601 bp, Human; identical to SEQ ID NO: 24760

SEQ ID NO: 35131 - DNA, 601 bp, Human; identical to SEQ ID NO: 24761

SEQ ID NO: 35132 - DNA, 601 bp, Human; identical to SEQ ID NO: 24762

SEQ ID NO: 35133 - DNA, 601 bp, Human; identical to SEQ ID NO: 24763

SEQ ID NO: 35134 - DNA, 601 bp, Human; identical to SEQ ID NO: 24764

SEQ ID NO: 35135 - DNA, 601 bp, Human; identical to SEQ ID NO: 24765

SEQ ID NO: 35136 - DNA, 601 bp, Human; identical to SEQ ID NO: 24766

SEQ ID NO: 35137 - DNA, 601 bp, Human; identical to SEQ ID NO: 24767

SEQ ID NO: 35138 - DNA, 601 bp, Human; identical to SEQ ID NO: 24768

SEQ ID NO: 35139 - DNA, 601 bp, Human; identical to SEQ ID NO: 24769

SEQ ID NO: 35140 - DNA, 601 bp, Human; identical to SEQ ID NO: 24770

SEQ ID NO: 35141 - DNA, 601 bp, Human; identical to SEQ ID NO: 24771

SEQ ID NO: 35142 - DNA, 601 bp, Human; identical to SEQ ID NO: 24772

SEQ ID NO: 35143 - DNA, 601 bp, Human; identical to SEQ ID NO: 24773

SEQ ID NO: 35144 - DNA, 601 bp, Human; identical to SEQ ID NO: 24774

SEQ ID NO: 35145 - DNA, 601 bp, Human; identical to SEQ ID NO: 24775

SEQ ID NO: 35146 - DNA, 601 bp, Human; identical to SEQ ID NO: 24776

SEQ ID NO: 35147 - DNA, 601 bp, Human; identical to SEQ ID NO: 24777

SEQ ID NO: 35148 - DNA, 601 bp, Human; identical to SEQ ID NO: 24778

SEQ ID NO: 35149 - DNA, 601 bp, Human; identical to SEQ ID NO: 24779

SEQ ID NO: 35150 - DNA, 601 bp, Human; identical to SEQ ID NO: 24780

SEQ ID NO: 35151 - DNA, 601 bp, Human; identical to SEQ ID NO: 24781

SEQ ID NO: 35152 - DNA, 601 bp, Human; identical to SEQ ID NO: 24753

SEQ ID NO: 35153 - DNA, 601 bp, Human; identical to SEQ ID NO: 24754

SEQ ID NO: 35154 - DNA, 601 bp, Human; identical to SEQ ID NO: 24755

SEQ ID NO: 35155 - DNA, 601 bp, Human; identical to SEQ ID NO: 24756

SEQ ID NO: 35156 - DNA, 601 bp, Human; identical to SEQ ID NO: 24757

SEQ ID NO: 35157 - DNA, 601 bp, Human; identical to SEQ ID NO: 24758

SEQ ID NO: 35158 - DNA, 601 bp, Human; identical to SEQ ID NO: 24759

SEQ ID NO: 35159 - DNA, 601 bp, Human; identical to SEQ ID NO: 24760

SEQ ID NO: 35160 - DNA, 601 bp, Human; identical to SEQ ID NO: 24761

SEQ ID NO: 35161 - DNA, 601 bp, Human; identical to SEQ ID NO: 24762

SEQ ID NO: 35162 - DNA, 601 bp, Human; identical to SEQ ID NO: 24763

SEQ ID NO: 35163 - DNA, 601 bp, Human; identical to SEQ ID NO: 24764

SEQ ID NO: 35164 - DNA, 601 bp, Human; identical to SEQ ID NO: 24765

SEQ ID NO: 35165 - DNA, 601 bp, Human; identical to SEQ ID NO: 24766

SEQ ID NO: 35166 - DNA, 601 bp, Human; identical to SEQ ID NO: 24767

SEQ ID NO: 35167 - DNA, 601 bp, Human; identical to SEQ ID NO: 24768

SEQ ID NO: 35168 - DNA, 601 bp, Human; identical to SEQ ID NO: 24769

SEQ ID NO: 35169 - DNA, 601 bp, Human; identical to SEQ ID NO: 24770

SEQ ID NO: 35170 - DNA, 601 bp, Human; identical to SEQ ID NO: 24771

SEQ ID NO: 35171 - DNA, 601 bp, Human; identical to SEQ ID NO: 24772

SEQ ID NO: 35172 - DNA, 601 bp, Human; identical to SEQ ID NO: 24773

SEQ ID NO: 35173 - DNA, 601 bp, Human; identical to SEQ ID NO: 24774

SEQ ID NO: 35174 - DNA, 601 bp, Human; identical to SEQ ID NO: 24775

SEQ ID NO: 35175 - DNA, 601 bp, Human; identical to SEQ ID NO: 24776

SEQ ID NO: 35176 - DNA, 601 bp, Human; identical to SEQ ID NO: 24777

SEQ ID NO: 35177 - DNA, 601 bp, Human; identical to SEQ ID NO: 24778

SEQ ID NO: 35178 - DNA, 601 bp, Human; identical to SEQ ID NO: 24779

SEQ ID NO: 35179 - DNA, 601 bp, Human; identical to SEQ ID NO: 24780

SEQ ID NO: 35180 - DNA, 601 bp, Human; identical to SEQ ID NO: 24781

SEQ ID NO: 35181 - DNA, 601 bp, Human
agaagaggagcctcagaataagggggagccccgcacacacttgcagtgttgagggggagggggtcacagtgccgccaccaggagtcaggagccgccgcttccactcaccggctggctggccaggctaagccgtcacacagagagagtaggaacggctggtcagagacagggggctggacatattgactcgggactgagctggagcccggagggaagttgggagggtgctggcggcgaacgtggcgaggaccccactcccatacacatcacccgggcccacggctaggccacctctcccctrtcgggcccgacagtagtgcctcccgtcccctgctcccgccagtacctctggggctcccgcccagccgccgccgcccgcgctggggtcccgctgccgctctcccgctaccgctcccggcgccggctccgcctgggggcggggccatgctgggaggcggggccatgccgggaggcggggccggccgggagctgtctgcggcgggaagcgcagcagcggggattccaggcctggcggaggtcagcaccgagcagtgctcattctaaggccatttcctctcctgagaaacttgtgcctgccttc

SEQ ID NO: 35182 - DNA, 601 bp, Human
tggctccatgagccaagctctgggcacattcagcgctcgggcctgggctatagtgtgtgaaggagtaggagggcatgagggagggggtctgtgcaagccccgctccttgtgggctgagctctgcacgcttggaagtgagatctgtgcatgtgtgcacccagcctgtgcgctgcctcttgctgtggcccagtgccaggctctggcgctgccttgaggggtgttctcgggctctgccccccaccctgaagcttcacacagggtccattgaggctaggacattcctccgggcctgtgtcactakgggtggggggaaagggccggccccgcccccacagatccggaaggcctggctgccccaggaggaggagctggccacttcccagcacatctggaggtcatgaccccatttcggctgccagggggcgcgacagatgtttcctcccaggccaggccagggactggggtggaggccgcctaagaagaagaggagcctcagaataagggggagccccgcacacacttgcagtgttgagggggagggggtcacagtgccgccaccaggagtcaggagccgccgcttccactcaccggctggctggcc

SEQ ID NO: 35183 - DNA, 601 bp, Human
gcaggagaatcgcttaaacctgggaggcagaggttgcagtgagccgagatcgcgccactgaactccagcctgcgggacagagtgagactgtctccaaaaaaacaaagaaaaaaattgggtttaattatttctgtcccctcccaaggctgctgagagactgagaagaatgaggtgagtgtcgctagctatgtgtgtgtgtgacgggtgtagcccctggctccatgagccaagctctgggcacattcagcgctcgggcctgggctatagtgtgtgaaggagtaggagggcatgagggaggggrtctgtgcaagccccgctccttgtgggctgagctctgcacgcttggaagtgagatctgtgcatgtgtgcacccagcctgtgcgctgcctcttgctgtggcccagtgccaggctctggcgctgccttgaggggtgttctcgggctctgccccccaccctgaagcttcacacagggtccattgaggctaggacattcctccgggcctgtgtcactaggggtggggggaaagggccggccccgcccccacagatccggaaggcctggctgccccaggaggaggagctggccacttcccagcaca

SEQ ID NO: 35184 - DNA, 601 bp, Human
gagctggggaacctccactgggggtacaggcatctaatggtgggtcttcatgcagcatccagcaacatcatgcggggctgggccggaggggggtggaggaggggctccacacacccttcgtctggggcctccagaaccaagcaagagtcggctccccagcccaggtgcttctaccttgatttctcctgaataaactcccatgctgaccttgagcctctgttttctcatctctaaaatggggttaactggccgggtgcggtggctgtggcctgtaatcccagcactttgggaggccaaggcrgggggatcacctgaggtcaggagttcaagaccagcctagctaacatggtgaaaccctgtctctactaaaaacataaaaattagccgggtgtggtggtgcgcacctgtagtcccagccactcaggaggctgaggcaggagaatcgcttaaacctgggaggcagaggttgcagtgagccgagatcgcgccactgaactccagcctgcgggacagagtgagactgtctccaaaaaaacaaagaaaaaaattgggtttaattatttctgtcccctcccaaggctgctgagagactgagaagaat

SEQ ID NO: 35185 - DNA, 601 bp, Human
cacacccaggcaagccctggatggagtaggcagtgaggacagggagctggggaacctccactgggggtacaggcatctaatggtgggtcttcatgcagcatccagcaacatcatgcggggctgggccggaggggggtggaggaggggctccacacacccttcgtctggggcctccagaaccaagcaagagtcggctccccagcccaggtgcttctaccttgatttctcctgaataaactcccatgctgaccttgagcctctgttttctcatctctaaaatggggttaactggccgggtgcrgtggctgtggcctgtaatcccagcactttgggaggccaaggcggggggatcacctgaggtcaggagttcaagaccagcctagctaacatggtgaaaccctgtctctactaaaaacataaaaattagccgggtgtggtggtgcgcacctgtagtcccagccactcaggaggctgaggcaggagaatcgcttaaacctgggaggcagaggttgcagtgagccgagatcgcgccactgaactccagcctgcgggacagagtgagactgtctccaaaaaaacaaagaaaaaaattgggtttaat

SEQ ID NO: 35186 - DNA, 601 bp, Human
gacctgctaagtgcggaaacgtgacgccagaggcaggtgcaaatggtggtgtgagaacttgagggaagccacacccaggcaagccctggatggagtaggcagtgaggacagggagctggggaacctccactgggggtacaggcatctaatggtgggtcttcatgcagcatccagcaacatcatgcggggctgggccggaggggggtggaggaggggctccacacacccttcgtctggggcctccagaaccaagcaagagtcggctccccagcccaggtgcttctaccttgatttctcctgrataaactcccatgctgaccttgagcctctgttttctcatctctaaaatggggttaactggccgggtgcggtggctgtggcctgtaatcccagcactttgggaggccaaggcggggggatcacctgaggtcaggagttcaagaccagcctagctaacatggtgaaaccctgtctctactaaaaacataaaaattagccgggtgtggtggtgcgcacctgtagtcccagccactcaggaggctgaggcaggagaatcgcttaaacctgggaggcagaggttgcagtgagccgagatcgcgcc

SEQ ID NO: 35187 - DNA, 601 bp, Human
ttcagcccatagcttggccctcatagccctgactcagatccttagctcacccaaagaactctccagtccccagccccaggattgtacggacaaaggagtgacaaggcaatttgtgctcaccccttcagcacagatctgctcccacccctcctgcccctgggcctcacttttggtgtctagctgggcccggtaactctcaaagcctttgagccgcaccacatcgcccagcaaggtgagaaactgcatgaaggccggtcccgcctcctggttgttgtacatctcctcctccgagccctggccygcccggcagtacaggatgcccaccttgcgttggaagctcagctgtgggtgggagacagaaggcataggtctcagtcccctgcagccccaccccaccagctcttagggaatggatgggacgctggcctggggctgagcaccagccctctctgagccacttgtgcccttgcctgtcaggtgagtacagtctgttgtgctcctcgtgcttgggagtgcacaggtaggaagggatgggaggaggctggttcccatgtggcagtagagaaggtgattcacagaaaggacccttccaataaacata

SEQ ID NO: 35188 - DNA, 601 bp, Human
agattcaagggcctcagccctgggtgcccctcctcctctccctccacaggctccagccccatgccagagtgaaggggggtcaggatgggagagttgaaatagaatgaagacagaaatgagaagtggtctcagagggagggcagggtcaggtgtcctaggaggacaggtgtcactccaggcccaagcatgtgtggcatgctgggaaagtgaaaagcaggcagggggtgctcagtacaacacctcccaggggtcctggggccccttccaccagggaggtaggggcacctctcttccacgaggstgagctgctggaatgtgtttggtggaggggtagtgcccccaaaccactttagccccagctcaggcagtagggtacttgggccttgagggacagtcccagcccctcttttcagcccatagcttggccctcatagccctgactcagatccttagctcacccaaagaactctccagtccccagccccaggattgtacggacaaaggagtgacaaggcaatttgtgctcaccccttcagcacagatctgctcccacccctcctgcccctgggcctcacttttggtgtctagctgggcccggtaa

SEQ ID NO: 35189 - DNA, 601 bp, Human
gtggcttgaacttgccattcctgcctgtacacaggagcctctgtgccccaaacagcaggtggacaaccagtcatgccaccagccaatgcccagccagcgagattcaagggcctcagccctgggtgcccctcctcctctccctccacaggctccagccccatgccagagtgaaggggggtcaggatgggagagttgaaatagaatgaagacagaaatgagaagtggtctcagagggagggcagggtcaggtgtcctaggaggacaggtgtcactccaggcccaagcatgtgtggcatgctgsgaaagtgaaaagcaggcagggggtgctcagtacaacacctcccaggggtcctggggccccttccaccagggaggtaggggcacctctcttccacgaggctgagctgctggaatgtgtttggtggaggggtagtgcccccaaaccactttagccccagctcaggcagtagggtacttgggccttgagggacagtcccagcccctcttttcagcccatagcttggccctcatagccctgactcagatccttagctcacccaaagaactctccagtccccagccccaggattgtacggacaaa

SEQ ID NO: 35190 - DNA, 601 bp, Human
cgagtccagcgacgtagtggtcacctcgttggtggcaggtcttgcaggtactgctggcgggtgcgcgtggccatggcgtggaactgcgcgcgtgccggccgcctgctcaccattcagcgctttggccagcaggaaggcccggaagtcggcgttggctgcgaaggggcctccgccagcaggcagagctggcccgaaggcaggggtgtcctgggtgcggctcacggccaccctgcggggagggaggcgttagtgaggggcggcaggactccatgcccacgggagacctgggaccactccggtrcccacctgtaggtggtgtgtggcgtgcagggtgtgtgtgcccgcaccactaggaacacgtgctggaagtgcgagcggatggtggtggggcagaagggcttgctgccaggctcctggaacacgatggtcacaatgtcgttgccaatgtggcgcttccggaggagctaggggttggatagtaggggctcgtgatgaggtcttctgtgccccaaacccctcctcattcaggcaggagaaagccaaggcaccaatggctcccccactgcccctggtgaagacctagggtgtttctgtctttggg

SEQ ID NO: 35191 - DNA, 601 bp, Human
catcctgacaacagtgaaaaatgtctgcctggttactggccatttttccagaccatggttcaaattccagtgctgcccctgtatatcccaagcaaatcactctgaacatcaatttctccatctgtgaaatggggataatagtacgaacctcatagtgtgctgtgaggatttaaataacacgtgtaaattgcttaaatcccaaaactactgtctgtagccaaatccagcctgtgccttttccttttcttttctaaagcagatgtgccagtttctgtactgcgagctaagcatggattttacttttttttttttttgagatggagttttgctcttgttgcccaggctggagtgcaatggcgcgatcacagctcatggcaacctcctccacctcctgggttcaagtgattttcctgcctcagcctcccaagtagctgggattacagatgcctgccatcacacctggctaatttttgtatttttactagagacgggtttcagcatgttggccaggctggtctcgaactcctgacctcaggtgagctacccgcctcagcctcccaaagtgctgggattacaagcatgagccaccgcgcccggtccg

SEQ ID NO: 35192 - DNA, 601 bp, Human
caaataaacgttatgggagagaagccaagcagtggcctggcctcagggacccctcagtgagtgccagcccatctctgagccagtgttcccagggcctgtcctgactggtccgaggagtttggctggggcctctggaggcaaaaccccttgccctgccctgtcttggacacatgttcagacacagacatcagtggcttttttactccctgaagtcctcttttctccacagaatatttacaaacagggaaggggtggaggccacttccgccaccaaataaggggctagggaggggggcagtgmtaagacacgcctctgcgcagggagagttcctgaggagggcccagtgtgaccacagtgccctcaggggcccaggtggttccagacggctcaggccaggtcggcggtgggtgagcccagctgcttggaggccaggaggaggcgtgtggctgcactctcagactccgcctgcagccgccggttgttgtgtctcaggctccgcacctcctcctccagggccgccctgtccgccttctcctggggtgccggggagacaggagtcagagccgccagcccctttcctggggcagccctgtgactccc

SEQ ID NO: 35193 - DNA, 601 bp, Human
tttgtaatctagttagctgaacaattctagaccagtccttgggagtctgatctgggttggatgatagatggactcgattccccactccctctctgtattgcagggagattcacatgaaggtgaaattaagaaattgaatgctatttgtattttttccaaaaacaggaaaaaatgaattccattcatattggtaaatttttgttttattgtttttccaatctagattaaagagtctattgttggggaaatcagacgggaaattgtaagtggacttttggcagcagtatcttcaagtaaagcrtctaattctaagcaagattatcattaaacagaaattataggtaaatttttctgagtttctttgttgagctaaatgtaaatagtaactggcattttattctttgttttgttagtatacaggtttggttctctagttaaattttgagttttagaatgtatgtaatatgttattttacaatgtgaaaatttcacacaagcctatttgaagtgtaagtcaaatcccataatacaaatctccaaggaattacttatattgggtcattctactgaaatttcattatagtaataaatcctggaattg

SEQ ID NO: 35194 - DNA, 601 bp, Human
ttaataacagtatttgaaagaggtttaaaactgacttctcttttcttttttaaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcartatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggt

SEQ ID NO: 35195 - DNA, 601 bp, Human
gttagtaagggctggacgtgccattatttggtttgcttatctactgaccagctccctgtgcactgggtgcttcctgcctagaacactattcactcgcgctgctcagcccctggcctctcctgtctccaccccttctcagactctgctccccttggtgggccaccccacccccaccttggcggtcttgatgatctcggtgaagttgtccatgatggacttaatgtcgtccttcagccgcttgttgtaggactgcagcagcgtctccttgctctggggcagggctctctgctgggccatggcygagcctcaagcagcgcagcggggagacctgggacctagagtgcagcacagacctctgagtgcaggcagagtctaccccagccaccctctatgccccaaccttagcagaacacgcagatttctggggattccctttctgccaaataaagtcaatcactgaaacacagatgaactcattccatcagcagacaccgcagggggtgccaggactggccccgcctttgccagagcaagctcatcctggaactcctggccagccctccaagccctgtccagggctccagtccagacttcacgtcca

SEQ ID NO: 35196 - DNA, 601 bp, Human
ctacccaggatgtccacactggccacaacctgtctgtggtgccatctacagacctaagcgctgtcagccagacctctgacaaggttcaattccaccctctcttgttctggccatgggagacaacatgcacctttgctcaagacaaatagaggcaacccacgctgcttgctgtgctaggtgcagggatgggggcttatcttggcccggtctttttgggctgtgggagccctgtttggtaggaaccgttgtcacttgcttggcatttggtaaactgttggatgagtgaagggatgatttaagttttttttcgcgaccatttcctgatcacttcccaggtgccaggctgtgtcatgcacttgaccaccattaacccatgccagtttcacagaagcctggcctgccacccctggtgtataggtggccaagcgaggctggatggggcttcccggcaggccttgcaaaggctcagttcggggtgggtgtcaggtaccctcagtggttaagacccagacttcgtgggttcaaatcctggctcagccagttgtgagctgagtgaccttgggcaagtcactaagtctcctgggcctgggtttcctcctga

SEQ ID NO: 35197 - DNA, 601 bp, Human
accctgagtggcccgtgacacctgcgtctcgtcctcaatctgggggaaaacaagaaaacctagaaatcaacccagccaaggcatccccacccctggcccggcccagcccagcttacggtaactgtcatctacccaggatgtccacactggccacaacctgtctgtggtgccatctacagacctaagcgctgtcagccagacctctgacaaggttcaattccaccctctcttgttctggccatgggagacaacatgcacctttgctcaagacaaatagaggcaacccacgctgcttgctgtrctaggtgcagggatgggggcttatcttggcccggtctttttgggctgtgggagccctgtttggtaggaaccgttgtcacttgcttggcatttggtaaactgttggatgagtgaagggatgatttaagttttttttcgcgaccatttcctgatcacttcccaggtgccaggctgtgtcatgcacttgaccaccattaacccatgccagtttcacagaagcctggcctgccacccctggtgtataggtggccaagcgaggctggatggggcttcccggcaggccttgcaaaggctcagttcg

SEQ ID NO: 35198 - DNA, 601 bp, Human
agtcattgaggatcaggaactgcttgaggtcggacaccagcttcatcagggactcgccggctcggacctgtggccatcagaaccagggcgggcacagggtgaggggggacagcggccttgcctacaagtagctgatgctgggcaagggatggcctctctaggagcctcagcttcctcatctgcaaagtgggactctacccctgacctccacaggttcatgtgtgagaattaagtgagaaaactgggatgtcagttctgcagggcaggccctcccctctcgtcagcctctggcttccactcytgcaggactggcctccagtccaattatgcaggtgtacattctgctcatgaaaaactcaaaccccacagataaaactgcgatcccattttgcctcctgccccggggtaggattaacatggctgccagctgggcagagctcctgtgggacctttttccatgcattttgagccctggacgtgcacctgcggaattatctgcttgctgtgtttctcctgtgatccgaaggaatccaatggcgcctacagttccattcggctgtttgtcttttcactcacaactgaccttaggaactcctgagtt

SEQ ID NO: 35199 - DNA, 601 bp, Human
gctctgcatggggagtccagcgctatttatacctggacgagtaatactcctcctccagctcgtagaggtcaatggagatctcgtctcgcagcgtgatgagcttccggtcgcactcctcctgcagtgtgcgcagctgctggttgcgctggtcaatggcctcgttcacggaggggaagtcattgaggatcaggaactgcttgaggtcggacaccagcttcatcagggactcgccggctcggacctgtggccatcagaaccagggcgggcacagggtgaggggggacagcggccttgcctacargtagctgatgctgggcaagggatggcctctctaggagcctcagcttcctcatctgcaaagtgggactctacccctgacctccacaggttcatgtgtgagaattaagtgagaaaactgggatgtcagttctgcagggcaggccctcccctctcgtcagcctctggcttccactcctgcaggactggcctccagtccaattatgcaggtgtacattctgctcatgaaaaactcaaaccccacagataaaactgcgatcccattttgcctcctgccccggggtaggattaacatggctgccag

SEQ ID NO: 35200 - DNA, 601 bp, Human
cagtctcagaaccgtcctgggcacagagtggcatcccgaggaaagcaaaggagaggcagagccagaaagagcaactaacaagcagagagggggcaggcgagcacagaggcgcagctcatgcggaacagggcagggcagggcagggagcggagcgccctttgggggaccagcaagaaggggcagaggaaactcggccaggacctggtcgcttaaaggcaatgtacagaggagggcaactgcttctgccacaggggctgtgtgaggccccccagggggcgctggtgtggacaggaggcctgckggaggggacacaggctggcctggaagccccgctgggtgaagctgagggactgttgggggagggcatgggaagcctggcacagatgtcctgggtttgcgccctgctctgctgcagggccgtgagcaggttccctctctccctgccccaaggcaaggcaggcaggctgaattacaggcccacagctgctctgtgcaggggccctcagggacggtggctgcctcaaagagaccgacaaactgaacagctgtggaaggagatgcccagaagggtctgaaacaccccaggacccctctcagccac

SEQ ID NO: 35201 - DNA, 601 bp, Human
gcgacagttgggaacacaggccctggcacttcccgatagccctacatcagccaggcggcctccagcaggcgtccccacctctaacacggggaatcctcacggcagccaggatgcaggtgaagagctcagctagcccttcccatgcccgcagctgtgacaatccacgctcgcctctttctaacctgcaggcaggggccctggctttcccgcggcctgcctcgcccctggcttcctcccttgctcctgccctcagtgttcagtctcagaaccgtcctgggcacagagtggcatcccgaggaamgcaaaggagaggcagagccagaaagagcaactaacaagcagagagggggcaggcgagcacagaggcgcagctcatgcggaacagggcagggcagggcagggagcggagcgccctttgggggaccagcaagaaggggcagaggaaactcggccaggacctggtcgcttaaaggcaatgtacagaggagggcaactgcttctgccacaggggctgtgtgaggccccccagggggcgctggtgtggacaggaggcctgcgggaggggacacaggctggcctggaagccccgctgggtgaagct

SEQ ID NO: 35202 - DNA, 601 bp, Human
gatgagatgccagcagaggcacaggtgcctggatgtgcaatgatggcagcaggtccattcactgaatactggggacctaccaggtgccaatgaggagagagtgaccttgggccaggctgtccaggcagagctgaggagctgctgctcggacaactgctgggagaccaaggatggtcctggactgacaaggaatgaggaagaaagagcagcaatgcaaaaaagtggcggtgttttaatcaagtctcattacaacggcagaattaggaatgagtcccacctagcttccacatgcgtgggcagyagctgtcacacgggcctgtcgtggcactcagcccatggcacagacatatgtggctcagggcaagaaccagtggatggggctctgcacaggaacgctggcctcgggatgggagacccggcctgcccaacactgctcagagcccctcccaactctgacaacaggctcgggtcaggactccccgaaatcaggcaccctcctgccccactgctgagatccccaacgggccagacctagcttggaaactttcttccacctggctggccaggaaggcagcaaacagagatgatgactcggaatgat

SEQ ID NO: 35203 - DNA, 601 bp, Human
gggatttgcaaagtgccattccatctgctctcaccacctgcagatgtgggtggggtcaggtggaacatccccatttgcggatgaaacagctgaggccccaagaaaggaagacacttgccagaggtcatccatcgtccatggagaggtggcagtgcctccaacactagcctggctatccctggccagggccctccctgtcctcctccccccgccactccaccggcgtcccctggacctaccgatcctgaggtagcccatctgggagagcttgcaggacgccttgccatgggccacctctacygagtgctcgatgaacaacaagacgctcatgatctggaggcaaagcaaagcatcagtcagctgagcctgcatcacggccccccgaccagcccctcccaccttagtggtgtacagcagggaagccagtagtggggatcctggagcagatggcatgccaggtcagtagggcatctcagacaaaagagtggcctttacacacagagagcccatgttcagaatcctgggtcttcctctctccagctatgtgaccctgggcaagctacttgacttctatgtgcctcggttttcccatctgcaagat

SEQ ID NO: 35204 - DNA, 601 bp, Human
ttcctttcttcaacttggttccaaagaagaaataatactgggggctgggggctaaaaagcgcacatgtcctttcctcaggtgtcaattcactcccagcggcactgactgagtgctgaccatgggctgcacccccaatgtgtgtgttcctcatgtaaccctcataaggcaggctgatgagatgtgattgcaggtacattccacagaggaagaaacttggggcaatgtggagggactcagagactgggtcaagacaccagccaggaagagggctcctaccctccccagcctgagcacagggcycgtgtctggtcccctcccatctcccatgccagacctgggctctgctgtccggtgagaggtgggggctgggtactcacagcacggctccgggaggccaacttgaggtaggcgggcagctcaatgtaggagcccagcagggtgagcaggcacaggagatagtccatgatttgcagggacaggaagggcagcaggtacttctcccggttctgaaaggtaggcccagcaccgtcaagtgtcccctgcatgcagccaacactccgccacccagcctgatatcctcatgcatccccttcccaccct

SEQ ID NO: 35205 - DNA, 601 bp, Human
agagctggtggcagacccaagactagaaccaaggtctccagactcccgggccagggcccttccatgatgtagccccccggtctcttcaaggacaacagttggggagagtgagaaaagcaggtttgggagactgtgtccttgactggcagcagccctcaagccaccccacagtgggcgctcactggcatgaatcatccttctcttcctttcttcaacttggttccaaagaagaaataatactgggggctgggggctaaaaagcgcacatgtcctttcctcaggtgtcaattcactcccagcrgcactgactgagtgctgaccatgggctgcacccccaatgtgtgtgttcctcatgtaaccctcataaggcaggctgatgagatgtgattgcaggtacattccacagaggaagaaacttggggcaatgtggagggactcagagactgggtcaagacaccagccaggaagagggctcctaccctccccagcctgagcacagggcccgtgtctggtcccctcccatctcccatgccagacctgggctctgctgtccggtgagaggtgggggctgggtactcacagcacggctccgggaggccaa

SEQ ID NO: 35206 - DNA, 601 bp, Human
caggctggcgcaccggcccatccccagctggcaggtgtcagctgcccatgggccacacctatgctcttctctagaagatcattttggctgacagggaccacctaatccactaatacctgggaggttacattccctcccctaggggcagcttgaaaccaatgactgatgcaggggaactcgccctaggtgagactgcctctgtggtcatttgcaaatattaccacacattctttgagacgcctcccttctaaaggtggtgtttatttcctctccccttgagtgtgggctggacttagcaackcacttctaactaacagaatgtggcagaagtgatagaagtcttaaaagacactgcctttcctccttgcttatctcttacatcactcccgcaggggaagccagcagccatgtcaggagagcactcaagcagcactactacaagtccacaggatgaggaattaggcaaagagcccacgccctgtgagtgagccaccaggagtgcatccttcagatctaatcaagccctcagttgtccacagccccaggtaccatctctggtgcagccccaccagagtccctgagtcagaagaacccagctaag

SEQ ID NO: 35207 - DNA, 601 bp, Human
acagatttgggggccacatcaatgtctctggacataaggaattccaacagcacccacacatccgggaataatgatcccaccctccacacacacacgagcacagcgtggcacagccgtcaccttggtcgaccgccacagcagccttaggaagcaggtgctaccttcagccccatcccactgacgggcaaaccaagaaaagccaagtggctactatctccagatctgcttcccaggctggcgcaccggcccatccccagctggcaggtgtcagctgcccatgggccacacctatgctcttctytagaagatcattttggctgacagggaccacctaatccactaatacctgggaggttacattccctcccctaggggcagcttgaaaccaatgactgatgcaggggaactcgccctaggtgagactgcctctgtggtcatttgcaaatattaccacacattctttgagacgcctcccttctaaaggtggtgtttatttcctctccccttgagtgtgggctggacttagcaactcacttctaactaacagaatgtggcagaagtgatagaagtcttaaaagacactgcctttcctccttgctta

SEQ ID NO: 35208 - DNA, 601 bp, Human
cttctaacagcttggcatgggcaggcctgggcccagcacagcctcaccacccctcccagagccgcagggcagggatccactcaccttgaagataaggacagtgatgaaggcgatggaaaagatgatcatcatcttgatgaactggttatgaggcatatcctcctggctggggaggtaattctgcaacagatttgggggccacatcaatgtctctggacataaggaattccaacagcacccacacatccgggaataatgatcccaccctccacacacacacgagcacagcgtggcacagccrtcaccttggtcgaccgccacagcagccttaggaagcaggtgctaccttcagccccatcccactgacgggcaaaccaagaaaagccaagtggctactatctccagatctgcttcccaggctggcgcaccggcccatccccagctggcaggtgtcagctgcccatgggccacacctatgctcttctctagaagatcattttggctgacagggaccacctaatccactaatacctgggaggttacattccctcccctaggggcagcttgaaaccaatgactgatgcaggggaactcgccctag

SEQ ID NO: 35209 - DNA, 601 bp, Human
tccagtgcttcaccatcactcagacctgggacctgaagctggaccctatcctctgggcctgaccaccccagagaagaatgagaccattcccctcctgccttctcatcaccaaacctctattaacataatctcaggtacattttgatgcctgaattacataaaactgtaacacaggcaaaacaagactcctgcccctgaggcccagagagaagtgacttgctgaagaccaaccacgcagctagtgacagtggggcttggattcaaacgcaggccagtccaaatctaattccagacagctggmattagacatctgaacgcaggtggcctttacggattcacatgccctaaatgggctgtctcggaggatcccaagtaaagtcagaggagctggcatgggaaagcaagagaaaggagctaaaagcaggagaggaggcatggaggacacatgtccctgccttctaacagcttggcatgggcaggcctgggcccagcacagcctcaccacccctcccagagccgcagggcagggatccactcaccttgaagataaggacagtgatgaaggcgatggaaaagatgatcatcatcttgatgaactggt

SEQ ID NO: 35210 - DNA, 601 bp, Human
ttacaggtgaggaaagtaagttaccaggaatttaaaccgtcactttccaataagctgcttctaagcacacctcatcctctcttcccggaaagcctccttctgctttcccagctatctcatatccattgaccctccaagaccagttaactgtcacctcctccaggaaggcttccctgatacctgagaagaggccaggtccttcctctgtgcttattgtccctgtgcttcacaccaagttgtaattgtatctatgtgtctgaactgtacactcctctaaggcagaggtggcatcttagttttytctgcgcctcctggaatcgatatgagactagcaaagagtgagaggcagtaaatactgaataaatgaatgagtgagtgaatgaatcttagactaccagaactgaaagagaacacatttcttctgttccaaccctcatcttacaaatagagaaaccaaggtccagagagggaaggaaacttgacccaaatggcacagggagttagtgacagggctggcacccacctgcagccacactcaccttctggagcatcttggagtttctcttctcctccaccgagttcatgcacttgatcaatctgt

SEQ ID NO: 35211 - DNA, 601 bp, Human
ggacatatttgcctttgcctattcagcatcaagtcccccttattttgaaaacagtgcaccattttccttgggaaaacattctcagtccatataccttcagaagaactggtcccatccctcagatccagcgaggtggctggacttggccactcaaagtagaattccatccccctggctatagtccttggtttggggataggcacgtggcccaagttggtccaatcagacatactcctgggaccttctttttctgttgggatttctgagagggtgggatatctgcctaggggttttggcagcgtttttgccaccacaagggatgggcttccggaaaatgaagccaacatcaaggaaagtagagtcaagagttggagaggacgagatcatatcctgatgtcaggactcagccaggcccaagccagacctacatttggctgctaagttctgtgagctagtaaattcctgaagtcagattgagttgggtttctgccacttgcaaccaaaagtgtcttagctaatacaatctccaccttacaggtgaggaaagtaagttaccaggaatttaaaccgtcactttccaataagctgcttctaagcacac

SEQ ID NO: 35212 - DNA, 601 bp, Human
gctggggcctggcgagggtcacacctctgagtatgggggtggtgctgggcccccctctggggtcttcgatggcaaagacagggcttcctcgtaggacggcaggaccacctgggagagacagagagatgagggctgagtatggtcaagaatgacctgcaattccaacctggggtcatgggacccaaacccccacctctggcaaaatgatgatgataatgactggcaggtcttggatatttgctatgtgctagacattgcctgcatgagataggtgcagttcccagccctgtagtggacatayttgcctttgcctattcagcatcaagtcccccttattttgaaaacagtgcaccattttccttgggaaaacattctcagtccatataccttcagaagaactggtcccatccctcagatccagcgaggtggctggacttggccactcaaagtagaattccatccccctggctatagtccttggtttggggataggcacgtggcccaagttggtccaatcagacatactcctgggaccttctttttctgttgggatttctgagagggtgggatatctgcctaggggttttggcagcctttttgc

SEQ ID NO: 35213 - DNA, 601 bp, Human
agctcacaggccctgcaggaggagcaggccagcgagggagacacaagcagattgtcctgccagggaggggcgggagggcccacccaggccacaggggccaccaaagcaaaaaagcagattatgaggcagctccacccctcccagcactggggctggggcctggcgagggtcacacctctgagtatgggggtggtgctgggcccccctctggggtcttcgatggcaaagacagggcttcctcgtaggacggcaggaccacctgggagagacagagagatgagggctgagtatggtcaagaaygacctgcaattccaacctggggtcatgggacccaaacccccacctctggcaaaatgatgatgataatgactggcaggtcttggatatttgctatgtgctagacattgcctgcatgagataggtgcagttcccagccctgtagtggacatatttgcctttgcctattcagcatcaagtcccccttattttgaaaacagtgcaccattttccttgggaaaacattctcagtccatataccttcagaagaactggtcccatccctcagatccagcgaggtggctggacttggccactcaaagt

SEQ ID NO: 35214 - DNA, 601 bp, Human
gggaagcaggcacaggagggctgttggggccaaacctccccagctgccacaaccgccatgaccccagtggcagggtcagtgcccacaagggggttgcctgctttgactgaactaacctgtgggtttagtccaacgaacagatgtgcctgatttcagggctgaatttttgcttgaccacaagcctcgggcagaacagattcgcctatgactgaatcgactgaatggatggccagcgacagcctggcctgggaatggactggcagctcatcactaaaatgactcctttcatggaatccactgytatgcagccacactgaccacagagcaactgaataggtgagcattggattgttgatgacaactcttcagcagaacaattgtgtgtttgaagggactgttttatgatgaaataactgttatttcctggagctaattgttgaatgacagtttgtcaactgtttaaatgaatttcatttgaattaacaattatacagccactcagaggtcctacattcgccagagttggcatccagttgatgggttcatttgaattaaatggtttggaggctaacgtgattttttaaattgaatttcatcacta

SEQ ID NO: 35215 - DNA, 601 bp, Human
gatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggsggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctct

SEQ ID NO: 35216 - DNA, 601 bp, Human
ggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgkgagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggac

SEQ ID NO: 35217 - DNA, 601 bp, Human
attgcatatcctttcttctgaaggacgctgtttctgctttttcacttttttgatggcctccaaaatccactcagtataaagcgggtttgcgagttttaccatggtgaaggattctgtatatccatagagtcgttatcccttatcctgatgctgagtaagttttacaccatggaaaacaagattctcggaggctgggaaccagttaaccatagcatatgagttttctggcctaagtccttcctcctttcacaaaacagaatgccaccccaattgtactatagaaaccaaaacaacctgttgwttgaaatgtcttccaacttcccaatgaatttctcaatagcaccacacatgggtctcgtcataaagttgtaagaactcaagaatatttcattcccggctccagagcagaaaaatgtgcatcttatgcctgaaaagcaatgaaaataaggtcagttttctaccaagacctatttcgaatgaaaataagcatcctcatcataaagcaatcaaacagcaagtgtttactaggcacccttaagaatttccaaacttatctattaatattccaaaacaatcatgtatgtaaaccattgggataaaa

SEQ ID NO: 35218 - DNA, 601 bp, Human
gcgcaatggctcacgcctgtaatcccaacactctgggaggtcgaggcgggtggatcatgaggtcaggagttcgagactagcctgaccaacatggtgaaaccctgtccctactaaaaatacaaaaattagacgggcatggtggcatgtgcctgtaatcccagctactcagaaggctgaggcaggagaactgcttgaaccagagaggcagaggttgcagtgagccaagatcgtgccactgcactccagcctgggcgacagagtgagactccttctcaaaataaataaataaataaaagagatragtgaccataatattaaaagtttccttaatttgtattaactatgtaaatagagttagcaaaaagttatgttccagccaatctttgataaagaactaaagtttcattagtttcaagtatatccaataaccagaaataagctaaccctggtctgctttaataatgagaaaagggcgacttgtaattaatatatcaactgaccatcctaaatgaatgcctctgtactgctcaaagaaatttggggagtatttctttaatgtggcttagtctctctgcaaatatataattaagtgctttacaaa

SEQ ID NO: 35219 - DNA, 601 bp, Human
cttaaaaaaagagataagccaggcgcaatggctcacgcctgtaatcccaacactctgggaggtcgaggcgggtggatcatgaggtcaggagttcgagactagcctgaccaacatggtgaaaccctgtccctactaaaaatacaaaaattagacgggcatggtggcatgtgcctgtaatcccagctactcagaaggctgaggcaggagaactgcttgaaccagagaggcagaggttgcagtgagccaagatcgtgccactgcactccagcctgggcgacagagtgagactccttctcaaaawaaataaataaataaaagagatgagtgaccataatattaaaagtttccttaatttgtattaactatgtaaatagagttagcaaaaagttatgttccagccaatctttgataaagaactaaagtttcattagtttcaagtatatccaataaccagaaataagctaaccctggtctgctttaataatgagaaaagggcgacttgtaattaatatatcaactgaccatcctaaatgaatgcctctgtactgctcaaagaaatttggggagtatttctttaatgtggcttagtctctctgcaaat

SEQ ID NO: 35220 - DNA, 601 bp, Human
aagactatccccccaccttttaaggtgacagttctcttcctacttatacaacctcaaaaagaaagatccaattattatttcatttaacaaagtagataaaatgtgctttcactaacatcctcctttatattcccagttttatttcagaaagtatttctcaccttttggcatacgggtgagtggcggatcacaacactccatgtgaaaacctcggtcacatgaatcacaaaagagcatgttatcctattagaaaaaagaaaggacagttttgcttaaccttatgaagcagaaacatgttacratcatgactgcataaaacctagaaagcttcagggatcttaaaaaaagagataagccaggcgcaatggctcacgcctgtaatcccaacactctgggaggtcgaggcgggtggatcatgaggtcaggagttcgagactagcctgaccaacatggtgaaaccctgtccctactaaaaatacaaaaattagacgggcatggtggcatgtgcctgtaatcccagctactcagaaggctgaggcaggagaactgcttgaaccagagaggcagaggttgcagtgagccaagatcgtgccactgcact

SEQ ID NO: 35221 - DNA, 601 bp, Human
cccacctcctccagacatagcccagctttctagtccacaatttctgatttctgctaatagatgaaaacattcaaattattttacatccaaagaacacaaaaatgggacttagccatcacctcaataggaagaacctatccagtgatttgtacacctaatagatattaacaactgagacaagatcaggagagtgacatgtgaaatgtcacagtaacaactttttctttcctgtttttatataagagaagcaacataaagcaatggttaagagtcagactttggtgccagactactcggattytcatcccagttcaacatttactatgccttagtttcttcctttgaaaaatgaaagtaacagcagcagctatatttcactgggttgttggcagaattaaacaattcaatgcatataaagcacttagaatagtgtctggcacttattaagggctgaataagtgttagccattattattatataaaagtgccagatatgacaatggaatttttttcatagagaaaacaagtgaatcctacactatagagaagaccctatccttttctcccctcaccttgccacaagtacaacttacaccgtgtt

SEQ ID NO: 35222 - DNA, 601 bp, Human
ttccccccgagctttccgcccatcaggggaaggggtaaaaaatttggtaaggccatcaatgagccctttggttttcttgttgaacttcaaggagacattgctatctctgcagaagtccaagccatctatccgctctaaatatccttcttctgatgatgatgatgctgattggctggaaagagtgatttttcgtttcctaccccttccagggccagttcgaactttgctgaagggaccttttgatctaaacaattaaacaggggaaagggtaagtattaaaaaagatacttgtaaggttccyttttaatacataacatataattagtaagtaacctacagctttattaaaatctatattattaagaatattctgcaaactataaatagtactctgtgaatgaaaattaatattattattagaaacatctattgccaggaagcctacttatagtgcaaagaatgacaggccaggagtcagaagacttgttctagtcataattctctcttactagctgtacgacttggacaaatcacattttttctaaacatatgtcagtgccttcatctgtaaaatgagaactggactaagaacaactaagat

SEQ ID NO: 35223 - DNA, 601 bp, Human
cagtgtctgaaatggcattcttacccctatttttctacttcgactgtagactagagaagcaagttattatatggaaagaaaaagtaaaaagataaataagttttactggatggcccttttaacaactatactggcctattcctagtttcttggcaacaacccatgttaaggcactcaacatattgtaaggtactaaataaattttgctaatattttggccaggcaatgttactacatgggtgaaaacttacatgatgagaatattctgaacatgtatttaacccacaaagcaccatgatgyattatttcttgtaacaccctactaaatgggaaactgaggcataagtagtttatagattagagagcattaatgtcactacaattaactagtatttaattttttgatctcatttcatcttttaattttaaccataaagaaaaaatataataactgacattattgagcacttaccattttctaagtgatttacatgttgtagctcatttaatgtcctcaatatccccacgaagtaagtactattactatctctgctttacagatgaggaaactgaggcacagagcagttgggcagcttttaag

SEQ ID NO: 35224 - DNA, 601 bp, Human
acctcaggcgatctgcctatctcggcctcccaaagtgctgggattacaggcgtgtccttggcgtatttcttctcggtcataaaagatcttggctattcagaattcctgaggaatgagttaacttgaacgctgagttctgtaggtagttgaggaagttcctgccttcctttaacatatatacatatacaatacatacatgtataatatatatgtataatatggaaatgcaaatacaatgtaaccttatcttaaagtcacattaattgttgtcagctcatgaaacagtgtgcttccttaaagwtacaccacagtgtttggggctaactgatcccacagtaaatggccctcaattgctgtgtttcatgagcttgtgtgttagtttcctggggttttgctttttcttctgtttttgttagctgtcactttgaggtcagtgtctgaaatggcattcttacccctatttttctacttcgactgtagactagagaagcaagttattatatggaaagaaaaagtaaaaagataaataagttttactggatggcccttttaacaactatactggcctattcctagtttcttggcaacaacccatgttaag

SEQ ID NO: 35225 - DNA, 601 bp, Human
tttctactggttcctattatactttttttggttattttttgatggcattatttattctttcactgataactagtctcctcacacctgtttctaatgaaaatctcatcagaacaaaagctacattttcaataaatcctttaaatatctatcttaaaagaaaacagtttatgattccattctcatcattctcttgaacaaaagtaaatgctagccctctatttccattcctgaatctatttcctctccccaccttgagtagacaaggggcctgtggtttccatctatctgtactatagtctcyggaacagttgacagacatgtggaaaagctttcttttctaagttgagtgctcttgtgatttgggcagcttgcaaagagctcacttaaaaaatgatcataacaacttattttaaacctgatgaaaaaattaattccttggcatatttattttcttttcttttgagatggagtttcgctcctgttgcccaggcgagagtgcaatggcgcgatctcagttcactgcaacctccgcctcccaggttcaagcgattctcctacctcagcctcctgagtagctgggattacaggcacccaccaccac

SEQ ID NO: 35226 - DNA, 601 bp, Human
taggcaatgcatacacaaatatctggatatgaaagaacattccgtaaagtataatcccacttcccaaaagacgtttttcttgtgatctttgcatttttgtttgctcctattgccctgtttttgtacgttacagtgtttgaaacctttaataagaaaataatttataagcagtttagcacgaaataataaataggcattaacaaaattaagaatagaggtttattatttggaaaatgtaagatctccaaacattttagtcacctcaagtttcaagctcatttaagtaaatataatttttttwaaaaatgtaaccaagagaactacgaatataaagatagaaaaaaagtcataattactcaagaacctattaaaaattacaggatattttctaattgaaaactcaaagaaccctatccaatggatgaaaaaatatacagaaaatgtctaaaactgcttaaggaagttgatgaattttacaagttcctatcctgtttctgctttctactggttcctattatactttttttggttattttttgatggcattatttattctttcactgataactagtctcctcacacctgtttctaatgaaaatct

SEQ ID NO: 35227 - DNA, 601 bp, Human
gatctaaatacaacccttctaaaatacatttattaggtaaaagaagatgtaactatgtagtctaatctatgccagctgcctgaagcaatgcaatctgactaccatgatcgggcttgaacccagataaaactacttaagggggtactaactattgccacgcagaagcaccaagcgggttcctcaagcaatcatgtggtaaatgaggctccaggttggccaggcccaggagcactctgctgctcttttgctcctggcagccttgtctgtgttcatggagttgccagagctttctatcaaaacrccaatggatgcccacattagctcccaagacactgtctgcgatactaacagaactcctcaacaacccaggtagtttaatattctcttcaaacagtatataccacacctaccccagcttctcccaaggtaaagaactcctctactgatcacttaaaagagtcttagggaggaccaagaaaagtgagagactgaggggatcctgacaatctgaaattttactgttacagtaagtaaacggcacataagcaagtactcaattaatacttggcacgaaaaccacagaactgaggatcaagagcgc

SEQ ID NO: 35228 - DNA, 601 bp, Human
ttgaagctgagacagaactcagagagctaatgactgtttatttcagaagttccatgttattaccatgggaagagaagccatttaaaaccttccccgtgagtattgccagcagtccataatcctaggagaatataggttgttgaatgttactaagcaccttctagcacctggtaagtttccaaatgttccttctattctttccaaacagctagatgacacctaggaggtgctgcatcttgttgtgtccccgagtgagaaccagcaaagattctttcagatttctatatgagttcaaacaaaytttaagctgacatacttaccttagaaaagtagccaacaaggtggcagcccttgacatcattctgtgttagtacataaaaaagaaatggctccacatcgtaatagagggttttgtggtcaagaaacaactttgccaaaagacacaggttttgacaataaatggtactcacattcccatcaacctagagaaataaacagaacaaaacagtcagtagagggtctctttagttctagaataatatgtatcagttaaaagcatctctagatatccacagtccagactaggagaaggtgtccatga

SEQ ID NO: 35229 - DNA, 601 bp, Human
ttcacataatcctattaaaattgtagttctgtcagtgaattagatgacaatctttcacttcaaccaaaactcctcacaattacctatcattctaactctaggcaagcaggactgccaatataagtgtggaactgtggactctgtcctctatagtgcacaactctcaagaactgaaaaacaaaggcctaacttctaaggaaaagcaacgaaaatggagatggcagagaaaggtatttttactgtcattaaagaaaacataaaagcagtctaagaatgttaatttggaaacgtattacattargaaaagtaaatacaaacaatactgttattgcacggactgtttgtataccatacacacacacccccaatcaccaaaagtaaaatattttccctaactttgcaatttaatggcatatataacatgtctaatcatgagtcctatttcaaaacaatatattaacattaaaggaagtaatctgagttccatcccctactgctcatctaaaaagaccagaaaatgtgtaaaacaaccagtagcacaagcttccaataaaatatggacagaaggacagtctaaagctaagagaaggcttaattaaca

SEQ ID NO: 35230 - DNA, 601 bp, Human
aacaatgctggttaatttttcagtcttgtttgcttacatttacctattctgaccttttaagtattgagagaagaaaaggaaactgagctttaaaaagaaaatgatcagttatttaacatggatatttcctgtttcagcactgctttaaattctgtatatgcattatttatttaatctccccaacaatcatatgaagtattaccactacaactccactttacaaatgaggcatgtggggtagaaaaaaatttaagtaatctgccccaggtcacgcaagagcaagagaagatgctgggatagraagcctggcagtctgactccagagcctatgttctgaatctttctgcagtaccaccctcaataagcaaagtgaatactattgttcttttaaatgttaaatgagattgtttaataaaatttctcagaaataaaaatttgtaaacagggtggaggagacaggatcttgagacatgggcaagaggaaggaggcatttgagaaatatgaaagaaagtttatgtagtttttaaatttacttttattctgaataatttcattttgaaaaattaaactgcactaaagagaggcatgggattttttatg

SEQ ID NO: 35231 - DNA, 601 bp, Human
tgtgctgctttggctggaagctggctgagtggctcttccagggagcagcctcgcttcagtctggctgcctcctggcaatgcttaaaatccactccatagcctgggatgtttctggtaaacggcttaacagaattcattatcatcattgtacattatttaataactaattggctatcattatgatggaatatagtttagaaaatatttttaaagcaagagagaccacgttaaaccactggagggatgtgtgagaagtggggagagtagagagaaaacaatagcacccaagatgagctactgkactctgagtaccccaaaatatagggcagcactatgttcactttccaattaattatgtaatattttggcctccttttctaatataaacacttctaatctgtacatactttaaaaatatcttttaaagatattttagggctttaagcccctaaaagtcatgatttgaacatcaaaccagtaagctaaaaaaaagtttgtttgcatcccaggaggtgaagcccttaaataagcttatgatttctaagtgaattcccatgaatcaaagaagtcaaacacacacacacatctcaaatgttcactg

SEQ ID NO: 35232 - DNA, 601 bp, Human
taggattacaagagtgaccactatgcccagcttccctatacatactgatagatatatgccaacaggtaccctttaattatgtgatgagaatggcactttacctctatggtcttcctctcaagaatatattaccccattctaatatcatgagggatcatctacaaaatacctgaccagtcattctcaaaactatgaaggccatcgaaactaaggaaattctgagaaactaccacagccaagaggaacctaaagacacatgactactaaatgtaatgcgatatgctgggtgggatcctggaayagaaaaaggacgttagggaaaactatggaaatctgaataaagtatgaactctagttactgatgtatctacactggttcagtaactgtgatagatgtaccacaccaacgcaagggattaataatagaggaaactggctggggtatgcgagaactctctgtactttctttgcattaattctgtaaatgtaaaactgctctgaagatattattcttaaaacaaaacaaaacaaaacaaaagatcctgtcttgctttttaagaccctgtaaggaaaggaacgattgtgctgctttggctggaag

SEQ ID NO: 35233 - DNA, 601 bp, Human
ttttagagattgccaaacgttccttttcttgcttagtgggttgtgttcatttttcagcctttttactgaagggtctgtcactgctactgctatatatctgaagacaataaaccacagtaagtgagttctgtaaaacataccatcagcatcatctgactcttcatcttcttcttcatctttagacttcctcttagaagaggactgacacctgagtacatcctgcgaagacaaacgacggaagtattctctagggaaaagttcattttcatcctcttcctcctcttcttcatcgatctcaaaygtgggttctaatcttggcattggcctctcggagtcagaatcttcaaaaggttcatctaacacttcagtggtctcagaaatagtttctgtgactacactgctattgtggtgtttgcgctttcggactctcctccttcggtggagaaatggtttctgtttaatagagaaagcaagtatttacagttatgaacactatcttttctattaataatacgaaaacagttttaaaaccaaatagaattagcacatataaaatgaggatgttgtttgccaaaaaatattttgaatattatttcaaaat

SEQ ID NO: 35234 - DNA, 601 bp, Human
acaatgatctaagacagaatataaagtgctaaatttacaaaataaatttttagtttcctagttatgttatttcaaaacatagcaagttaaactctgtagaatcattcatgatagagcaaagaacacattcatcttatcactatattaaaagtatttgttggccaggcagggtggctcacacctgtaatcccagcactttgggagtccaaggcgggtggatcacttgaggtcaggagtttgagaccagcctggccaacatggtgaaaccccgtctctactaaaaatacaaaaattagccagrcatggtggcgtgcacctataatcccaactacttgggatgctgaggcacgagaatcgcttgaacccggaggtggaggttgcagtgagctgagactgtgccactgcactcccacctgggtgacagagggagactccatctcaaaaaaataaaaaataaaaaataaaaaagtatttgttatatagaaaatatgagaatggagaaaatgtaagtttatcttctagacttgaaactgactgaatttttaaaagaattaaaaagttcaaccagttaatgcataaaagctaaaggtttatgtaccaa

SEQ ID NO: 35235 - DNA, 601 bp, Human
tcctgctggaatgaagtaggaaatgaaaggttgggtttggaggaaagggtctggttaacccttgagatgtatataacatttaaaaatgacaacattgggagctgcaaacagtgaggggaaacatacattttaaaataaagataattcacttttacacaaattctgtccatgtggtatgtaaagaaagtaaggctctttttaattatgaaaagattttgtgcatgtttccccatccccaaatccatttttagatgagttctactgtaaaatgttcaagattgtgaagaaaaccaaaacccasaacaaaatgaacccaaaaaaagagaagatcaggttttctaaaaaataaaataaaccaaagaaaaattcctctaaatctacagcaatattttaactggaaaaaggtccatttttctctggtttgtcagtataaaaggttcctttatttatatatatttaagtttttgattgcaagttcatcttgctcatcttctcatgtaaggtccgttgagtgactgcttgggcacgccagcagcgttcatgtagctgtgatgggaggggcctgtgtacatcatgttcccatgagggttaggctgcatag

SEQ ID NO: 35236 - DNA, 601 bp, Human
gctgggggtggagcctggagagcttggagccctcataagacctgatagcaaggagggggcacatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggtgagcagagggtggcccttccccttgagcctctctccaaggaacctggatggggatggggagacggtgtyctgggggcagtctggtctcctctaggggtttttggggatgggctgggggagcttctggggccctgccccctctctttgggcagctgttatgctggaggttgagtctgtctccccatggctcaggagctctgtgccagctgaagagcacagccccgtgcagttcccacactgctctccattagcccctaggtctttggggtggagcagaaaaggctctccaggtcatcatcaagttcagtcctgaccttgcacagccaggcctctggggcccccagaaggccaagggcaaacagcagggtt

SEQ ID NO: 35237 - DNA, 601 bp, Human
gacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggtgagcagagggtggcccttccccttgagcctctctccaaggaacctggatggggatggggagacggtgtcctgggggcagtctggtctcctctaggggtttttggggatgggctgggggagcttctggggccctgccccctctctttgggcagctgttatgctggaggttgagtctgtctccccatggctcaggagctctgtgccagctgaagagcacagccccgtgcagttcccacactgctctccattagcccctaggtctttggggtggagcagaaaaggctctccaggtcatcatcaagttcagtcctgaccttgcacagccaggcctctggggcccccagaaggccaagggcaaacagcagggttgcagtgggacgggatcgcctgtgcccggagtgtgcagcctagatgtgtctgtgatgaggacctggaaaag

SEQ ID NO: 35238 - DNA, 601 bp, Human
tcccttcagaacctcaaagggcctccccgactccctctctctctctgcagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacrtggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgctgcattgtggctcgcaagaagcctgggccctgagccaggagggccagccagaggtctggtcaggctgtgaggccttggccatctgtatgctagagaggggtgaggaatggatgctgtctaacagtctctgatttcaacactaacattccatctt

SEQ ID NO: 35239 - DNA, 601 bp, Human
tctgcagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagrggaggtggagcaggctgtcctggatgctggctttgacattgaacagctcctacacagtccccagagctactctgtcaccaatgctgccaacaatggggtctgctgcattgtggctcgcaagaagcctgggccctgagccaggagggccagccagaggtctggtcaggctgtgaggccttggccatctgtatgctagagaggggtgaggaatggatgctgtctaacagtctctgatttcaacactaacattccatcttctgaaattctgagattctaacatccttgttttagaattctaag

SEQ ID NO: 35240 - DNA, 601 bp, Human
ctcttgcttcttctgtagcgaatcctttcatgcagaaaagctggttccataatgcgggaaggaagagacagagttgtaaaccttgcagtcgacaagacaggcaggattcttgcttgccatgtgagtaccatacttaggagaaaataacaaggactaggctgttccttccaaacactcattctttcatattcaatgtaaagatgactttttcttgactcatgttaataattcattatatggtactgtgtggacctataatctctagctttattagcataacaacaaaaatattaataattaytattaggttggtggaaaagtaattgtggtttttgccatttaaaaagtaataattgcaattacttttgtaccagtattattattagcaaccatttattaaatgcttgctcttctaagcaatttaagagcatttaacttcttgttcagccttcagagcaatgctacaagtaggaaatggtatcctcattttacagatgagatagcaaacccagagagattaagttgtccaaggtaatacaactactaagggaagaaaaataaatattgttgtttacttttaattgagaattaggtaaattac

SEQ ID NO: 35241 - DNA, 601 bp, Human
cataaatttatatccagctttaacctcctccctaaacatcaaattcatatatacaaatactttgtgtcaccacttggatgtctaattaagcatttcaaacttttatgtgtcccaaaccaaacttacgttgttcatgtctccaaaaatcttcccacctgctattccttcagacttccctatcttaataaatgattacttgctaccagttgtagtctaaaccttgtagccattcttgattttcttttatttatttatttattttgagacagaggctcgctctgtcgcccaggctggagtgcaytgatgtgatctcgcctcactgcaacctccacctcctgggttcaagtggttttcctgtgtcagcctcccgagtagctgggattacaggcgtgtgccaccacgcctggctaatttttgtatttttagtagagacagagttttaccatgttggcctcaaactcctgacctcaagtgatccacccatctcggtctcccaaagtgctgggattacaggcatgagccaccgcacccagcccattgttgattttcgtatcccatattcatccaatctattagcaaatcctatcagctctaccttcaa

SEQ ID NO: 35242 - DNA, 601 bp, Human
atgtgatctcgcctcactgcaacctccacctcctgggttcaagtggttttcctgtgtcagcctcccgagtagctgggattacaggcgtgtgccaccacgcctggctaatttttgtatttttagtagagacagagttttaccatgttggcctcaaactcctgacctcaagtgatccacccatctcggtctcccaaagtgctgggattacaggcatgagccaccgcacccagcccattgttgattttcgtatcccatattcatccaatctattagcaaatcctatcagctctaccttcaaaastgatcccaaatccagcctcatcttaccacctgcactgccactaccccattcaaaccactgtcatctctcatctgggttattgtaaagccccctgactggtgtccctgctttcttgcttgcccctctatagtctgttctcaacacagtagccagtgtaatctttttatagtggaagttagatcacttccagtagttccatctcactctacctaccttacacaccttatctcttactactctccttttctgctccactagagccacactggtcttcttgctattccttcaacagaacaagaa

SEQ ID NO: 35243 - DNA, 601 bp, Human
taatgaattgaagtgggagaaaattttttaatatttcttgtattgcactccaggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataycaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttat

SEQ ID NO: 35244 - DNA, 601 bp, Human
gcagctttcctcgggggctgctcggtaactgctgagccgggggcgcgctgaagccctgcagaagcccacacccgcttcaggaattccgtggatgttcccgacagaggtttattcccgcctatccctacaggcccacggcgctctttcctccaatcccacacccagtcgaaggcggggcagccgccccacccagcggccagccgggcggcccccagtctggtttaactggttggaacgactaaagcacgctggcgcaaggaaagctctcaacttcgggagctgaggcgcaggctggccagascgtggagaggaaagccctttccatcctcaaggccgttgcaggagatgcccgcgagccaccttcgccagcaccacaccggggtaagccgtccgtccccgaaacccgcaaggccaccgactgcgcaggcgcctgcagagcactggccctcggcgcgttctctcgcgctcttcttcagtctcctcagcgagcctggggacgaagggggcgcggtgcctcctgggtgttgtagtttgcttccttggcgagaggccttcgggctggctggacgccggggccttgggaactacgcctcccagcgcg

SEQ ID NO: 35245 - DNA, 601 bp, Human
cagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggagtaagtgccattttttcctatgcctagatatttttattttattttattttactttattttattattattttttgggacagagtcttgctctgttgcccaggttggagtgcagtagcacaatctcagctcactgcaacctccgcctcgaggttcargcaattctcatgtcttagtctcccgaatagctgggactacaggcgtgcgccaccatgcccagctaatttttgtgtttttagtagagacagggttttgccgtgttggccaggctggtcttgaactcctgaccttaagtgatctacccacctcggcctcccacagtgctgggattacaggcgtgagccactatgcctgtcctagatatattttaaataaacttccactctaattacatgtaccagctgtcttctggaaacatgtgaaggcagagattcttgtttgacttttctgttctttat

SEQ ID NO: 35246 - DNA, 601 bp, Human
cacatccagttaggttacagttccctatgttcggagaaacctttaggccaaacttaaaatacatgaggaggcagctttaacctaacatgtttgttagattgattcatgttattccatgtggcagtaatttgttcatctttgcactagatattgtttcattgcattatatgttagagtttattaatctcttctacttttgttgcttgtttgggtggttttcagtttttgactgttatgaatagtgcttctgtggtgtacatgtttttgtatttctgttatgtttatgcctgggagtggaatwgctcatttgtaggccatgtgtatttcagcttcagtagatccctgcaaaacagtcttccagaatgcttgtaccagtttaccttctcaccagcaatgtatgaatattccacttgctaaagcatcatggtattttgtccttaagattcttgccattctggttggtgtggggtacatggtattttagttagagggtaacttaggaaatagctgttatcttttatataatagcttgcaaggtagctagctaaggaaaagaattaggagagttacagatattaaaaaaaacaacaacaaaaccaaa

SEQ ID NO: 35247 - DNA, 601 bp, Human
cagaatgcttgtaccagtttaccttctcaccagcaatgtatgaatattccacttgctaaagcatcatggtattttgtccttaagattcttgccattctggttggtgtggggtacatggtattttagttagagggtaacttaggaaatagctgttatcttttatataatagcttgcaaggtagctagctaaggaaaagaattaggagagttacagatattaaaaaaaacaacaacaaaaccaaactatgacaactctgacatggttggtaaagcaattgggcacatttgtcagtgtgtgaamaaccagaggtttctgatgcagggaagtgggcccagtggatttggccaccatctaaagatgagggaatttctcagttcaatcctctacttaaaagagtctgcagttcctgctgcagtctccataaagaacttagcagctggtgacaggagagtgaagtgtcataggagaataactgaaacacataaacagtagtgcagttcgtcattctctgagattgcctaaagttataggctaggcagcacttagctggaaaagctagggtaggtaaagtgaacacaggttgagtatccctattccgaa

SEQ ID NO: 35248 - DNA, 601 bp, Human
tcctctacttaaaagagtctgcagttcctgctgcagtctccataaagaacttagcagctggtgacaggagagtgaagtgtcataggagaataactgaaacacataaacagtagtgcagttcgtcattctctgagattgcctaaagttataggctaggcagcacttagctggaaaagctagggtaggtaaagtgaacacaggttgagtatccctattccgaaaatccaaaatgctacaaaatctgaatctttttgagcactggcatgacacttggaggaaatgctcattggagcattttggrtttcagattttttgggttagagatgttgaactggtataatgcaaatatccagaaaaatctgaaatttgaaacacttctggtctcaagtatttcagataagggatactcaacccgtagtatgttagaggacacgactcacgtgatgaaaggatgctcggtctactttagaaaaggattcattccattagccctctatgtagagcctttcaggtgtatctctaatgtttggtttgcctgaattccacttacacacatatgtaatataaaccctgtttcccctcctaatattgtaaggatggt

SEQ ID NO: 35249 - DNA, 601 bp, Human
acttggaggaaatgctcattggagcattttggatttcagattttttgggttagagatgttgaactggtataatgcaaatatccagaaaaatctgaaatttgaaacacttctggtctcaagtatttcagataagggatactcaacccgtagtatgttagaggacacgactcacgtgatgaaaggatgctcggtctactttagaaaaggattcattccattagccctctatgtagagcctttcaggtgtatctctaatgtttggtttgcctgaattccacttacacacatatgtaatataaamcctgtttcccctcctaatattgtaaggatggtaactgctatctatttgtccccctcttgtggtcaagagatgtcactgcaacatctctttttgagaagaaacccatttctttgctgggagtgcccaggaggaattggccaagaagtgaaaagctagattagctggtgccaggtggcaccgttttttggttctgtttttagaaagcatatggacagtttgacattaaacaaacatataacttatactgtctctgtttctttggcagctgaaggctatgcagcctttcaggaagatagctct

SEQ ID NO: 35250 - DNA, 601 bp, Human
gtttgtttttttgagacagagtctcgctctgttgcccaggctggagtgcagtggcgtgatctcggcttactgcaacctctgcctcctgggttcaagcgattcccctgcctcaggctcctgagtagctgggattacaggcgcctgccgccacacccagctaatttttgtatttttagtagaggcagggtttcaccatgttggtcaggctggtctcgaacccctgacctcagatgatctgccctcctcggcctcccaaagtgctgggattacaggagtgagccaccactcccaggcgcctgcttttttttttttttttttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcgcggttcttagagttagtgcagtacccggtcaatacatggagtggtccaagcaagcttctgttccatctccctgctccagaaatcctagaacagatactacacccaa

SEQ ID NO: 35251 - DNA, 601 bp, Human
atgttggtcaggctggtctcgaacccctgacctcagatgatctgccctcctcggcctcccaaagtgctgggattacaggagtgagccaccactcccaggcgcctgcttttttttttttttttttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcrcggttcttagagttagtgcagtacccggtcaatacatggagtggtccaagcaagcttctgttccatctccctgctccagaaatcctagaacagatactacacccaactttagccaaaagaccaagaagcagtaaatgtttaggccccacatgtgaatgctttggtcagctacatgcaactattacgtatattagcaaaatggattttctatttatctttattccatatgtatacaaattaaatttcatacttggaaagaatgtgttttgattgggtatctaaatcaagcaatatgtatat

SEQ ID NO: 35252 - DNA, 601 bp, Human
tatgaataattggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaawaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgc

SEQ ID NO: 35253 - DNA, 601 bp, Human
ttggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttg

SEQ ID NO: 35254 - DNA, 601 bp, Human
tggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaatatataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgg

SEQ ID NO: 35255 - DNA, 601 bp, Human
tactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacasacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataatagtgttatttttgtgttttgttattgattttattttatcaatactggataagttacagatttatcataatgccattaaaagattttcacaaaggataaggaatgc

SEQ ID NO: 35256 - DNA, 601 bp, Human
cacataaaaaagtaatttacccacaactttttggaacatacttaggtacaccaagccacatttttttgtggtcagtcttgtgacttgttagaaaaagcagctggctgcctgtgtagagccagacttacacttggattgtagtttaatttttgtctttttacctttttttttatttttttgagacagagtttcacttttcacccaggctggaatacagtagtgtgacctcggctcactgcaacctccacctcctgggttcaagcgattctcctgcctcagcctcctgagtagctgggagtayaggcacccgccacaatgcccagctaatttttgtatttttagtagagacagggtttcaccatgttggccaggctggtcttgaactccctacctcaggtgatccacctacctcggcctcccaaagtactgggattacaggtgtgcgccactgtgtaatgtttttacattaaaaacaaattcctgaattaatgggcatatttgcttaatatatccatggttgctttgacttctgactgttgagcttttcaattatcatttaacttttggttaaattcacttttgaagttagttttttgggttt

SEQ ID NO: 35257 - DNA, 601 bp, Human
gcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcaggtacatggtcttctctacacatataccctctggtactgacattggggaactggggtaattttctattgctgagtcacatgtaaagcagtgaacttgagaagataggtaatggattagcttgaatacgggtcttttcctttcataatttggacagtgtcratgtataagataacatacttgccctttagcttgtagtgatgtaatttgaatgcggtacagtctttgatgtgggtttataaacaagacctgatgacaaggatccttcattaggggaggaggagcccatggcatctacagttacagagttcgtgtgtagaattttagagatcccagttatttaatcaatagcattattgcttcgttagatcacagacacacatcaaactcaggcacaaagggacctgtcattaattgtttggtcaaagatttagcctgaggatttcattcataaggatggat

SEQ ID NO: 35258 - DNA, 601 bp, Human
ttggtgctgtcatagagtatatgttttcttttaattgcagttaatgatattttactcaggccaataaaaagggagatgataggttatatttattatcttaagccctctttttggccagtattctgagtcaccataaatcactgtcactgttattagagagtgttttcatttactaaagagcgtttcagtcaggcgcggtggctcacacctttaatgcgagcactttaggaggctgtggcaggaggatagcgagaggccaggagttcagcctaggcaacatagcaagaccctgtctctacawaaaaattaaaaattagctgggtgtggtagcatgtatgtgtagtcccagttacttcggaggctgaggtaggaggattgcttgagcccagcagtgagctatgatcatgccactgtactcctctctgggtgacagagcaagattttatctctaaaaaataaagattcttctgttactcattgattacgctttgaaagcaaaatgtttctcagattttagtttgatcattaggatttcaggatctggtaaatattacattgatacttaatattactataatataatagagatggttgtatcata

SEQ ID NO: 35259 - DNA, 601 bp, Human
tgatcattaggatttcaggatctggtaaatattacattgatacttaatattactataatataatagagatggttgtatcatagaagagtcaagtgtgttgtaagagtaagttttaggtaggaaataatttcttgtagtagcttttcagccaacctaatgccctggcctcctagcatatgaacatccatacttaaatgctggctgtgtccaggtatttgtttctggagtgagggctttcaacctcaacccagctttactactgtggtgctcccacttccctcatggtcctcattcattccaktgcgtctgttaaaatatgtcaaagtaagttgaaaataaagaatataagatgttttagccgggcatggtggctcacgcctgtaatcgcagcactttgggaggctgaggtgggtagatcatttgaggtcagcagttcgagaccagcctggccaacatggtgaaactccgtctctactgaaaatacaaaaaaatcagccaggtatggtggcacacgcctgtaatcccagcttaccggggaggctgaggcaggaaaatcgcttgaacccgtgaggtggaggttgcagtgagctgagattgtgcc

SEQ ID NO: 35260 - DNA, 601 bp, Human
gcttttcagccaacctaatgccctggcctcctagcatatgaacatccatacttaaatgctggctgtgtccaggtatttgtttctggagtgagggctttcaacctcaacccagctttactactgtggtgctcccacttccctcatggtcctcattcattccattgcgtctgttaaaatatgtcaaagtaagttgaaaataaagaatataagatgttttagccgggcatggtggctcacgcctgtaatcgcagcactttgggaggctgaggtgggtagatcatttgaggtcagcagttcgagmccagcctggccaacatggtgaaactccgtctctactgaaaatacaaaaaaatcagccaggtatggtggcacacgcctgtaatcccagcttaccggggaggctgaggcaggaaaatcgcttgaacccgtgaggtggaggttgcagtgagctgagattgtgccactgcactctagcctgggctacagagcgaggctccatctcaaaaaagcaccaccaccgccaccaacaacaaaaaacacacaaaaaataagatgtttaaatcagttaatactgtgatagaaaaaataaacaaatggatgg

SEQ ID NO: 35261 - DNA, 601 bp, Human
tgttgtggagtccagtggtgatgggctcttgtttcctgaacactttctgtgtgtctggagctatgttaggcacactgaagtcagaaattcccatctggtactgtttcatgccaaataagtcagaataccatggtggaaagagcatagtttttggaatcaaaacacctggctttaaattcttgctctgatctagttaactgattttaggcaaattcttaaccaccttaagcactggtgttcttgctttaaaatggatcctcttataggattgatgtgaagattaccccaaatgagataatayatgaaacatgccaggcacgttgtaaatagtctaaagatgtttgccttttcttgacaaggttgctgtcatcagccatattttatagataagaatattaaaattcagggaagttaagtaacttaccctgtgtgacatgattactaattacagacccaagatttgagcccaaatcctgggattttttactgtgctattttgatggaagtaacaatgccgtgtgtgtgtgtgtgtgtgtgtgtgtaattcaagactaaataagaaagttaattacatttgattatttatttgcatgcaatttat

SEQ ID NO: 35262 - DNA, 601 bp, Human
taaccaccttaagcactggtgttcttgctttaaaatggatcctcttataggattgatgtgaagattaccccaaatgagataatatatgaaacatgccaggcacgttgtaaatagtctaaagatgtttgccttttcttgacaaggttgctgtcatcagccatattttatagataagaatattaaaattcagggaagttaagtaacttaccctgtgtgacatgattactaattacagacccaagatttgagcccaaatcctgggattttttactgtgctattttgatggaagtaacaatgccttgtgtgtgtgtgtgtgtgtgtgtgtaattcaagactaaataagaaagttaattacatttgattatttatttgcatgcaatttatcaaacccctgcttgcttttcttcccttgtatctgccctgagctcccaatgcttactagttaatgatgatgacattggagatggggatgtggattaagtattattgaaccaatacaaattagtgaataattaataggcaaaacaataagaatgatttttcaatcatatcttcaaaaaaataattagtgccattattttactctaatgaaataaagga

SEQ ID NO: 35263 - DNA, 601 bp, Human
tttaagataagaggatatgaaatgcaactaggtgtgtggcatttgctttctaggagtttcttttgaattgtttacatcgagatctgcagggtgggataaaggatttgtctaaagaagaaagattatgggaagtacaaagaattttgacagccctcaaaagaaaactgagagaagctaaaagacaggtgagttattattttgatacctaatgtttataatagaatgtgtttgagtcttttatgtactttatgtactctttttttttctttctttcttttttcttttgatgttgaccagggtrgtctcaaactcttggcctcaagtaatcctcccacctcggcctcccccagagtgctgggattacagacatgagccaccacccccagcccaagttctttctgttaagaatattataatgtcacttgaagtgaacttctctggtgggacatttattcactaaaatgtttctagtcctatattattgatattgcagcctggtgtcagtcacatgtttcagtgcaatctagaaagtttttttttttttttttttttttgagacaggatcttgctctgtcacccaggctggagtgcagtggcacga

SEQ ID NO: 35264 - DNA, 601 bp, Human
agtcttttatgtactttatgtactctttttttttctttctttcttttttcttttgatgttgaccagggtggtctcaaactcttggcctcaagtaatcctcccacctcggcctcccccagagtgctgggattacagacatgagccaccacccccagcccaagttctttctgttaagaatattataatgtcacttgaagtgaacttctctggtgggacatttattcactaaaatgtttctagtcctatattattgatattgcagcctggtgtcagtcacatgtttcagtgcaatctagaaagtttttttttttttttttttttttgagacaggatcttgctctgtcacccaggctggagtgcagtggcacgataatggctcactgtagcctcgacctcctgggctcaagggatcctcctacctcagcctcctgagtagctgggactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctag

SEQ ID NO: 35265 - DNA, 601 bp, Human
gactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctagaaagttttgttttaattaaaaatgattttactaaaaaatttgtcatttcctgcttggttatacctgtaaacagggctttctatggatgaaaaacaggctggatggtgacacacctttggggactgctggggaatttaagrcatttagaattagtcagctctttggaaatgtagtgatgagggtcacctggaaggccttgaagatcaggagagattctatttatgtaataataataagagtggcctgcaatacctgatgagtttagggtatgccagtcagacttttgagttccctcttgtttagtgtgtgttgcttggttctgggactgtgagtgtaccagccacagcaatggtaaaatcccagatctctggatcaccttaaaatccacattgcagatcaactgcagcatctaaacagcacatccaaggaacattagttag

SEQ ID NO: 35266 - DNA, 601 bp, Human
ttcaactttgaggaataaatgacttttaaagacagaagtaatgtaacttatcatattaacagactaaaaataagaaaaacccacaacatcgtatcagtagatgcagaagaagatttagtagaattcaatacttattcatgataaaattcccagcagataactttctcagcctgataaaggacatctacaaagaatctacaattatcatacttaatagtgaaagactaaatgcttaccctaagattggtgtacactgcagggatttctgctgttaccacctctattcagcattgtactggaygttctagccagtgcaataaagcaagaaaaaagacacacatattggagagaaataagtttttattcttggataacatgattatctgctgagaccagcttggtcggggagaccctaacccagtggcactagaggaattaaaagacacacatacagaaatatagaggtgtagagtgggaaatcaggggtctcacagccttcagagctgagagccacacacagaaatatagaggtgtggagtctcagccttcagagctgagagcctcttattgatagcaagccagtgataagcattgttcccat

SEQ ID NO: 35267 - DNA, 601 bp, Human
atacaaaacctattataaactataaaagaaaaatttgataaattgaatttcatcaaaaatttaaaaatatgctcttcaacagatattaagaaaataaatatccaagccagaagctgcgacagaatatttgcaaaagcttgtatctgataaaggacttgattttttttttaaagtttacagtttaataagaaaacaaccaatttttaaaaggcaaaaatttgaacaaatactttaccaaagatcatatatagatgacaagcacatgcaaagactctcaccatcattagtcattaaggaaatmcagattaaaagtactctgagataacagtatacatcaactagaataggttgctcttggtaatgcaaaatggtgtagccattttgaaaaacagcttggcagtttcttattaagctaaacatgcggttacttaccatagcacccaggcttcccactcctaggtatttctctaagagaagaaagcatttgccctcacaaagcatgtgcgaaatgttcctaacagctctagttgtaatagcttacaactagaaggaaccccaatgtccatcagttggtaaatggataaacaaattggggtacatt

SEQ ID NO: 35268 - DNA, 601 bp, Human
aaagcatttgccctcacaaagcatgtgcgaaatgttcctaacagctctagttgtaatagcttacaactagaaggaaccccaatgtccatcagttggtaaatggataaacaaattggggtacatttattccatggcatgttgctcagcaactactgatacagacagacaagtagatgaatcttaaaagcattgtgctaagtggaagaagccagataatcacactacttactgattgattcagttatgaaactcaaggaaaggaaaaactgcagcgatggagaccaggacgggttgctagatrccggcagatggtggaggagcccaagggcactttgtgtggcaatggaaacgttctagagcatgatggtggtgctggttacttgactttatgtttgtgaacactaaattctgtgctcaagatttacactcctgaccacaccctccctaagtattacaataggtaatttctgtggaagggtaccagaaatggcaagtacattcaccagaattgagtatttttcacagtgcaggcacagactcagatctccatgttatattccaagcccagttaccaaatgcccatccagctagatggttcatc

SEQ ID NO: 35269 - DNA, 601 bp, Human
ttatgtttgtgaacactaaattctgtgctcaagatttacactcctgaccacaccctccctaagtattacaataggtaatttctgtggaagggtaccagaaatggcaagtacattcaccagaattgagtatttttcacagtgcaggcacagactcagatctccatgttatattccaagcccagttaccaaatgcccatccagctagatggttcatctgactgttattgtttcaattctaggaaatgagaaggaaacgtgtagattggtggtggtgtgatttgttgaatatgtgttacatatrggctgactagttcttttttatttgtcttatttgacaggagtgtgaaaccaagattgcacaagagatagccagtctttcaaaagaggatgtttccaaagaagagatgaatgaaaatgaagaagttataaatattctccttgctcaggtaacctaaaatctttttctctcttttgcaagactcttttttgtttttgtttttgagacaaagtctcgctcttgtcccccaggctggagtgcgtcgaagcgatctcggctcactgcaacctgcaacctccgcctcccaggctcaagcgattctcc

SEQ ID NO: 35270 - DNA, 601 bp, Human
gatttgttgaatatgtgttacatatgggctgactagttcttttttatttgtcttatttgacaggagtgtgaaaccaagattgcacaagagatagccagtctttcaaaagaggatgtttccaaagaagagatgaatgaaaatgaagaagttataaatattctccttgctcaggtaacctaaaatctttttctctcttttgcaagactcttttttgtttttgtttttgagacaaagtctcgctcttgtcccccaggctggagtgcgtcgaagcgatctcggctcactgcaacctgcaacctcygcctcccaggctcaagcgattctcctgcctcggccccctgaatagctgggattgcaggcacctgccaccacacccagctaatttttgtgtttttaatagagacggggtttcaccatgttggccaggctggtctagaactcctgacctcaggtgatccgcctgcctcagcctcccaaagtgctgggattaacaggcgtgagccaccgcgcccagcctgcaaggctcttaatggtcatttaaaaatagtaacttgagaagctctactacagatgtgaatattttaaccaaaattataaagtg

SEQ ID NO: 35271 - DNA, 601 bp, Human
atgttggccaggctggtctagaactcctgacctcaggtgatccgcctgcctcagcctcccaaagtgctgggattaacaggcgtgagccaccgcgcccagcctgcaaggctcttaatggtcatttaaaaatagtaacttgagaagctctactacagatgtgaatattttaaccaaaattataaagtgattttgagggcctgtgtctgttttatttgtcccttcctttatgttgtgtttgttaaaatgttcagttatggcgaaagaaactaccttatattcagtaatgactctttactgggcrttgttctagacgtttaatctcatttagtgtgcacacaggtccgaattataggtcttttccctaatttacagattagtggtacttgttccatattaatgagatcagacttttaaaaatattttaaaaaccgttgtacctgacattacaaagtctggaatccttgaaatgtaagaaacagattttatctaatagttgttgctaataacaccttttagatattttgattttattctttacaggtgaaagtcaattgttggaggcaaattgtcttattagtccttcattgatttaacagatatc

SEQ ID NO: 35272 - DNA, 601 bp, Human
taaaatgttcagttatggcgaaagaaactaccttatattcagtaatgactctttactgggcattgttctagacgtttaatctcatttagtgtgcacacaggtccgaattataggtcttttccctaatttacagattagtggtacttgttccatattaatgagatcagacttttaaaaatattttaaaaaccgttgtacctgacattacaaagtctggaatccttgaaatgtaagaaacagattttatctaatagttgttgctaataacaccttttagatattttgattttattctttacargtgaaagtcaattgttggaggcaaattgtcttattagtccttcattgatttaacagatatccctttcgtgcctactgtattccaggcatagagctgaagatgagctcatttctttctgaagttctcaagtcagcctcactttgttctggaaattgccagagtttaaccagaaaggaatgaagttctaggctctgaccacagtgtgtctagggttccagaaactcgtgtggtttccctgaagcccaataggtttcagtccttctgtgtcacctctgaaacatgcgttgttttgcctctcag

SEQ ID NO: 35273 - DNA, 601 bp, Human
gtgaaattcatcatctttaagtttcttatttatcaggtcctaagaatggtgttatattgagtagagtcctgaaaacgtggtaaatataaaaggaggtcacagacaagcacatccagtagcgtcttcctttgtctctcatcttgcagtcgccagcagcacggccgaagtgagactgaggagtactcctccgagagcgagagcgagagtgaggatgaggaggagctgcagatcattctggaagacttacagagacagaacgaagagctggaagtgagttttggggggaaatagccaaaatgcrtactaacttttagaaagttgtagagaccacatatttcccctcagaattgtccttctttttcttggtcaccagctgggaggctgagtagagaggaatttagggggacatctcaccgagagtctgtgggacttgagctaagtgctggccaagcagatggcacctgtgtgtcttcctcaggctgtgaactggagttctgtgactttagtgtgacatgtagacctttctccacccgatgtaaaggcaagcctcacctgactgtgtcagcttgagcagctttgaatgacctagtctctgttccca

SEQ ID NO: 35274 - DNA, 601 bp, Human
gatggtgtctcttgtgtggcaggcggtccagcccatcatcctccacaccacttttttccatgtagggtccaatgtggctgctctgtcttgccactcttagcaggactaagttagcagggaagggatcaaggcatgcccagtcgccaagggcagggtgcatgcgtggcactcggtgcttgcgcttacacctatgcccccttcgcagagcctagtccatgccacacccacgcaggggaggctggcacctgccacagagtggaggccacggcagcagggccgctgctattcctcaggacctaarctttgccgagtacatccagatgatttagaattgatagtaattttctgtagtttgattgagtaggacatttcagaattaccgtaatactattcacaaaagacaaaggatattcacctttgaaacaaatctagttttttatctgatctctaactcccctttctaattgctgctaaaattacttttattttctccttgtttaagggctgttgagaagccagttcaaagttataagttgtctattttaaacactaggatactgaattattaaaataacggttttctgttggcacatggatgtgt

SEQ ID NO: 35275 - DNA, 601 bp, Human
ctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaatcgtctttctttgcttttttatcacagcagaatcaggatctctttctcattcaaggggggaaccacmccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcg

SEQ ID NO: 35276 - DNA, 601 bp, Human
cgggggcagtgctgtgttcctgaaagctcccaggtgactctaacgtttggccagggttcagagcccctgtccagagacgatggttcatttttcctttacctggctccagccaagacatgacataacacttactggtgctgaataattttgcttgactggaaccagaacacaataaatttgtcaagctcgttcttccacatgcagcaggcctgagggctgcagtggcagaaatgccccaaggaatggcactcacatgtcgggcaacctggaaagagaaactttttattagaaagttttcctrgactggtgactgaaggctgaaagggcatcgtgccaacggtggtttcagctgtccctgttcctgtgaaccaaatagcaaaccccaaactctaagagcatggattggatctgcatgttcttaacactcccttctgcttccttctcctaggagactggaaggtggagaggaactataagaacacaaagaccggctgggcgcggttgctcacacctgtaatcccagcactttgggaggccaagacgggttgatcaccaggtcaggagttcgagaccagcctggccaagatggtgaaactccatc

SEQ ID NO: 35277 - DNA, 601 bp, Human
ctcgaggctgagagaacatggacctcactgcttttggggaaaaaaacctaccgtaggagaatccggtgtccagttcgctgggcagacttctccatgtgtttctacatactggaacgccttcaccaagcggagggtttcttccacgcttcggcccactgggagatcgttgacgctcaaatgcttgatgactccattggggtcaattatgaagagacctctgcatgatcatttatcctcatcagtgcctcaacagtaccagaactagaacagtctaacttcttcccttttaggtctttaattytccttttaataaaatatttattaagcgtaatcatatgcttaaaggtggggttttcactgttgtgcaaaaaacttatcatctcttactgatgacagatgctttaacaaaggcagtactggaccaggtcaccataaaacatgcagtatggtcacacttacaagttcacatagtgccctgaatgttacacagtatcggaaagtcactgaactagagagagcaaagactattagtgacttggcaagcattctttgagctgctgtatcacatcttggcaagaaacttataggcaaatgggaagag

SEQ ID NO: 35278 - DNA, 601 bp, Human
atttgcttcaatcacataaacattcattgcaggagttacacggctaatcattgaaaattatgatctttgttagcttaaaagaaaattcagtttaatacaaagacattcaagatgaaaatttcaggaccgttgatcagaagctttcaatgtgtgttgctctactttattataggcaagattcaagtaaggctaagaaagaagagtgtttccattgagacatgatctaagaatagccttctatagaggcaaattatgttctgtagaaactagctagccagccaccaagatgttaccaataaasgattccttgtactagcaactaaccatgtttaaaaggtcttagccagaattacaaaaacaaaacatttagagtaatacttatgaatacaagcataattggttccttgccttctacaaataaccatcttgaaaatgataaaagcaggtttcaactgtggttcttctctcagttgagaaggtgcagatacacatgggtgatctactgatttaccttctgaaagtactctttggaagcagctggacttggcttgatctgaaaatacaaaagcttaattaggtaactgtgactttaccataataa

SEQ ID NO: 35279 - DNA, 601 bp, Human
aaactaaaattcatcaggtttgtgttcattttgttttcaaagcagctgatgcatcactgaaaagcacaagctggccaggcgcaatggctcatgcctgtaatcccagcactttgggaggctgaggtgggcagatcacctgaggtcaggagttcgagaccagcctgcccaacatggcgaaactccgactctactaaaagtacaaaaaattggctgggtgtggtggcaggtgcctgtaatcccagctactcgggaggctgaggcaggagaatcgcttgaacccagaaggcggaggttgcagtamgccaagatcgcactagtgcactccaacctgggcgacaagagccaaactcagtctccaaaaaaaaaaaaaaaagcacaagctaaaagcataacatttcttgtgtacaagtacatcaaagtctaaataatatagttcacaacccagaagtgttaaaggaaaaagcctcctttttgcatatcaatttcattatctacaaatgtgttacatttgaagatgacatatcttcatcgctgtaatcagacataagttggaggcaggggaatgggttacagaaggagacaaaagacccaacctaagaat

SEQ ID NO: 35280 - DNA, 601 bp, Human
gaggggcttctgcacctctgtctcgagtggagtctgagacaggtatgatatgcacaagcctcagcccccagaatgaggcccaggactgaaaaacacgcagtaagcacaccactaaagctgtgcaacactccaaaccactcagggagaaaggaatgtccacacaaaagcaacccaaaagcttgcatgggttatcattactcggcccccacaccaagactcaaagaccacctagcatgcactgggagaactgtaggtactgctccaatctagagccccggggctgtcaccagcccacaccagygcttctccctccccatgtcccctggctcttactcctttgcattctttgggcatatatttgtctgtccaactagatgacaagtacatttaaaaacgtggactcctcgaggccaggtgcagtggtcacgcctgtaatcctagcactttgggaggcagaggcgggtggatcacatgaggtcaggagttcaagaccagcttggccaacatggtgaaacctcatctcttaaaaattagctaggcatggtggcgcatgcctataatcccagctactgtggaggctgaggcaggagaatcacctgaa

SEQ ID NO: 35281 - DNA, 601 bp, Human
gtgaagaatgaaattccacaatacgatctatgctctgtgagacacaaatccctccaacactacactaatgcctcccaaccttctctgggccaccatcataacctcaaaattcacacaatgtatagcatcaaaccttctgaaacctggaccaccagtgagaatcatctttcttgccacctcgttttccaccgccaccacctcctcctccagaagagcgtgtggtagcagctggctttgattctgttcataaacaaagagcacacacagaagcacggcaaggttttagctctctcagcaatgycttcatgtatacggtttaataaaagactcattgcagaatacactgtggcaactgatcagttactaagtgaagcactatgagaaagaatacaaatacaaagcttaccaatcagggaggctcccaagggctatacttgcatcatctcatgaaatatgcacaataacccaataacccaagaaattataggactgttatacccttcacagagggagaaagtatagcttaagtaacttgttggatgggtggcagtgttaggggacagtgaataagtcacagagttgggatgcaaattcctcagtc

SEQ ID NO: 35282 - DNA, 601 bp, Human
tcttacaatcaatagcatcttaaatatgctgaaatatggtcttacttatttcccattggttgtggtgaatatagtcacacatgggcaagcccagcagacagtaacaaaggctgctccgcagacagagaaatggcagggaccacgcacccacttggccctcccttagagccccatctgctctgacaacacacgctgattagctgccacgcccacaggtgactaaatgtagtaaagacccacagagggcccaaagaggctggcacacaacagcacaaagcaggggcagacgctggcacatgayagcacagagcaggggcagaggctggcacacgacagcacagagcaggggcagctgagggcacgtgagaaaagggcgcaagcagaggactgccaagaccatggtcagaagcagtggttccaaaacccagttctgggaggtagtgaaataaaagaatttgtgggtaaatttgaggacaccaggtcaaaacacgggttctctagttgcagtacttctcagcattagaaaaatctgagtgaaaataacaattttacaatggacgagccaggttaacctgctgactgtcacttctttggtctaatc

SEQ ID NO: 35283 - DNA, 601 bp, Human
cgggttcacgccattctcctgcctcagactcccaaatagctgggactacaggcacgtgccaccacacccggctaattttttgtattttttagtagattcgggggtttcaccatgttagccaggatggtctcaatctcctgacctcgtgattcacccgcctcggcctcccaaagtgctgggattacaggcgtgacccactacgcccggccactgcatcaattctaagacacacatttttcatattttaacatcagaaatggagatccattttacaattgatggcatgtcataatttcatcakcatcttattagatttgtcttagcaacttataaaataccatgtgtcttacaatcaatagcatcttaaatatgctgaaatatggtcttacttatttcccattggttgtggtgaatatagtcacacatgggcaagcccagcagacagtaacaaaggctgctccgcagacagagaaatggcagggaccacgcacccacttggccctcccttagagccccatctgctctgacaacacacgctgattagctgccacgcccacaggtgactaaatgtagtaaagacccacagagggcccaaagaggc

SEQ ID NO: 35284 - DNA, 601 bp, Human
aggcacatcccctcccaaagggggctatgctctcatttaggggctgcattgcccaaaccacatccttacacttgcactacacatgaaggtaaccctacacgatatgcacattcccttctgcctgtttttaactttaaaaatggtcttgttttatatataagtattcttctacaactttctttttccctccaacattgcatttgtgaggtttacgcaagctgacacttccgtgctgcagggtacgccatgctatgaccacacccaaggtactgatccatcctcctgttaacagacagctagsctgttacacatttctcacaagcaatgctgttacgaacattcccatatctacctttgtgggcacatcttaaaaaacttctccaggaaacacacctgtagatagacacactaaggctgtgttgcagggtatacatacctttgactttactagatattgccaaattgctctccaaaatggctccccaattcacactgccatgagcaaaacattattattgctctataggacatagcctatcgctctataggacataccaacatttggtagtataagacttcttaatttttgtcactctataaa

SEQ ID NO: 35285 - DNA, 601 bp, Human
aattcacagaaaatacttgagatactcttttaagctcatttaaaatgcatatgatgtttcagccatacaaggaaagaataaagaatcagataaagatgcccccatgttcccccctataattctgcagaagctcccaggcacatcccctcccaaagggggctatgctctcatttaggggctgcattgcccaaaccacatccttacacttgcactacacatgaaggtaaccctacacgatatgcacattcccttctgcctgtttttaactttaaaaatggtcttgttttatatataagtattmttctacaactttctttttccctccaacattgcatttgtgaggtttacgcaagctgacacttccgtgctgcagggtacgccatgctatgaccacacccaaggtactgatccatcctcctgttaacagacagctaggctgttacacatttctcacaagcaatgctgttacgaacattcccatatctacctttgtgggcacatcttaaaaaacttctccaggaaacacacctgtagatagacacactaaggctgtgttgcagggtatacatacctttgactttactagatattgccaaattgc

SEQ ID NO: 35286 - DNA, 601 bp, Human
ctgccacactgcccagttctgatatatctggtgtgtataactcctagagtatgaggcaggttttcctttcagctttaaatctgaaaaagttaatttacaactaattcacatcaattaataaaatgatttaccccatcaacaggagtttttcctggtgtaaaggtcactcgaacaaaacgcttgttgacgacttccaatctgtctacctagaattttaaaaataaattcacacataaattcacagaaaatacttgagatactcttttaagctcatttaaaatgcatatgatgtttcagccayacaaggaaagaataaagaatcagataaagatgcccccatgttcccccctataattctgcagaagctcccaggcacatcccctcccaaagggggctatgctctcatttaggggctgcattgcccaaaccacatccttacacttgcactacacatgaaggtaaccctacacgatatgcacattcccttctgcctgtttttaactttaaaaatggtcttgttttatatataagtattcttctacaactttctttttccctccaacattgcatttgtgaggtttacgcaagctgacacttccgt

SEQ ID NO: 35287 - DNA, 601 bp, Human
cccagctactctggagactgaggcaggagaatcgcgtgaactggggtggggacaaaggttgcagtgagtcaagatcatacgactgcactacagcctgggcgacagagcgaaaccccacctcaaaaaaaaaagaaaatgaatgagtcatgcaaaaactagtgagttactaatagttttttaaaaatctggccaaactgataaaggcctgtttgagaatataatgtatagccctgcacccagggacagaacacagtgaaccacaggcagcacagtcaacagtctacaaaatattatatttgarattacccatcactttcagcaatgtagacaacaggcacccgattttctccttctatgcccaattcctgctgtaaagtttccagattccgttcaaaggtgtccacactgccaatattaaaccaaacgtattgctataaaaacaaaaaaacaaatatcctaagaatgtagtgaaactaaaaggttcaattcactaaacggttcaactttttaagaattttccagaaatactgaaaatttataaattaaagaataaacaataataaaagactggctttaataatggtggtgattaaatgtcact

SEQ ID NO: 35288 - DNA, 601 bp, Human
tactgctttgggtttttcaagaaattcacaaattccatgatctctagcttggcctcctcacagccagccacatctttgaacttcacatcaatttcatcctttaagaccttggcagtggtttctccgacactgaagagtccgcccatccctcggcctgtccggccaatgccagcaggccctcttctgatggtgtagagcaagaaggcgatgatgagcaccgtaggcagcatgctcagcagaaaagagctggggacacacagcgcaacacgggttaggactggctgctcacctccagctttcrcatgtggtgcaagatatcaatataaatatatatagctacaccaaggtataccttctgcacttaatacaaaggagggtaacttgcaagtgttcttcaaaggcaacagaattcccaaataagctccatggcaaccaactcttcgaaataaatggagcatctgcccagactttaagtggggttactaacatggtcttattaaagacaacccccaaagaagaagttctgatgagagaagaatcacctaaaaatcctggaaaactgtgaaatgtaaacataaatgatagttcaaagatgggaatg

SEQ ID NO: 35289 - DNA, 601 bp, Human
tacagcgggcctacagttgctgagagatagggcatctaaatcagattggagggaaaaggaagacgaatcaagaaaatcttccaagaggaggtgacacagatattttcaggaatacatacactatacaagacacatgcacacagaactgacccaaaacgatcctcgagttgggcagaggctagcctagtaagctgagaaagaggaaggacagaaaaacagctatctataataagtaatcaaacttcacagaattataacttcagagatcaagaaacatttcaaaaagttaatcttaaatttyattttacctttgggatttttgctcctaggtcttgatactgctttgggtttttcaagaaattcacaaattccatgatctctagcttggcctcctcacagccagccacatctttgaacttcacatcaatttcatcctttaagaccttggcagtggtttctccgacactgaagagtccgcccatccctcggcctgtccggccaatgccagcaggccctcttctgatggtgtagagcaagaaggcgatgatgagcaccgtaggcagcatgctcagcagaaaagagctggggacacacagcgcaa

SEQ ID NO: 35290 - DNA, 601 bp, Human
gtaagaataaaaagattatcaaaaataattttgtttcaaaaaatttggtaagaatgtgaaatttaaaatatttcctttttttcctagggctgatttttagacctttagtctaacagtatgtaaagggtgacttgggctaggaatatactaataaatctgctaaggtttacttaaataatttaagaagacaccaacaccacactcctgatttatgtaattcttttactctttacaagtaaaattggtttttgagctcaaataattaataaacccaacttctgacttctactttcatgtacamatcagtacatttttagcatggttggacgtgcaacttaaaacctaactgtgaatttgtttttatttccactgactacccacaaacagtatcctctcttatttatagacatactaccacactaccatatccaaatactgtgaggaggtagataatatggtcaaatgatattttttctaggctttgtaataaaaccttaaggtatttttaaaattttgcttattttcttctttaaaagtttcacaaatgaagtagaaatctaacgaccaatgatgaacttaacttcaaagaaagatgtgtttg

SEQ ID NO: 35291 - DNA, 601 bp, Human
ggaataagcacatgaaaagatgctcaacatcactagtcattagagaagtgcaaatcaaaacaacagtgagatgccaaatcacaccagctaggatggctgtaataaaaacacagtgacgagtgctggcaaggatgtggagaaactgggaccctcacaggttactggtgggaatgtaaaatggcacaggtaattaaaacaacctggcagttcctcaaaaagttagagttaccatatcacccagcaattccactcctaggtatataccaagagaaacactatgaccacaaaaaatctgtacacygatgttcatggcagcattattcataatagccaaaaagtggaaacagcccaaatggccatcaactgatgggtggatcaacaagatgtggaacagccaaacaatggcacatttacttggccacaaaaaggaatgaagttctgatgcctgccacaatttgaatcaatcctgttcattatgttaagtgaacataaaccaggcacaaaagaccacatgtttttatttttatttttttgaggtggagttttgctcttgtcacccaggctggagtgcaatggcgtgatctcagctcactgcaacctc

SEQ ID NO: 35292 - DNA, 601 bp, Human
acattataaatttcaaagtccaaagacaagtaaaaagttaggatccctggaacaagatgatcatcttctgaccacactattgtatataatcttttcatacttctcaaactgttctttttttatttcattttgcgttcagaaggagagaaatagggaatgggaaaggatcatattttacattaaaaaattattggaataagcacatgaaaagatgctcaacatcactagtcattagagaagtgcaaatcaaaacaacagtgagatgccaaatcacaccagctaggatggctgtaataaaaasacagtgacgagtgctggcaaggatgtggagaaactgggaccctcacaggttactggtgggaatgtaaaatggcacaggtaattaaaacaacctggcagttcctcaaaaagttagagttaccatatcacccagcaattccactcctaggtatataccaagagaaacactatgaccacaaaaaatctgtacactgatgttcatggcagcattattcataatagccaaaaagtggaaacagcccaaatggccatcaactgatgggtggatcaacaagatgtggaacagccaaacaatggcaca

SEQ ID NO: 35293 - DNA, 601 bp, Human
agatttctctttggtctctgcttacccttttgccaggttctctgggattgccactgtgcatgtgtagtttagttgtcggcctgagatttgggcagttcctgctcagattcgggcctcaccacttggtagttttcttgcttctgggattttcctgttaaatttccagtattctttaagtcctggactatctcctctaccacctcaggataataaagactatgtctcataccactgtagtgtggagattatgaaaaaccctttggcaagaaagccacaggctcccagttcaaacccactgcarctgctgctttataggagcaaactctccagctctcgcctgcttttggacactctgtggtccctttaaataattttctgtccaaattttatatttatctatgggacggtttgtgcaactatggttaccagaagttaccagaagttttggctaaagccttgtttctttctcctttgcaggagtgtagcttgcttcttgagtgactgcagcgagcatctgctcacccatgcactggctgcctagtgcagctaccctgcttcacctttaaaagcgggtctgcgtgctccagataccagccggcaa

SEQ ID NO: 35294 - DNA, 601 bp, Human
tatggacactctaatgttgtcttctctatggttcccttgcttcaggggacccccacacccctggcccgcctcaattcccagcagccctgatacccatcgcaaggcagggaggcagctgctttctgtcatctgtgctgcagcagttcgggaaatgcctcagttgaaaagcaaaaaacttaaaaatctcacatggttcccccgtctttcaggggtagatttctctttggtctctgcttacccttttgccaggttctctgggattgccactgtgcatgtgtagtttagttgtcggcctgagatktgggcagttcctgctcagattcgggcctcaccacttggtagttttcttgcttctgggattttcctgttaaatttccagtattctttaagtcctggactatctcctctaccacctcaggataataaagactatgtctcataccactgtagtgtggagattatgaaaaaccctttggcaagaaagccacaggctcccagttcaaacccactgcagctgctgctttataggagcaaactctccagctctcgcctgcttttggacactctgtggtccctttaaataattttctgtccaaatttt

SEQ ID NO: 35295 - DNA, 601 bp, Human
gcttctcaatttccacaaaaaaaaaaaatctgctataattaccagagattgcactgaaattatcaattagttttgggagaactgatgtaacactccatgagcaaagtccacctctatttttatttagggcttgttatcaatgtgcatgtcctacaaatattttcttaaatttattcctccatatttcgagtttttagatgctactgaaattgctaatgaaattgaatttttaaaatttcattttccaattgtttattgctaatacacagaaatacaattggtctttgtatactgaccttgmattcttcaaccttgctaactttacttattagttctagtgggttctctgtgggttccttaggatgttttatggacactctaatgttgtcttctctatggttcccttgcttcaggggacccccacacccctggcccgcctcaattcccagcagccctgatacccatcgcaaggcagggaggcagctgctttctgtcatctgtgctgcagcagttcgggaaatgcctcagttgaaaagcaaaaaacttaaaaatctcacatggttcccccgtctttcaggggtagatttctctttggtctctg

SEQ ID NO: 35296 - DNA, 601 bp, Human
tgtttttggcagagcttcattctgtcccccaggctggagtgcagtggcacgactgctgcttactgtagcctccgcctcttgggttcaagtgatcctccccatctccagtgattctcctgcctcagtctcctgagtagctgggattataggcgttcaccatcatgtctggctaatttttctatttttagtagagacaggtttcgccacgttagccaggctggtctcaaactcctaacctcaagtgatccgcctgcctcggcgtcccaaagtgctgggattacaggcatgagccactgtaccyggccccattttacattcctatcaataacgtgtgagcgtttcaactgctccatatccttatcaacaatgaagactgtctcttcttcattttaaccattctagcaagtatgttcaggtagctcatgggtgaatttgcatgtccctgataaataatgataccctgtgtgtgcttaatgcccactcatataccttctgggaaatgcatgtttaaatctttcgcccattgttttactgggttgttttcttattattgagttctaagagttctttacaggttctagaaataagtcctttgtcctgt

SEQ ID NO: 35297 - DNA, 601 bp, Human
actgccaaactgttttccaaaacaatggtaccattttacattccctatttttgtttttggcagagcttcattctgtcccccaggctggagtgcagtggcacgactgctgcttactgtagcctccgcctcttgggttcaagtgatcctccccatctccagtgattctcctgcctcagtctcctgagtagctgggattataggcgttcaccatcatgtctggctaatttttctatttttagtagagacaggtttcgccacgttagccaggctggtctcaaactcctaacctcaagtgatccgmctgcctcggcgtcccaaagtgctgggattacaggcatgagccactgtacccggccccattttacattcctatcaataacgtgtgagcgtttcaactgctccatatccttatcaacaatgaagactgtctcttcttcattttaaccattctagcaagtatgttcaggtagctcatgggtgaatttgcatgtccctgataaataatgataccctgtgtgtgcttaatgcccactcatataccttctgggaaatgcatgtttaaatctttcgcccattgttttactgggttgttttcttatta

SEQ ID NO: 35298 - DNA, 601 bp, Human
gtggccacaccctcctttgaaggaagaggggtacagcaggccaagatgctcggcagcctttcctttccagtcctcttttgcaattaagtaaattcctttaatttttaaaaaattcagtttattgagagatgacatatatggtaaaatgcacccatctgaagtgtagagttcaatgagttttgacaaacataacatcaagccccaatgaagatacagaatattctcatcatgcccagaaagttcccttgtacccactggtagggagtctttccctccacacccaaccccaggcaaccacagrcatgccttctgtccctatggattagtttagcttctagaattgcaaataaatgaaattgtatggcacatacttcattgtttggcctctttccctgtttttgagatccatagatactgctgtatgtattaataatcattcatttttactgctgtgtggcactccactgctacaaacataccaaatatccatttcattcttgatggaagtcagggttattttcagtttattgatattatacataaagtagtaacagtctttgcatggacataggtttttatttctcttggggaaataaaagtt

SEQ ID NO: 35299 - DNA, 601 bp, Human
gttcatcagccttagtgggatgtgatctagcagtgactgctcaggaggagtattttctctcaggataagttcaccttagagtgtttttttcttgagattgagattgagtcctgctctgtcacccaggctggagtgcagtggcacgatctcaactcactgcaacctccacctcccgggttcaagtgattctcctgcctcagcctcctgagtagctcggattataagcgcccaccaccaggcctggctaattttttatttttagtaaagaaggggtttcaccatgttggtcaggctggtctcgaacgcctgagctcgtgatcctcctgcctcagcctcccaaactgctgggattacaggcgtgagctaccacgtccagcttcaccttagaattctaaatggcttttcttttttttttttttttaagtaaaaacagggtctcactttgctgctcgggatggtcttaaactcctgactacaagcaattcccccaccttggcctcccaaagtgctaggattacaggcatgcgccaccacacccagcaaatttcttgtctttttgtaaaactcaattgaaagtattccatcttgacattctgacagt

SEQ ID NO: 35300 - DNA, 601 bp, Human
aacgatccctgccacacggtcagccgaccccacttggtgccacagggtccagcctcggccactctgggctcaacctttccagcacgtctgggagcccaatgaggctatgggacagtgtgcatttccctcaaggcctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggasagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaagttcaaccatatcattcttatctaatacttctttttctaacaacagaagagcaacctgaaatatgaacaattttcattaaatacagttactcagcaaagtctattcaga

SEQ ID NO: 35301 - DNA, 601 bp, Human
gcatgcctgtggtaccagctacttagaaggctgaggtgggaggataccttgagcctgggaggttgaggctgcagcgagctatgactgcaccactgtactccagcctgggtgacagagcgagacctcgtctcaaaagaaataatttttaaaaagaagtcattctgctttgtattataagcagtaggccatattcctaattaaacaataagccatgaaggtggggactgagtcacactgtatccatcatagcactggaggtctcatacatctctagactcctgataaacacgtggtggctacrtttacctgtgtcagtgaaacttactctgagaatcccttccactttaggaggtactccactttgccctttaccactcgacggtcgagaactttttccaccacatattcctcttcctcctcttctagcacctcctccactttcttcttgttttgttttttccccatagtgcccgccagctttctggtgtaaagggtgacgctgctaaaatgataaatgaaataaaaagggcattagggagcactcttattggttagataatatctggatggtaagaaaaccagggacatgacaggtgataat

SEQ ID NO: 35302 - DNA, 601 bp, Human
aatatcagggaagaagcagaacaaaactactttgacagtagtttgaattgtgggctagtaaaaattcttacttctattcttacctcttctttcttcttctttggtttgctctcctctcccttatcttcagaatcagaatcagctttgcgcttgcctccctctgatttatctgtctcatgtgctgttttctgtgactgcagaaactcagcaatgaggtcggggcaatccaggttctcttctggctcccatgtgttgtcctcactgaaaccagagggcacagcaagtcacactttcactcaartaagtatactcatactaaggataatcgtaagaggacaagacctcagatgtctatggaaaagctgaaattcttggggaatggggaagctttttagtataaatagaaagctaagaaactggcttccttcaaaggcaaatgacttttatttgtcaatttaaattggtctatagccacacacaaaactgtttctcagcaatcactatgggctgggtacagtggctcatgcttgtagtcccaacactttgggaggcccaggtgggaggactgcttgaggccaggagttaagagacaaacctgggc

SEQ ID NO: 35303 - DNA, 601 bp, Human
aaaatcaatgtttacaactatctcttcactctcaaaaaacaacttactttaagatactgattaagtcaaaatagccacctcacacctttaatgattaaatattgaaaactattttttacaagaatgaattcacttgcccttatatctgtccccagcaagttttccatttactgctcctgtaccatggataaaaagtaagagatcatgtggcttcatgacagtacactctcactttgtaggcattagcctacctaagatttcaggactaagaagagacagctgctaatatcagggaagaagyagaacaaaactactttgacagtagtttgaattgtgggctagtaaaaattcttacttctattcttacctcttctttcttcttctttggtttgctctcctctcccttatcttcagaatcagaatcagctttgcgcttgcctccctctgatttatctgtctcatgtgctgttttctgtgactgcagaaactcagcaatgaggtcggggcaatccaggttctcttctggctcccatgtgttgtcctcactgaaaccagagggcacagcaagtcacactttcactcaaataagtatactcatact

SEQ ID NO: 35304 - DNA, 601 bp, Human
tgtatttttagtagagacccagtttctccgtgttagtcaggatggtcttgatctcctgaccttgtgatccgcccgcctcggcctcccaaggggctgggattacaggtgtgagccaccgtgcccggcccaatcacaaactcttttgccaatatttcaccaataccttggctcaagtaagagagctgttagaatcctttggagtgattattcatcaatgtctgaagcgcatgagattttccctatgtgaaaagggacatacagcccaagcaaaatcaatgtttacaactatctcttcactctaaaaaaacaacttactttaagatactgattaagtcaaaatagccacctcacacctttaatgattaaatattgaaaactattttttacaagaatgaattcacttgcccttatatctgtccccagcaagttttccatttactgctcctgtaccatggataaaaagtaagagatcatgtggcttcatgacagtacactctcactttgtaggcattagcctacctaagatttcaggactaagaagagacagctgctaatatcagggaagaagcagaacaaaactactttgacagtagtttgaatt

SEQ ID NO: 35305 - DNA, 601 bp, Human
ccgctccggctccaaacctcgagcaaagcctcgtggcttttctgactgtaaaaacaagatgggtagaacaattttatctatatgggactattatccagactggaaccattcctgtgtctctgattaatgtaatcacaaactctttttttttttttttgagacggaatctcactctgtcgcccaggctggagtgcagtggtgcgatctcggctcactgcagcctctgcctcccaggttcaagtgattctcctgcctcagcctcccaagtagctgggaccacaggcacatgccaccacgtcagctaattttttgtatttttagtagagacccagtttctccgtgttagtcaggatggtcttgatctcctgaccttgtgatccgcccgcctcggcctcccaaggggctgggattacaggtgtgagccaccgtgcccggcccaatcacaaactcttttgccaatatttcaccaataccttggctcaagtaagagagctgttagaatcctttggagtgattattcatcaatgtctgaagcgcatgagattttccctatgtgaaaagggacatacagcccaagcaaaatcaatgtttacaactatct

SEQ ID NO: 35306 - DNA, 601 bp, Human
tccgctccggctccaaacctcgagcaaagcctcgtggcttttctgactgtaaaaacaagatgggtagaacaattttatctatatgggactattatccagactggaaccattcctgtgtctctgattaatgtaatcacaaactctttttttttttttttgagacggaatctcactctgtcgcccaggctggagtgcagtggtgcgatctcggctcactgcagcctctgcctcccaggttcaagtgattctcctgcctcagcctcccaagtagctgggaccacaggcacatgccaccacgtcmgctaattttttgtatttttagtagagacccagtttctccgtgttagtcaggatggtcttgatctcctgaccttgtgatccgcccgcctcggcctcccaaggggctgggattacaggtgtgagccaccgtgcccggcccaatcacaaactcttttgccaatatttcaccaataccttggctcaagtaagagagctgttagaatcctttggagtgattattcatcaatgtctgaagcgcatgagattttccctatgtgaaaagggacatacagcccaagcaaaatcaatgtttacaactatc

SEQ ID NO: 35307 - DNA, 601 bp, Human
aatttcacacttgggtgattggaatttcgaaggtccagctcttttcctctggcatgaaaccaatgggagaagaaaaaaaacaaccacacagagccactggccgactcaccatttcatcaggaacatgagctctccactggagtctgtagctccaataatccgctccggctccaaacctcgagcaaagcctcgtggcttttctgactgtaaaaacaagatgggtagaacaattttatctatatgggactattatccagactggaaccattcctgtgtctctgattaatgtaatcacaaactmtttttttttttttttgagacggaatctcactctgtcgcccaggctggagtgcagtggtgcgatctcggctcactgcagcctctgcctcccaggttcaagtgattctcctgcctcagcctcccaagtagctgggaccacaggcacatgccaccacgtcagctaattttttgtatttttagtagagacccagtttctccgtgttagtcaggatggtcttgatctcctgaccttgtgatccgcccgcctcggcctcccaaggggctgggattacaggtgtgagccaccgtgcccggcccaatc

SEQ ID NO: 35308 - DNA, 601 bp, Human
tctttattaaggaggtggtagaaggagagggtggtccaatcacatttcattttctccccctttatttacagaagtgaaatgtaattccttcccacactctttccactctagattgtctcccacctcctaaaaatatgggcaaagacccaagattcctaagggctcctacctgtaactcatgagtccagggtggcagtcaggccgagggtcactatcgaaggactatgccatcttaacaatttcacacttgggtgattggaatttcgaaggtccagctcttttcctctggcatgaaaccaaygggagaagaaaaaaaacaaccacacagagccactggccgactcaccatttcatcaggaacatgagctctccactggagtctgtagctccaataatccgctccggctccaaacctcgagcaaagcctcgtggcttttctgactgtaaaaacaagatgggtagaacaattttatctatatgggactattatccagactggaaccattcctgtgtctctgattaatgtaatcacaaactctttttttttttttttgagacggaatctcactctgtcgcccaggctggagtgcagtggtgcgat

SEQ ID NO: 35309 - DNA, 601 bp, Human
agcagaatttctgattctggggccagcctcatctttattaaggaggtggtagaaggagagggtggtccaatcacatttcattttctccccctttatttacagaagtgaaatgtaattccttcccacactctttccactctagattgtctcccacctcctaaaaatatgggcaaagacccaagattcctaagggctcctacctgtaactcatgagtccagggtggcagtcaggccgagggtcactatcgaaggactatgccatcttaacaatttcacacttgggtgattggaatttcgaagrtccagctcttttcctctggcatgaaaccaatgggagaagaaaaaaaacaaccacacagagccactggccgactcaccatttcatcaggaacatgagctctccactggagtctgtagctccaataatccgctccggctccaaacctcgagcaaagcctcgtggcttttctgactgtaaaaacaagatgggtagaacaattttatctatatgggactattatccagactggaaccattcctgtgtctctgattaatgtaatcacaaactctttttttttttttttgagacggaatctcactc

SEQ ID NO: 35310 - DNA, 601 bp, Human
tagctaaactgagtaactcacagtataacttctcccacccaataagcagcatcttaaaaatgaacttttctcttataggttaacaataaatcagctaaaagaggggcagctccagtaactgcctagggaatacatagaagagaataggttagttagttgtgactctggctttcagtggtgctaaagttaggcccctccagccatactgtaaaagaggataattagtacagacacgagtttcagagtaagttctggactgacaaaaggacaaagctccatagactgtgtgtgtgtgtgtgttttttaaaggacaaagtttctagaatgctgccttcattggcaatggcttagaattattccttccaaattttaaatacaatcattgagatccactttgtggggagaatgagcaagaaataggaagaatggccttcttttgacagagtaggaaaattacagagattgttgggataactatcttcattaggctgtttcatggagtattactatcactggtatttatactcataatggaaaaaagcaggcttgctctatgcttgatagcagttaaggagccttgctgacccctgctggctgatcc

SEQ ID NO: 35311 - DNA, 601 bp, Human
ggagtaaactcttaggcagggagcagtagctcacgcctataatcccagcactttgggaggccaaggtgggcaggcccaggagttcaagaccagcctggtcaacatggcaaaaccgtgttgctactaaaaatacaaaaattagccaggcatggtggcgtgcgcctgtaatcccaactattcgggaggctgaggcacaagaatcgcttgaacctgggaggtggaggttgtagtgaacagagatcgcctcactgcacttcagcctgggtgacagagcgagactctgtctcatttaaaaaaaaaacaaactcttatcttcaggttattaggaatgtcctagacagaagcagtagcgtaaagcaagcaggagacacctgatgacatctctgacaaagcaccaccccaaatctctagaaccttaataacaggaaatcagagccacatagtcccatagagcagaagagtaagctgataatgtatgtttttgaacaatggacccaagagaatgggagggaaatgggaatctgaagcatgctgccatttgctgacagctgaacaacaccctctgagttaaatttagtcatttcactccccagaaatattt

SEQ ID NO: 35312 - DNA, 601 bp, Human
taaatctatagttttattaagacaaaaactgacaatgtagtatgaagtttacatttaaacaaagtttacacagaaatctaacacatgcctaaaagaattttacaacgtagctctagatgcaagtctagacaatatcaagaactgatggttctcatgactcaagacagagcattttgggtatgttacttattaggatttcttaaaaaattgttttgtgtgtgtatgtgtgtgttttaaagtgaaccactgcccaatatgaaagtttaatcttctcctgagaccaaggcttttgaaatcactmaactcttggatcaattcagtgaaacttgtgctgtcagtgactgaaccctgccaacaatggtttcagtgttcaaagctcaaagtaaacggctccaagagttttccccactaagagcatgggcccttgtctttccctactgtcttacctcctctaccaccctcttcctcttcctaacacctcagccagtggcttggatgaacaagctgatatttataacttcattactggaaaagaaagggtcttctaatttcgggaattagcacctctaaggcagaatgatctgcttgtactgtatactct

SEQ ID NO: 35313 - DNA, 601 bp, Human
aaccctggttggtggccctgttgaccttcactgggaacaagttcaggggcgaggtcacagctttgaggaattcctcactgctgtgattcaggtctctcctgtccaccctgctctgggtacctggtgtgttacttgtgggcacttgtcacgccagcaagttggctaaggatgggcacagagcagtcacacagataccaaaaaggtccaattcatagcctcgctggctgccgacctttggcctctgcatagtgggctcctgataacaagaagttaacctgcacccaggccacaggtgctcagycaaacatacgacgaggcgctggataaaactccagcccctccaggggtctcttgggctaggagagcacagatcggtaaggggtccgtcctcacttgggcaacctatttgtcatgcccagctgttccttgagcgcccgcagctgggccaggctgatgttgctgcccccgcagacgatgaccacgagggatggcagcggggttcggagattcccctccagttggagcttctggatcacgtggctatagacagcggccagggctgccccgcaggcgggctccaccaggatcttctcatcatctg

SEQ ID NO: 35314 - DNA, 601 bp, Human
ccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggtgagtcctttcctctccaggcccccaggcctcccccacccccaccacgttccttccctctcactctcccccgctgcaggctgctgcatctgaagccccccaggatgtgacctacgcccrgctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagta

SEQ ID NO: 35315 - DNA, 601 bp, Human
tgctgacgtccagggagaaaacttctgtgagtgagaggcagagaaggtgcacctggggtggagctgggggtcccaaaatttcaatagcaatgggggcaggagcacaggctaggattggtcagggactcagggagaagtggtctgaacccacattgtgggacctcggggacatcacagcccctccctgcgttgcagtggcactaatgggaacagggcagggaccagcaggaatgagaggtcccagggaaccttcccaggagatgaaccccttgctctaccccagcaggtgctgccgtgaagracacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggagg

SEQ ID NO: 35316 - DNA, 601 bp, Human
gagggggtcaaggctgaaggagatgttgcggggagaagccgagctgatgcggggagcagggcagccccagccctcacatccctgttctaacccagcaggccctgaggaccagcccctcatgcctacagggtcagtcccccacagtggtgagtgaggggctctgagtgggaggtgggcagggtctaggggagccaagggtgggttctgtcctaggttcaggctcctctggaggtggtgatgtggacaggcccctcccctgcatgggcctcagtttctccaagtgtaaaggagagaggcctgygggtgggaaagttcctttcagctctgactcccagctgtgccctcctgggagaggaggcctcccagggaacctcccagacccgattccgcaggggcctgtccggtcccacctgcagcagagacggtgacctggggcaggggaggggagcagggcggtggttcaagacagtcaggctctttccctgcaactctggggcttggctctggtgcaggaacaagggctgcagctcagactcccgggtttccttcccagctctgccgcttcctggctggaggggtctggggcaggcgattcccctct

SEQ ID NO: 35317 - DNA, 601 bp, Human
ttgcttccacgggtgtgggagtcgggcagcgacttgggaggcaccacaggctcccaaggccctgaggctgggctggtgaggggtgagggggtcaaggctgaaggagatgttgcggggagaagccgagctgatgcggggagcagggcagccccagccctcacatccctgttctaacccagcaggccctgaggaccagcccctcatgcctacagggtcagtcccccacagtggtgagtgaggggctctgagtgggaggtgggcagggtctaggggagccaagggtgggttctgtcctaggttmaggctcctctggaggtggtgatgtggacaggcccctcccctgcatgggcctcagtttctccaagtgtaaaggagagaggcctgtgggtgggaaagttcctttcagctctgactcccagctgtgccctcctgggagaggaggcctcccagggaacctcccagacccgattccgcaggggcctgtccggtcccacctgcagcagagacggtgacctggggcaggggaggggagcagggcggtggttcaagacagtcaggctctttccctgcaactctggggcttggctctggtgcaggaaca

SEQ ID NO: 35318 - DNA, 601 bp, Human
ggggaatagcagttctggactgactgatgggggcatctggagggtcctgggctgagagctgagatatgttgggtgggaaatgacttagaatctgaactctgatttccttccagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccrtccatcacctgggaacacacagggcggtatcgctgtttctacggtagccacactgcaggctggtcagagcccagtgaccccctggagctggtggtgacaggtgagctgacactgagggctcccagccccaggctctgccctcaggaagggagtcagttctcaggggcatctccctctcacagcccagccctggggatgaagtgggaggtgtgagccccatttaacatggtgcctccttctctcctaggagcctacatcaaacccaccctctcagctctacccagccctgtggtgacctca

SEQ ID NO: 35319 - DNA, 601 bp, Human
agccacactgcaggctggtcagagcccagtgaccccctggagctggtggtgacaggtgagctgacactgagggctcccagccccaggctctgccctcaggaagggagtcagttctcaggggcatctccctctcacagcccagccctggggatgaagtgggaggtgtgagccccatttaacatggtgcctccttctctcctaggagcctacatcaaacccaccctctcagctctacccagccctgtggtgacctcaggagggaacgtgaccctccattgtgtctcacaggtggcatttggcrgcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgagaaattcacagcattgcctggagttccctgagtctccctgagtctccaggcaggtggggagcagccacgtctcagggcagctccaggtggga

SEQ ID NO: 35320 - DNA, 601 bp, Human
caggggcatctccctctcacagcccagccctggggatgaagtgggaggtgtgagccccatttaacatggtgcctccttctctcctaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcrcaggtggtcgtacaggtgctatgcttatgactcgaactctccccatgtgtggtctctacccagtgatctcctggagctcctggtcctaggtgagaaattcacagcattgcctggagttccctgagtctccctgagtctccaggcaggtggggagcagccacgtctcagggcagctccaggtgggatgatgttggggcgagagggctcagggctcctggggccggagacacaggaagatcagcagtggtgaggccccgggggagagggaggatatgtggggaagcctgagggtcggctcct

SEQ ID NO: 35321 - DNA, 601 bp, Human
gagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtccyaggtgagaaattcacagcattgcctggagttccctgagtctccctgagtctccaggcaggtggggagcagccacgtctcagggcagctccaggtgggatgatgttggggcgagagggctcagggctcctggggccggagacacaggaagatcagcagtggtgaggccccgggggagagggaggatatgtggggaagcctgagggtcggctcctggaaaccatgagcaccttttcccaggtgtttctaagaagccatcactctcagtgcagccaggtcctatagtggcccctggggagagc

SEQ ID NO: 35322 - DNA, 601 bp, Human
acacagtgaaccccgtctccactaaaaaatagaaaaaattagccaagcgtggtggcaggtgtctgtagtcccaggtactcgggaggctgaggcaggagaatggcatgaacctgggaggcggagcttgccgtgagctgatgtcatgccactgcactcaatcctgggcaagacagcgagactccatctcaaaaaaaaaggaaaagaaaagagtggagtgaagggggaaggtctgcgggggagggtcgagcccatgggagggtggaaatagacggggcctcccacccctggctcccacccttgyagtctcagtagggtaaagagcagggaaggctgggaggagatgggggtgaacctcagaggagatgagagtagactgagggtgaaagacagaggccccacctgctcccctcctgatgtctccacctcagaatcagagcctctggggatcccaacctctaagtcctgaccccatgggtgacaaaaacccagtcactcccagctctaaagaagtttctagactcatctcaatgctacctctaatattcagggtctgatttccagggcagcagaggggagggtggacagtaagggtgtggtctgc

SEQ ID NO: 35323 - DNA, 601 bp, Human
tgtagtctcagtagggtaaagagcagggaaggctgggaggagatgggggtgaacctcagaggagatgagagtagactgagggtgaaagacagaggccccacctgctcccctcctgatgtctccacctcagaatcagagcctctggggatcccaacctctaagtcctgaccccatgggtgacaaaaacccagtcactcccagctctaaagaagtttctagactcatctcaatgctacctctaatattcagggtctgatttccagggcagcagaggggagggtggacagtaagggtgtggtcygcatggcttcctggtgctccagggatggggcaggtgttccctccgtggtgttcagaggggagagaggtgtctgaggttcagcattgatgagtggagcagcggggtctttccccctccccgagcaggattccaggagacatcacctctggttgagactctccactgtctcatgtacataacaaaatctctccaattttctactgaaagcaacacgtggcacagctctgcaggaccccacaccccgaccttgtcctgcaggatgtgtgacgagtagaagagggagaacaggtcgggtcagca

SEQ ID NO: 35324 - DNA, 601 bp, Human
acgtctcatatgtcattcatttctacactgtattttctgtacgtatgctttctatatgtatgctctctcctttactaaaacttttaaagcaatacttcaatatataaatttatattttttatttcaattatatgaacctattatttaaaaacatttaattttactttgcctttcattggggcttgatttaatttatatattcaatgtagacatccatttttcattaacctcaagtcttcctcctgtacatattaaaaatcgaggtttccttaacgaacttcagaaatgtttggatgtttcmaagcacaatggcccgagcgaaactgactgggcggctccctgtggcatgagaaacccgggggaggtcagcgggagctacagtgcagctcagccctgggcctggggggttcatgcccaaccttgtccaatcactggataattctaacatctaaataaacgtcttttatatgaaaaaagtgctttaaattgttaatttagatttaaattagaacagggcaatttggtagtgggttaatatgaaatacaatgaatatacccaaaccagtggctttctcatgagtacttatctctcgttttaaaa

SEQ ID NO: 35325 - DNA, 601 bp, Human
tatattcattgtatttcatgctaactcactactaaattgctctgttctaactgcttttcaatggatctcctctaatttactaatacaatttgtataaaccgtaagacaatgggaaattttacttctttatttctaaattatgtgccaatatttctcactttaaatgtcaatatatatgttactacatcttaaataaatatctgaagttttacatatatacatatttatgtgtggttaagtaagatacttttgaatatgtgtgtaagtatatccaaattcatttgatgtatattcatgcatatgcttaatatatttgatgcggtaggtgtttacatgtttgttcctggtctagattcacctagattcacacttcataaaaacaaatactgatttatgaaccttgagtgacatctccatttagcatatatatatatatgtttgtatgtgtgtgtgaatgtgggaaactgtattgcattctaggtgttactgcctatatgaggaattagttaactagagattaaatggaagatgaaaccccaggtgaactggctgaggctgtgtgaagaagaagcacccccagactttcacccctttgtgcttc

SEQ ID NO: 35326 - DNA, 601 bp, Human
acctagattcacacttcataaaaacaaatactgatttatgaaccttgagtgacatctccatttagcatatatatatatatgtttgtatgtgtgtgtgaatgtgggaaactgtattgcattctaggtgttactgcctatatgaggaattagttaactagagattaaatggaagatgaaaccccaggtgaactggctgaggctgtgtgaagaagaagcacccccagactttcacccctttgtgcttctgacactggggagcccctgcagaccaacctcccatgcatggagcctgggtcctccrctggtggataagtgaaactctcatctctgggggaattggctcatgtgctcctgtgtccctggctgcacagacagcgcacagggctcagtgacttctgtattcccttgcagatcctgagctcccagagtgcaggaaaacgccctccccaaatgcctcaggagtaacattcgaatttctagaatgcaagaaatctgaaataattcaataaggacactggagggaaccctgctacacaggaagggtttattgaggaactccctagaactcatgtcagaagacataggggaagataagaatgca

SEQ ID NO: 35327 - DNA, 601 bp, Human
gaaactgtattgcattctaggtgttactgcctatatgaggaattagttaactagagattaaatggaagatgaaaccccaggtgaactggctgaggctgtgtgaagaagaagcacccccagactttcacccctttgtgcttctgacactggggagcccctgcagaccaacctcccatgcatggagcctgggtcctccgctggtggataagtgaaactctcatctctgggggaattggctcatgtgctcctgtgtccctggctgcacagacagcgcacagggctcagtgacttctgtattccyttgcagatcctgagctcccagagtgcaggaaaacgccctccccaaatgcctcaggagtaacattcgaatttctagaatgcaagaaatctgaaataattcaataaggacactggagggaaccctgctacacaggaagggtttattgaggaactccctagaactcatgtcagaagacataggggaagataagaatgcagagcccaggggagaggctggctcagggctcttcccctctgtttttattctcaggagcagctaacaccctcagcccatcacaaaacaagactggtgagtgaggag

SEQ ID NO: 35328 - DNA, 601 bp, Human
taaatggaagatgaaaccccaggtgaactggctgaggctgtgtgaagaagaagcacccccagactttcacccctttgtgcttctgacactggggagcccctgcagaccaacctcccatgcatggagcctgggtcctccgctggtggataagtgaaactctcatctctgggggaattggctcatgtgctcctgtgtccctggctgcacagacagcgcacagggctcagtgacttctgtattcccttgcagatcctgagctcccagagtgcaggaaaacgccctccccaaatgcctcaggagyaacattcgaatttctagaatgcaagaaatctgaaataattcaataaggacactggagggaaccctgctacacaggaagggtttattgaggaactccctagaactcatgtcagaagacataggggaagataagaatgcagagcccaggggagaggctggctcagggctcttcccctctgtttttattctcaggagcagctaacaccctcagcccatcacaaaacaagactggtgagtgaggagatgctctcgtttacggtgctgggcacaagggttgggtcctgtcaagggtaaggaggtg

SEQ ID NO: 35329 - DNA, 601 bp, Human
atcacaggtgaggagcccagcgggttcagtcagggacccaggctctgcacaggccctgccaggggagcccaggtggtgatggccggaatgagggttgggggtcccaagggagggagagacagagagagacaggggatgggcggggaggggagactcagagaaaacagagacagagagactaagggtcccagggagaggcctggggaggtctcagctcagaacaaggtggggcagcccctcacccatccttcttctctctaggacagttctatgacagaccctctctctcggtgcagccggkccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcaggtgagggccctgatcttgtcctctccgagctcaaagg

SEQ ID NO: 35330 - DNA, 601 bp, Human
aaaccagaacccagggcacaagttcagggtttcctttctgagtttggcggccttgctggcagtggggcttggggactcagcggtactggacagcccgcggtcccagcctagccctggagaagagtttcgaaagctttggggtgagagaggtgggggcgaattggaagcctcgggcatttccctggttctgcctggatgtcctcaaatcctaaggaacaggtggagaccggactggaaatagcctgaggctgggggaagggaggccagtccctgaaggataaactagttgcctgaaaggcaragtgccccggggtggtgtgcgctggtgactggctttgctgagagctggagaggaaggtgaggaaaccggacacggttgaaggctggggctgaaggagtaaacacgaggaggctgggccaacctgcacagctccgtccactcagctccacaaacaagaccataaataaatcccctcagcaaagaagtccgctgcccactccggtgccaggcctaactgcagtgcctggggctgccagccgagggcttgcttggattggggaagcctccgcgttagccaatgactaaaccaagtggccttct

SEQ ID NO: 35331 - DNA, 601 bp, Human
catgagctgtagccaattcctaaggcaagaccaagatgaaatagggggattctggatgtgctaataatttggtggcctcaatattctttaaatattcaaaatgtatttagaagagagaaactcatttttcagaaaattggatgttcaaaacaaagatatacctattttctgaaccagaaaacatgttgagaaggtaaaatattgaacattaatgtaatagggccaggcacagtagctcacacctgtaatcccagcactttaggaacctgaggtggaaggattgcttgaggccaggagttcraggccagcctaggcaacaaagcaagacctcagctctacaaaaatttaaaaaatcagccagggcagttgtgcacacctctagtcccagctatttggaaggctgaggcgggaggatggcttgagcccacgagctggagattacaacaaaaatttaaaaaattagggcagtggtgctcacctgtagtcccagctacttggaaggctgaggcgggaggatggcttgagcccaggagctggaggttacagtgagctatgatggtgccactgcacttcagcctggacaaccctgtctctaaagcta

SEQ ID NO: 35332 - DNA, 601 bp, Human
gttgtgcacacctctagtcccagctatttggaaggctgaggcgggaggatggcttgagcccacgagctggagattacaacaaaaatttaaaaaattagggcagtggtgctcacctgtagtcccagctacttggaaggctgaggcgggaggatggcttgagcccaggagctggaggttacagtgagctatgatggtgccactgcacttcagcctggacaaccctgtctctaaagctaaaatgaaatttatgtaatagaatgaattactccttctcggggaatactatcacatcatgcgacamtgtcatgcaacacttggcttcataatttgggcagattgtaactaatgttccagtttgggatagcatctttgcaatcttcatgtacacattgcagtgagaactcagtgcccttgaggagtctcttttgtatttttatgttcgtgggagtttgccagccacgggcctggagactcaggttaaccagcattgcctttctaatcggttgccgtgatggtttagctccctgatgcgtgaggctgctgcctggctggccacccccatgatctgactttacttgcctcggtggcgttgagggatcta

SEQ ID NO: 35333 - DNA, 601 bp, Human
aaaacaaaaacaaaaaataaacccctaaaaaacttattaataaattatcaggcattgaagagaatcgcagcaaattactcattttgtttaaggacagagaagacacaacagatgttcagtctgcttaaaacttcatagcagttttttccccagcagtcccgtgagaagagttctggtctagctttcaccgtctgctactggttggcctgagggggatgagaacatggcagagtggctgggaggaaggatacctgtgttttagtccaagctctgtcactaattactttttttttttttttttaacctttgcctgtatgctggtttcctggggctgctgtaactgaggaccacatacttggtggcttaagtaacaagaatttattatcttacagttctggaaggtagcagtcccagtccaagatgttggcagggttgattccttctgagggctgggagggagattctgtttcttgcccttctcccagcttctgctggtttgctgacagttgtccccaatctctgccttcatctccacatgaggttctccctatgtgtgcatctgtgtccaaatttctcctttttattttattttttatttatt

SEQ ID NO: 35334 - DNA, 601 bp, Human
actagggctcaccctcttgatctcaccttagcttgatcatctgcaatgactctgttaactaagtaaggtcacatttacaggtactggaggttaggacttcaacattttgggggcgggggggagacataattcaacccataacagacagcctttgtaaattttggtttggaaaattaaagagtttggcgctgttctgagtcatgaatgcgttagaatcgcctggggaaacactccaaaatacacataatatgtccagcacaaaggtggtgattcatgaagtttgaggcagctggagcacgartattttggaaccagttctaagaggattctgatgtgtacccgggtgtgctggaccagcctctgaagccctttccatttgtggaaccctgcggctctctggtagcactgcagctgggcatgagcttctcacgagcctgataactgatggtgaggctttcagggcttggatccacattcagaggtctgggctggggccaccaaacactgcaaaaggctgggggccagaacacagtattcttaccttttagccagccattagtttaccccatgctttttgagccactaggactacaaagttgga

SEQ ID NO: 35335 - DNA, 601 bp, Human
tggaggttaggacttcaacattttgggggcgggggggagacataattcaacccataacagacagcctttgtaaattttggtttggaaaattaaagagtttggcgctgttctgagtcatgaatgcgttagaatcgcctggggaaacactccaaaatacacataatatgtccagcacaaaggtggtgattcatgaagtttgaggcagctggagcacgagtattttggaaccagttctaagaggattctgatgtgtacccgggtgtgctggaccagcctctgaagccctttccatttgtggaamcctgcggctctctggtagcactgcagctgggcatgagcttctcacgagcctgataactgatggtgaggctttcagggcttggatccacattcagaggtctgggctggggccaccaaacactgcaaaaggctgggggccagaacacagtattcttaccttttagccagccattagtttaccccatgctttttgagccactaggactacaaagttggaagacgtccctgtactcagacaggtgttacagctaatgagcgatctatataatagattatgtaataaaatacaatatgtaaaaga

SEQ ID NO: 35336 - DNA, 601 bp, Human
gtgtgtttccaagggccacccatgatgctggtgtgctcacctccaacccagagtggctaagtggcagttgttcatggaaaagtacgtgggtatgcacacagctttgtgtgctgactgaaggtgggggccttttcctctgtgcacacataaggatttgggtgagaagggaagaggggtggactgggggccagggccggctccccgctaccatgttctggtgcctttctggttgtgaatgaaattgctttttttttttttcagggtaggaggttagaacctattttatgtagcagtttgttcrttggacttaccacattgaattatttaggaatgtggtaggttgtcctctatttgtactttttttttttttttttttgagacaaggtctcactcttgtcactcaggctggcatgcagtagcatgatcatggctcactgcagcctcagcctccggtgttcaatcaatcctcccacctcagcctcctgagtagctgggactacaggctcgcaccacccaagcctggctagttttttctattttgtgtagagatggggtttcaccgtgttgcccaggctggtcttgaactgagctcaagcaatct

SEQ ID NO: 35337 - DNA, 601 bp, Human
ccggtgttcaatcaatcctcccacctcagcctcctgagtagctgggactacaggctcgcaccacccaagcctggctagttttttctattttgtgtagagatggggtttcaccgtgttgcccaggctggtcttgaactgagctcaagcaatctgcctgcctcagcctcccacggtactgggattacaggtgtgagctaccacgccagcccatttgcacttttgagcccctgacatgttgggtggcaggactggctttaatgaaggcctgttagagagcagcagagatgtgtgtttgtgggtsggggaggggactttgttactttatgttccctttcaggtcaggcttagacagggaatctaatctatatttggcgtattggccggctgtgccagactaagtgccaagtgttgttcctgggaggctgaaatatttaaaatatttatctctgctagtgaacaactggcctgggttatgtgtgtgtgtctgggtggataaagttggggaagatcattttatttttcattcttagaattaacgatggcaaagagctagctcataaaaaggactggaaatgaggggaagcgtttactgttaaggctg

SEQ ID NO: 35338 - DNA, 601 bp, Human
gctgggattacaggtgctctaccatgcccggctaattttttgtatttagtagagatggggtttcactatgttagtcaggctggttttgaactcctgacctcaggtgatccacccacctcagcctccccaaatgctgggattacaggaatgtgccaccacgcttagcaaattttaaaagtttgatttgttttatgttttttaaatagacatggggtcttgccatgttgctaggctggtctcaaactcctgggcttaagtgatcctcctgcctcggcctcctaaagtgctgggattacaggcrtaagccaccatgcctgggcaacttaaactgcttaagctccatttatgcccacgaagctaataatgctgttcaaagttgttccaaaaattaaatgaaacgactgacacaaagcgggtcataaatgctggggcagtagtcataggtttagggttatactttatataattcccaccggcaagatttaatggatttaccttttagcaagaagtgttccggttgtgagcacaagagaaagctttcagggataaggtggggttcttcagggtcggctaagcagaagtttgtgttaggatggtcctt

SEQ ID NO: 35339 - DNA, 601 bp, Human
aatagcccaaaagtagacacaacccaaatgtctatcagtgggtgaaaggacatacaaaataaggtatatccatacagtggaatattgttcaaccgtaagaaggagtcaaggtctgatacaggctacagcatggatgaaccttgaggacatttcactaagtgaaaaagccagacgcagcccggcgcggtggctcacgcctgtaatcccagaactttgggaggccgagtcgggtggatcacctgaggtcgggagttcgagtccaacctgcccaacatggagaaaccctgtctttactagaaayacaaaattagccgggcgtggtggcgcatgcctgtaatcccagctactcaggaagctgaggcaggaacattgctttaaccccggaggcagaggttgcagttagccacgattgtgccattgcactccagcctgggcaacgagagcgaaactctgtctcagaaaagaaaaggccacacgcaaaggccagagcatctatgatcctatttctaggaaatgtccagaataggcaaatctaagtcataaaatagattagtggcctgaggggctgaggaagtttgagagggagtgtggttaaggggta

SEQ ID NO: 35340 - DNA, 601 bp, Human
ccattgcactccagcctgggcaacgagagcgaaactctgtctcagaaaagaaaaggccacacgcaaaggccagagcatctatgatcctatttctaggaaatgtccagaataggcaaatctaagtcataaaatagattagtggcctgaggggctgaggaagtttgagagggagtgtggttaaggggtatgagactttctttgggagggttatgaaaatattctaaaatctatcatgatggttacagaactctaaatatactaaaaatcattgaattgtgcatgttgaatgggtgaactgtayggtatgtcattatatttcaagaagccattaaaaaaaaacaacagaaagccttgctgcaacatgcctgcacttgctcctgccacattcaggtggttctgagctgaagccacagacaggtctccctgggttagaggtgttccctgctggtcagatcatttatgattggaaaatgacttcaggtcgtactgttttcaaggtctcactggctttttggggttgtcgttactgtgctttaattatgtgtggattttgattagtgaaaaagtggttttggatataaaataattctgactcaatagt

SEQ ID NO: 35341 - DNA, 601 bp, Human
tgatctctgctcactgcagcctccacctcccgggttcaattgattttcctgcctcagcctcctgagtagctgggattacaggtgcgcaacacctagcctggctaaatttttgtatttttagtagagacaaggtttcaccatgttgacctgaaatgatccacccacctcggcctcctaaagtgctgggattataggcatgagccaccatgcccggcctccctccaccttctttaagggagtttttggcaatgtattgttaactggaactgtggctttcattaccaagtgtgatacatcgacytactacacagcccgccaccaaataaaaggcgaattcaaaagggataatgttaaaaacttagtagcagtgagagaaggcaaccaatctcaagttccatatagtatacttagacagaaatgaagtaagataaaaaaagcagagctctggtgggagggagagtgggcttgtgtggattgggctggcacagggcagagctgtgaaccacgaggcccaggcgtgaatgcacagagaaggctggagtaaatatgtgtcatgttaaccatcagctcactctcagtctctgcactgcagccacattgt

SEQ ID NO: 35342 - DNA, 601 bp, Human
ccaaggagctgggattacaggcacctgccaccacgcctggctaatttttatatttttaatagagacagagtttcaccatgttggccaggcttgtctcgaactcctgacctcaggtaatccacctgcctcggcctctcaaagtgctgggattacaggcatgagccaccacacttggctaatttttgtattcttagtagagatggggtttcaccatgttggccaggctggtctcaaactcctgacctcaggtgatctgcccgccttggcttcccaaagtgctaggattacagcatgagccacygtgcctggccaaagtttagataatttaatgaatgaatcccctttacctctgctgttgcatgtgtcttgagcaggtgcactgtgcatttgattagggtagaccgaaaagggttgttgtactgtcccagaataggtgcataaatgggggcagggtctgatgtctgaatgctactgtttatgcctgtcttcttggtttattttggtgcagaatgtagccgtgagttcaggcagtgggcagaatgatctggaaaagatgaccagcatcctggaagctgtgccacaggttaagtttatttgcctg

SEQ ID NO: 35343 - DNA, 601 bp, Human
gtggtctccaggtatgaaattctgtgttccttttttgtcccccagctgcctggtggctttaggacatgcacatcctcgtgttcaggtgtggggttcctcacctttataccagcaatagtagttcatgatcatcagctgtattctttctgtctcaggcagggaacgtggtgacaggagaaatggtagaagagcttattctttccggagcagatatcatcaaagtgggagttggaccaggtaagacttgttaggagcacagcagaggacgtgtgtggggaagaatgggatctggggcttgcgrggactgcagatcactggaggggatgcatgaatgactcattcacagatatttaaagcatgctttttctggaagcataattgagcttctcggggaagcccctgatgaaaagtattgttgagctgctttttgatgcccccagggattttctaaattatggttagaatatatggatgtggtcagaatatgagggcttggtttcagaaccaatgtggaagaatgtagatttcactaatgaccccatacaccttgcagaggaaggcgataggtgaagaatccatagagacagttaataaacatgaa

SEQ ID NO: 35344 - DNA, 601 bp, Human
gaagaaacttgccccattggagaagcagtggggagggaggggagcaggtggagcttgattctgctgatctgggtaaagtggggtgctgtggcggcaccgggaagcttgaataaggggaggtatgataaagaggtcagagtgcgacttggcctggacctaactgggagaacaaccaggactggggctgaccgtgggacaggcaggcaggagggtgctggtgtgagccctggcctggaagtgaacctcgggctaggctgcaagggacttgaggtggggcagccaggagggagatggacaaacrgctgggccctgtggagcacagagctgagtgagagcaggtgagggtatggagggtgtcgtgctgcaggccaggccctgggccaagcggtatccctccctgtgccatttgttctctgccacaaccccaggaggttgtgtttctctttggattttacaggccgggcagtgaggcttaagagaggtgagtcatttgacaaaggttgaaggtaaagaagctacgagccagtgggaggattctgagaggtcctttaaagcagagtgtagatttgtagaaaggtggaaaggagtgggtgtttaagtg

SEQ ID NO: 35345 - DNA, 601 bp, Human
ctgttccccacatctcctctgccacagaggttcaccctggtccctaaagcagggctgcaaaggtaagggggacgcatttcatgtcacagtcttctcatgtataaccatctatttggggacaacttctttctctgtgcaggttctgtgtgcaccacccgcaccaagacgggagtggggtacccccagctgagtgccgtcattgagtgtgccgactctgcccatggcctgaagggccacatcatctctgtgagtctccacccggggctgaggctggggtgtcttgggaggcccctgctccctygctgctcttctttcactggctgggcatcctgtgggcatgggagggagctgggcactgcggtcacagcgctgacattcagcagaaacagaggccctgctgcccacggattccacagtgagggtggcaggcccagtaggcagaagccatacaagcaggtgggtggtccatctgatgagggatgtgcaggcagctttcagagcacagggtaggccaggccacagcttgctagaacagttgtaataaagccccacagactgggggcttcaatttcagtgtctcaccattctggagacgagaagc

SEQ ID NO: 35346 - DNA, 601 bp, Human
ctcctctgccacagaggttcaccctggtccctaaagcagggctgcaaaggtaagggggacgcatttcatgtcacagtcttctcatgtataaccatctatttggggacaacttctttctctgtgcaggttctgtgtgcaccacccgcaccaagacgggagtggggtacccccagctgagtgccgtcattgagtgtgccgactctgcccatggcctgaagggccacatcatctctgtgagtctccacccggggctgaggctggggtgtcttgggaggcccctgctccctcgctgctcttcttycactggctgggcatcctgtgggcatgggagggagctgggcactgcggtcacagcgctgacattcagcagaaacagaggccctgctgcccacggattccacagtgagggtggcaggcccagtaggcagaagccatacaagcaggtgggtggtccatctgatgagggatgtgcaggcagctttcagagcacagggtaggccaggccacagcttgctagaacagttgtaataaagccccacagactgggggcttcaatttcagtgtctcaccattctggagacgagaagcccaacatcagggt

SEQ ID NO: 35347 - DNA, 601 bp, Human
taacagttagggacaatgacatcccaagcctggggcactggtgcaataggaaggtagcacttctgatcttgcttgtgttctctgaggttcttttttttctttttagtttttacttttttattttatttattttttatttttttgagatggagtcttgctgtatcgcccaggctggagtgcagtggcatgatctcagctccctgctagaatgcctcccgggttcaagcgattctcctgcctcagcctcccgagtagctgggattacaggcacgcgccaccacgctcagcccattttttttttgtatttttagtagaggcagggtttcaccatgctggccaggctggtctcgaactcctgacctcatgatccgcccgcctcagcctcccaaagtgctgggattacaggcgtaagccaccgtgcccggcctccgagtttccttttacgtcaatgctgagaggtctcctagatggggttaggagttccatttagctggaaaagcaaatgaatggacttagtagaatttggacctttgccctcagctcagtccttgtaagcagctgagtgtcttgaggttcagagcagccattgcccccacactcc

SEQ ID NO: 35348 - DNA, 601 bp, Human
tggctttcgtgactgtccccgtgtgtctggctgctgctccagcgtactgttgctgtccttttgccccttgaattgcgcccaggctacattaggaatagcaggtagcagcctgggcatttggtgtcttgtgtttgtaagaaaatgcagctagtggctgggcgcggtggtgcacgcctgtaatcccagcactttgggaggccgaggtgggcggatcacctgaggtcaggagctcaagaccagccaggccaacgtggcgaaatcccgtctctactaaaagtacaaaaattagctgggcttggtkgtgggcacttgtaatccagctactcaggaggctgaggcaggagaattgcttgaacccaggaggcagaggttgcagtgagccgagatcacgccattacactccagcctgggcgacaagagtgagactgtctcaaaaaaaaaaaaaaacaaaaaaaaaaaaacagaaaagaaaagaaaattcagctagctctgcatcctagaagacttgtactgtgtagctggagtttaaacattacccccaacagctgaaccttgctgggcagcccaagataacagactggccctgctacacattaaacca

SEQ ID NO: 35349 - DNA, 601 bp, Human
tgagaggtgacagccctcacagccctcgcttgctgtccacgcctcctctgcctgggctcccactttggcagcacttgaggagcccttcagcccgtctctgcactctgggagcccctttctgagctggccaaggccggagccggctccctcagcttgaagggaggtgtggagggagaggcgcgagtggcaaccgaggatgcgcgaggcgcttgcgggccagctggagttccgggtgggtgtgggcttggcaggccctgcactcggagcggccggctggccctgccggcctcaggcaatgagrggcttagcacccgggccagcagctgcggagggtgtgctgggtcctccagcagtgccagcccactggcgctgcgctggatttctggctgggccttagctgcctccctgcggggcagggctcgggacctgccgcccgccatggctgagcttccccgccccctccacgggctcctgtgcggcgggagcctccctaatgagcgccgccccctgctccaaggcccccagtcccgtcaaccatgcaagggctgaggagtgcaggcgcagggcgtgggactggtgggcagctccatctgcagcccca

SEQ ID NO: 35350 - DNA, 601 bp, Human
tccacgggctcctgtgcggcgggagcctccctaatgagcgccgccccctgctccaaggcccccagtcccgtcaaccatgcaagggctgaggagtgcaggcgcagggcgtgggactggtgggcagctccatctgcagccccagtgcggatccactggatgaagccagctgggctcctcagtctggtggggacgtggagaacctttatgtctaactcagggattgtaaatacaccaatgggcactctgtatctagctcaaggtttgtaaacacaccaaccagcatcctgtgtctagctcaggktttgtgaatgcaccaatccacactctgtatctagctaatctggtggggacgtggagaacctttgtgtctagctcagggattgtaaacacaccaatcagcgccctgacaaaacagaccactcactctaccaatcagcaggatatgggtggggccagataagagaataaaagcaggctgccggagccagcagtggcaaacccttctggctccttttctttgggagggtgatttgttgtttcgctctttgcaatagattctgttgctgctcggtctttaggcccacactgcttttatgagctg

SEQ ID NO: 35351 - DNA, 601 bp, Human
ctcaaggtttgtaaacacaccaaccagcatcctgtgtctagctcaggttttgtgaatgcaccaatccacactctgtatctagctaatctggtggggacgtggagaacctttgtgtctagctcagggattgtaaacacaccaatcagcgccctgacaaaacagaccactcactctaccaatcagcaggatatgggtggggccagataagagaataaaagcaggctgccggagccagcagtggcaaacccttctggctccttttctttgggagggtgatttgttgtttcgctctttgcaatarattctgttgctgctcggtctttaggcccacactgcttttatgagctgtgctatttgccgggaaggtctatagcttcatttttgagctagcgcagaccccaaccccaccagaaggaaaaagcctcagccgcgccaccttatagagctgttacactcacagtgagagtctatggcttcattcttgaagtcagtgagaccaagaacccaccagttccgaacacagtagcagttccttagttaataggcaatgaagaatcccactgcacagtgatccatgaacaaaatggggaatgataacttt

SEQ ID NO: 35352 - DNA, 601 bp, Human
aataaaagcaggctgccggagccagcagtggcaaacccttctggctccttttctttgggagggtgatttgttgtttcgctctttgcaatagattctgttgctgctcggtctttaggcccacactgcttttatgagctgtgctatttgccgggaaggtctatagcttcatttttgagctagcgcagaccccaaccccaccagaaggaaaaagcctcagccgcgccaccttatagagctgttacactcacagtgagagtctatggcttcattcttgaagtcagtgagaccaagaacccaccarttccgaacacagtagcagttccttagttaataggcaatgaagaatcccactgcacagtgatccatgaacaaaatggggaatgataactttttttcccacgtttttacttttttgacagctaatcattcagcgtctatcatgtgctgtgcactttggatcaacatagaaccagccctgggcctgttccagcatagcccacaaagacaggcagcttcagtacctctgtctcctgtgcctgtcctggaaatgtgctgtcattcggtgattagtctggcagaatatgtactctggaaatctaat

SEQ ID NO: 35353 - DNA, 601 bp, Human
agccttcagtaggctgcatttgtttctcgcagtgtcccatggccctttctccctgcatggaagccttctccctttttccaggaggagacaggcgagagaggtccagcctttctcttgactatagctgggcggggagggaggtgaactgggcaagcactgggattttttgagagccttttcccctgagctgttttctctgctactcgctttcatccccaccgttggcatttaggagctggagcagattttgtcatgctgggaggaatgttttcgggtcatacggagtgtgctggagaagtgwttgagaggaacggacggaagctcaagctcttctacgggatgagctctgacaccgccatgaacaagcacgcaggaggagttgctgagtacaggtgaggaggtgaccccggggcgcaccctcgaggcctggccttgcttttcttacggagatgggatggaagcaggtctgaatagcagctctgtgtatattaaagtaccgtgggaaggggttctttttaaagacccctaatttgtatccagttagcatttgcagtgtttggggttcccaaaagcaagtacagagcagcagtgtttggtgatg

SEQ ID NO: 35354 - DNA, 601 bp, Human
tccagcctttctcttgactatagctgggcggggagggaggtgaactgggcaagcactgggattttttgagagccttttcccctgagctgttttctctgctactcgctttcatccccaccgttggcatttaggagctggagcagattttgtcatgctgggaggaatgttttcgggtcatacggagtgtgctggagaagtgtttgagaggaacggacggaagctcaagctcttctacgggatgagctctgacaccgccatgaacaagcacgcaggaggagttgctgagtacaggtgaggaggygaccccggggcgcaccctcgaggcctggccttgcttttcttacggagatgggatggaagcaggtctgaatagcagctctgtgtatattaaagtaccgtgggaaggggttctttttaaagacccctaatttgtatccagttagcatttgcagtgtttggggttcccaaaagcaagtacagagcagcagtgtttggtgatgggttggaagtgtgaccagggttatatgtgagtgggtgccagtcctgaagggaatacttcagacctctgggggtaggtggaattattgtcttgtccttccag

SEQ ID NO: 35355 - DNA, 601 bp, Human
aaagcctggaagcctctggtgctaagacaggtcttggttctcctctgattccaccttgcttggacccacacatgtgcagggtgataggtgtagtgacctgtaagagaacagggagtcgaactgggggtggccagtgtacccagcaaagcagaaagacaggcaggctatcaaaacagagccacttcaatgaaatcaccttgctggtgatttccacgtaagctggtaggacctgcgctatccattttatgtcctcctcgtcctggtcgtcccccttgaagacacttgatttctgatcttagascagacaggcgggaggtgaagctctggacttttcctgttgttgacgtaggaggacaggaggctgtttccaggggggaatcggccagggccattctgggggcattttgggctcctggttgttgggaagttggtgtgcatgttgaggtagaatagaaaggtaaaggtggtttctgttagcagcagaggggagcacgttgctggagagaatggcaccaagcagggtgttatgggtccctgactccttcaagcgctgctcaccaggactttcctctccgcaacatgcagggcagccagcaatgag

SEQ ID NO: 35356 - DNA, 601 bp, Human
tgaagctctggacttttcctgttgttgacgtaggaggacaggaggctgtttccaggggggaatcggccagggccattctgggggcattttgggctcctggttgttgggaagttggtgtgcatgttgaggtagaatagaaaggtaaaggtggtttctgttagcagcagaggggagcacgttgctggagagaatggcaccaagcagggtgttatgggtccctgactccttcaagcgctgctcaccaggactttcctctccgcaacatgcagggcagccagcaatgagcccgtgccctttgggmgggaggaatgtgttcatctgagatgctggtgatcatcttggcacttggtagaaatgtggggatggggtcagagggtggggtctggttttctgagtgccttgggggctacagaaagtgctggagctgggagtaattctaattgggctcttaaggtggggcgggaaactagataaaaagaaaacttctatcgtcttccagagcctctgagggtaagactgtggaagttccttacaaaggagatgtggaaaacactatcctggatattctcgggggactgaggtccacgtgcacctacgtggg

SEQ ID NO: 35357 - DNA, 601 bp, Human
gtcagagggtggggtctggttttctgagtgccttgggggctacagaaagtgctggagctgggagtaattctaattgggctcttaaggtggggcgggaaactagataaaaagaaaacttctatcgtcttccagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacacygtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttctcggggcccagacgcaaggcaccgattgggccaacatcagagccctgctgcccagaactcataacctcattgttcaaaccaacacttgcacctttctctttttctctttctctctc

SEQ ID NO: 35358 - DNA, 601 bp, Human; identical to SEQ ID NO: 19113

SEQ ID NO: 35359 - DNA, 601 bp, Human; identical to SEQ ID NO: 19114

SEQ ID NO: 35360 - DNA, 601 bp, Human; identical to SEQ ID NO: 19115

SEQ ID NO: 35361 - DNA, 601 bp, Human; identical to SEQ ID NO: 19116

SEQ ID NO: 35362 - DNA, 601 bp, Human; identical to SEQ ID NO: 19117

SEQ ID NO: 35363 - DNA, 601 bp, Human; identical to SEQ ID NO: 19118

SEQ ID NO: 35364 - DNA, 601 bp, Human; identical to SEQ ID NO: 19119

SEQ ID NO: 35365 - DNA, 601 bp, Human; identical to SEQ ID NO: 19120

SEQ ID NO: 35366 - DNA, 601 bp, Human; identical to SEQ ID NO: 19121

SEQ ID NO: 35367 - DNA, 601 bp, Human; identical to SEQ ID NO: 19122

SEQ ID NO: 35368 - DNA, 601 bp, Human; identical to SEQ ID NO: 19123

SEQ ID NO: 35369 - DNA, 601 bp, Human; identical to SEQ ID NO: 19124

SEQ ID NO: 35370 - DNA, 601 bp, Human; identical to SEQ ID NO: 19125

SEQ ID NO: 35371 - DNA, 601 bp, Human; identical to SEQ ID NO: 19126

SEQ ID NO: 35372 - DNA, 601 bp, Human; identical to SEQ ID NO: 19127

SEQ ID NO: 35373 - DNA, 601 bp, Human; identical to SEQ ID NO: 26391

SEQ ID NO: 35374 - DNA, 601 bp, Human; identical to SEQ ID NO: 26392

SEQ ID NO: 35375 - DNA, 601 bp, Human; identical to SEQ ID NO: 26393

SEQ ID NO: 35376 - DNA, 601 bp, Human; identical to SEQ ID NO: 26394

SEQ ID NO: 35377 - DNA, 601 bp, Human
ccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctct

SEQ ID NO: 35378 - DNA, 601 bp, Human
gagttgggaggagaaaaggataaaagaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagcccygggaatctgtgcctggggaggggagaagtctgttaggctcttggattgtgtggaagaaggagaagttgtgccaggctacagaatcctgtgtttgcactgagaaaacaggatggtacctgaccttctctgcatggctgtgagatagcttaaaataatttcttttgtttttgatgaatatgaacaatatcttaaaatttttgaggctaaaaaagtcttgaagggatccctgaggtattttctttgaaaggtactggtgaaaatgagtaacttaacctaagggtttttctttctaattttatt

SEQ ID NO: 35379 - DNA, 601 bp, Human
ttcatataggctgatcagctgaccgaagaacagattgctggtaagttgacaactccaaggagtccccagaaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtaaaactaaggatgcccacatgttaaactctggagaatttgaccatgtttcacaatgtgcaaagtttgcrtatgattaattgtactgagcctgctactcagcggtttagtttacaattcttatgccatgggtctttcagtaatctgccacgaaagcttgtgctcgctatcctaaaataaatggaaatgggtgaatatgagtgttaggaccactgtagtaattgggaagaaagttacattagttaaactctgttgcccaggctggtctctaactcctgggctcaagcaatcctcctgcctcagcctcctgagtagctgggactacaggcatgtgccaccacgtctggcagattttagctttttaatattcc

SEQ ID NO: 35380 - DNA, 601 bp, Human
acaccattcctactgttaaagttttcacttaagagcataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctcgaacgaagtgtgtttattaagaacagttcttatgtcattcttaaggtaggtagggttaatactctccagcaaatttagtagatactstttgccagaaaagagaggagtatatatagtttgataattattgtgtagttttctgtgtacttaatttttgcagttttgtaacacttcatttgtaagatggtaccattttttcctggcttctgaatcataggatagtttgacccagggcattagccattgtaatggtagccttttaacaaataactgcctaatttaaaggattggaaagcatttgttacatggaaatgaagttggtggcgtacccagttgctgtatctttattttttctacttaattatttctcataaaatggatataaaa

SEQ ID NO: 35381 - DNA, 601 bp, Human
ggcgaacccgggggcgggaccaggcgggcaaggcccggctgccgcagcgccgctctgcgcgaggcggctccgccgcggcggagggatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgytccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcg

SEQ ID NO: 35382 - DNA, 601 bp, Human
ttcttatgttagacagctccccaaccacctaaagagccttggttttctattcaatcaaataatgaggcactaaaaggtagtcagattctctttgtgtaagtcagggcagggtttgttgagtgagtagctcactgaataattgagtgtggactcagctctttcctgggagatcctcagatataaaatcatgttaactttatcactgagatgatttgtttccctatagaggaattcttcaatcccctatttgagggtagatggtggggcagggcttgggggcaggaaaaattatagtaaatamctataaatagtaaagttggttattgttgttgcatataaaacatttaaatccttggctagaaaatagtaagttttcaataattatttgatgtcattataatatgtgaaatgggatgaataatagtatctaactcatagaggaatttcaaggattcaaagagttaattcacataaatcacttacatgtacctagaatcataataattgctaatatatgtggagtgcttgtcatgtgcagatacatttctaagagatttgcatgaattaaatcattgaatcctcacaacttctccatgaatta

SEQ ID NO: 35383 - DNA, 601 bp, Human
agatgacgagttagtgggtgcagcgcaccagcatggcacatgtatacatatgtaactaacctgcatattgtgcacatgtaccctaaaacttaaagtataataataataataaaaaaaagaaagggagtgactattgagtagatagcatggggttggatttccagagataactaacatttctgaatagcataagggatgtatgggttttggaagttggttaccaacgggaaatgtacgtattttggcaataccacttgattaacgacaaaacactatttttcttcctggtctacaatgatartcaccccaaaagaataaacttacaagaagtcaaaggaagaaatactccaattgtgtcatatacaggcaattctatgtctctgcttctttagctgatgaaatcttttgcctgtcaggtagtacttatcactgtccaggatgccaagatatttctctaccagacttgcttttgttcccacttcctcacataactatttcataactcccctgtctccttaccactcctgcaatctctcccagaccattcgttctgagccaatgacctcacttcataatgtatagagaaaatagaaactgccag

SEQ ID NO: 35384 - DNA, 601 bp, Human
agataactaacatttctgaatagcataagggatgtatgggttttggaagttggttaccaacgggaaatgtacgtattttggcaataccacttgattaacgacaaaacactatttttcttcctggtctacaatgatagtcaccccaaaagaataaacttacaagaagtcaaaggaagaaatactccaattgtgtcatatacaggcaattctatgtctctgcttctttagctgatgaaatcttttgcctgtcaggtagtacttatcactgtccaggatgccaagatatttctctaccagactkgcttttgttcccacttcctcacataactatttcataactcccctgtctccttaccactcctgcaatctctcccagaccattcgttctgagccaatgacctcacttcataatgtatagagaaaatagaaactgccagatactcattttttaccctctaactttgcaaacataactgcatttgtgcatcatctccttcttccatcttattgcaaaaacctcctcttatcaaaaaccactccctctgcttaaccctggatcccattcttttctctgttataaatattgtgatttcaggaatca

SEQ ID NO: 35385 - DNA, 601 bp, Human
cctcacttcataatgtatagagaaaatagaaactgccagatactcattttttaccctctaactttgcaaacataactgcatttgtgcatcatctccttcttccatcttattgcaaaaacctcctcttatcaaaaaccactccctctgcttaaccctggatcccattcttttctctgttataaatattgtgatttcaggaatcagcttctctttcctatttctcttaaaacttccatgtttgttccttctttcttataacaactctgtttccctctgaatctctatcctgttcctctctctycatctctgtctatgccccatttttctgtgcagcgtctctgcctctctattactcattatagtcctcacactcttatgatacttttacaacctcactgtcaattcagaaaatttcactgtctttgagaaaaatttaaggtaatcttctatggcccacttccacatttctagccaggtcatatcgtagattgttagccatcatattgattcactatatttgggtacctgcctatggtccctgtggtggaaaatgtggagtgtggcccctaaggcaccatgagccatgcacaggtcaggtcca

SEQ ID NO: 35386 - DNA, 601 bp, Human
tagccatcatattgattcactatatttgggtacctgcctatggtccctgtggtggaaaatgtggagtgtggcccctaaggcaccatgagccatgcacaggtcaggtccattttatttcattcattcatatgaaagaggcacagctaaagtacttttcctttgtgcaatgaattctctaaggacaggctatatggaatattgaattcttgtccaacaaagatgaagatgagatataagaagtgtctatgggggtggggtccaaagatgcaagccatggggaaaaatttcccacgtcaatgcmtaagtccaagttctgtgttgggtggaaaggcctgtacttcactagagattgatccagaattattaaaaatgggtgtcctgacccctaaacaccctgtgaccaagcagataacctcatgctttatttagtccaacttcctacagaatctgtcatcatcagaggctgtcacattttctgtgattttaaaaaagcatctgtgagcatatggagaagctagtgcaaagggcttaattgtaaagtaacgttccatgaaatggggtctgtttttatggtgccagaaccattttctcccagaagaac

SEQ ID NO: 35387 - DNA, 601 bp, Human
tatttcattcattcatatgaaagaggcacagctaaagtacttttcctttgtgcaatgaattctctaaggacaggctatatggaatattgaattcttgtccaacaaagatgaagatgagatataagaagtgtctatgggggtggggtccaaagatgcaagccatggggaaaaatttcccacgtcaatgcataagtccaagttctgtgttgggtggaaaggcctgtacttcactagagattgatccagaattattaaaaatgggtgtcctgacccctaaacaccctgtgaccaagcagataamctcatgctttatttagtccaacttcctacagaatctgtcatcatcagaggctgtcacattttctgtgattttaaaaaagcatctgtgagcatatggagaagctagtgcaaagggcttaattgtaaagtaacgttccatgaaatggggtctgtttttatggtgccagaaccattttctcccagaagaactgcaattcacgaattatagaataggcataggattcatgtccccatgtggaatggtgactaagtgtctccagctataaatgtctgtgctatggaagccagaaagagtaaattt

SEQ ID NO: 35388 - DNA, 601 bp, Human
ttcttaagtgttttcttgggtaaaaattcactcaactagaaaatcaaactttctaggagtatctagcccaagcaataaagacttcaacatacagaagcagctcatttctctttttcctcctttctagatgctgtattatgtaaaagacatcccagctaccctgaaattcttccatagtctcttaggtaccaatgctaagatgctcattattgttgtgtcaggtaagttattttcattcagcctgaattttaaaacagcaataatacacgtatgcatggattcctgtgtttgaaagaagcttatatattttgtcttcattatgaaattcttgccttggcctctaatcatagccaattaattttcacagtattagggaagtcattcacaacagttctcaatttagaaggtatagtggaattaaacatctgtctacttctttcttttgggaaaatatgcctttgtcttctatatatgaatcctttttatatagcttaaattcaactgacaaaagattttaaatgagactaaaaatagtaaacatttattttacctacttcgtgtcatttgagtgtttcttttccctctatgatgtttattaata

SEQ ID NO: 35389 - DNA, 601 bp, Human
ctaccctgaaattcttccatagtctcttaggtaccaatgctaagatgctcattattgttgtgtcaggtaagttattttcattcagcctgaattttaaaacagcaataatacacgtatgcatggattcctgtgtttgaaagaagcttatatattttgtcttcattatgaaattcttgccttggcctctaatcatagccaattaattttcacagtattagggaagtcattcacaacagttctcaatttagaaggtatagtggaattaaacatctgtctacttctttcttttgggaaaatatgyctttgtcttctatatatgaatcctttttatatagcttaaattcaactgacaaaagattttaaatgagactaaaaatagtaaacatttattttacctacttcgtgtcatttgagtgtttcttttccctctatgatgtttattaataaataaaggttaaactatttcagatgtcatcatttttaattgacttgcattcttagagccatgatcaacactgcttgctataggttttttcaaatgcctatcaaaaacagttcatttgttttgttttgtgttggtgttttattttccaaggaggca

SEQ ID NO: 35390 - DNA, 601 bp, Human
acaatcagttagctttttttgaaaagtatttttagtcaaaaattatttaaccaaagtatttgatgatggaaatgttttactcactttctcaatatgcagttaacaattcttcattactgcttatagcacaggagacagctgttccaaagaggaaaacattgttaatagaatgcaacgaataacatttgacagatgattaaagagattctgatgatctccttcctttaccatatcacttcttctgagaagagatttacacagctatagccatctatttcttcctaaaagaaaaaccacttcrcaaaagtagaagaaagatttcgatattttatttggggctttctacgtctctctctcctaagcctaagaatgtcttggctttttttgcctctatttgtcagaatgctaagaaaataaataaattaaatataagttaattttttttaaaacctacttttcccaataatgaatactttgcagtgaaaaataattctacctgaaaagagaaatagaattgtgaaatatgttgatcattgtcatcaatttagtagaactggaatgtccccagattctccaatcctatcggcatgtcatacttaac

SEQ ID NO: 35391 - DNA, 601 bp, Human
caaagaggaaaacattgttaatagaatgcaacgaataacatttgacagatgattaaagagattctgatgatctccttcctttaccatatcacttcttctgagaagagatttacacagctatagccatctatttcttcctaaaagaaaaaccacttcacaaaagtagaagaaagatttcgatattttatttggggctttctacgtctctctctcctaagcctaagaatgtcttggctttttttgcctctatttgtcagaatgctaagaaaataaataaattaaatataagttaatttttttwaaaacctacttttcccaataatgaatactttgcagtgaaaaataattctacctgaaaagagaaatagaattgtgaaatatgttgatcattgtcatcaatttagtagaactggaatgtccccagattctccaatcctatcggcatgtcatacttaactcttaaagatccagagtaaatgatggagttctcatttcaagtaacttgggtaatccatcccctcatcatcactcctttactcctgagggttcctgggggtcagacttaaatgttcctggtgattgccatccactgtgtgctcca

SEQ ID NO: 35392 - DNA, 601 bp, Human
tcttcctaaaagaaaaaccacttcacaaaagtagaagaaagatttcgatattttatttggggctttctacgtctctctctcctaagcctaagaatgtcttggctttttttgcctctatttgtcagaatgctaagaaaataaataaattaaatataagttaattttttttaaaacctacttttcccaataatgaatactttgcagtgaaaaataattctacctgaaaagagaaatagaattgtgaaatatgttgatcattgtcatcaatttagtagaactggaatgtccccagattctccartcctatcggcatgtcatacttaactcttaaagatccagagtaaatgatggagttctcatttcaagtaacttgggtaatccatcccctcatcatcactcctttactcctgagggttcctgggggtcagacttaaatgttcctggtgattgccatccactgtgtgctccaagttcaacttttgatttcttctccccaaatcttgcatgtgctgcagccgccctttctcatcttgtttcacattgccttaaacatggacatagtcctacctccttccttctccaaaacaccattcttgctttt

SEQ ID NO: 35393 - DNA, 601 bp, Human
agaagaaagatttcgatattttatttggggctttctacgtctctctctcctaagcctaagaatgtcttggctttttttgcctctatttgtcagaatgctaagaaaataaataaattaaatataagttaattttttttaaaacctacttttcccaataatgaatactttgcagtgaaaaataattctacctgaaaagagaaatagaattgtgaaatatgttgatcattgtcatcaatttagtagaactggaatgtccccagattctccaatcctatcggcatgtcatacttaactcttaaasatccagagtaaatgatggagttctcatttcaagtaacttgggtaatccatcccctcatcatcactcctttactcctgagggttcctgggggtcagacttaaatgttcctggtgattgccatccactgtgtgctccaagttcaacttttgatttcttctccccaaatcttgcatgtgctgcagccgccctttctcatcttgtttcacattgccttaaacatggacatagtcctacctccttccttctccaaaacaccattcttgcttttgacagattttgggacctgtgggggagaaagag

SEQ ID NO: 35394 - DNA, 601 bp, Human
gttaattttttttaaaacctacttttcccaataatgaatactttgcagtgaaaaataattctacctgaaaagagaaatagaattgtgaaatatgttgatcattgtcatcaatttagtagaactggaatgtccccagattctccaatcctatcggcatgtcatacttaactcttaaagatccagagtaaatgatggagttctcatttcaagtaacttgggtaatccatcccctcatcatcactcctttactcctgagggttcctgggggtcagacttaaatgttcctggtgattgccatccrctgtgtgctccaagttcaacttttgatttcttctccccaaatcttgcatgtgctgcagccgccctttctcatcttgtttcacattgccttaaacatggacatagtcctacctccttccttctccaaaacaccattcttgcttttgacagattttgggacctgtgggggagaaagaggaacaaagaacagaatttagcattaaggtcccaccgtgactctttttctcacctttctcttgctcaatctggacacacttccgttgaacctgctctcataacttctctcagtcttccctcatat

SEQ ID NO: 35395 - DNA, 601 bp, Human
ttgctcaatctggacacacttccgttgaacctgctctcataacttctctcagtcttccctcatatcctcttagttcagtgctaagatgccacctcctcattttctattgcaaccctcttttttaacttttattttaagttcaggggtacatctgaaggtttgtcacataggtaaacgtgtccggggggttgttaaacagattatttcatcacccaggtattaaacccactacccaataataatcttttctgctcctctttctccccccaccctccatcctcaagtagacctcaatgtctgytgtttccttctttgtgttcatcagttctcatcatttagctcccacttataattgagaacatgcggtatttggttttctgtttctgcattagttttttaggccaatagcttctggctccatccatgtccccagaaaagacatgatctctttattttttatggctgcatagtattccatagtgtatatgtattacattttctttaaccactctgtcactgaagggtttttaggttgattccatgtctttgctattgtgaataatcctgcaatgaacatttatgtgcatgtgtctttatgaca

SEQ ID NO: 35396 - DNA, 601 bp, Human
aattgagaacatgcggtatttggttttctgtttctgcattagttttttaggccaatagcttctggctccatccatgtccccagaaaagacatgatctctttattttttatggctgcatagtattccatagtgtatatgtattacattttctttaaccactctgtcactgaagggtttttaggttgattccatgtctttgctattgtgaataatcctgcaatgaacatttatgtgcatgtgtctttatgacagaatgattaatattcctctgggtatatacccagtaataggtttccaaacyatactataggggggtacaataaccaaacagcatggtactggtacaaaaacaagcacatagaccaatgaaacagaatagagagaccagaaataaggccgcacacctacgaccatctgatctttgacaaagctgacaaaaacaagcaatggggaaaagacttcctattcaataaatggtggtgggataactggctagccatatgcagaagactgaagccagtctccttccttatactatatacaaaaatcaactcaatgtggcttaaagactacctaaaactataaaaacctggaagacaac

SEQ ID NO: 35397 - DNA, 601 bp, Human
catgtctttgctattgtgaataatcctgcaatgaacatttatgtgcatgtgtctttatgacagaatgattaatattcctctgggtatatacccagtaataggtttccaaactatactataggggggtacaataaccaaacagcatggtactggtacaaaaacaagcacatagaccaatgaaacagaatagagagaccagaaataaggccgcacacctacgaccatctgatctttgacaaagctgacaaaaacaagcaatggggaaaagacttcctattcaataaatggtggtgggataackggctagccatatgcagaagactgaagccagtctccttccttatactatatacaaaaatcaactcaatgtggcttaaagactacctaaaactataaaaacctggaagacaacctaggcaataccatcctgcacataggaacaggcaaagattctgtgacaaagacactaaaatcaataaaaacattggcaaatggcatctcattaaacttaagagcttctgtacagcaaaagaaactatcaatagaataaacagacaacctacggaatggtagaaaatatttgcatagtatgcatttgaca

SEQ ID NO: 35398 - DNA, 601 bp, Human
cctacggaatggtagaaaatatttgcatagtatgcatttgacaaaggtctaatatccatcatctataaggaacttaaatttacaagagagaaacaaccccattaaaacgtgggcaaaggacatgaataaacaattctcaaaagaagacagagatgtggccaagaagcatttgaaaaaaagctcaacatcactgatcattagtgaaatgaaaatcaaaaccacaatgagataccatctcataccagtcagaatgactatttattaaaaagacaaaaaataacagatgctgatgaggttgtgsagtaaaaggaacacatacattgttggtgagaatgtaaagtagttcaaccactgtggaaagcagtatggcaatttcttagagagctaaaagcagaactaccagttgacccagcaaccctcttatagagtagtttaaatcccttttgttctatttctatcacctagataaacctgtgcacacatgaacttgtcttaacaacaacacatttccctgagataaattgttttgcccccctcagtgtatgatgagggtgatggtagtttcctattttaaaaaaatagcaatagttgctttgttgta

SEQ ID NO: 35399 - DNA, 601 bp, Human
ggacatgaataaacaattctcaaaagaagacagagatgtggccaagaagcatttgaaaaaaagctcaacatcactgatcattagtgaaatgaaaatcaaaaccacaatgagataccatctcataccagtcagaatgactatttattaaaaagacaaaaaataacagatgctgatgaggttgtggagtaaaaggaacacatacattgttggtgagaatgtaaagtagttcaaccactgtggaaagcagtatggcaatttcttagagagctaaaagcagaactaccagttgacccagcaaccytcttatagagtagtttaaatcccttttgttctatttctatcacctagataaacctgtgcacacatgaacttgtcttaacaacaacacatttccctgagataaattgttttgcccccctcagtgtatgatgagggtgatggtagtttcctattttaaaaaaatagcaatagttgctttgttgtattaacatacccaatagaaatatattggtcagcttttggaaaaatagatcaagtctagtttccaacattggaaacaaatttgatcacaagaaatttccaatcagacattttcatattg

SEQ ID NO: 35400 - DNA, 601 bp, Human
aagaagcatttgaaaaaaagctcaacatcactgatcattagtgaaatgaaaatcaaaaccacaatgagataccatctcataccagtcagaatgactatttattaaaaagacaaaaaataacagatgctgatgaggttgtggagtaaaaggaacacatacattgttggtgagaatgtaaagtagttcaaccactgtggaaagcagtatggcaatttcttagagagctaaaagcagaactaccagttgacccagcaaccctcttatagagtagtttaaatcccttttgttctatttctatcamctagataaacctgtgcacacatgaacttgtcttaacaacaacacatttccctgagataaattgttttgcccccctcagtgtatgatgagggtgatggtagtttcctattttaaaaaaatagcaatagttgctttgttgtattaacatacccaatagaaatatattggtcagcttttggaaaaatagatcaagtctagtttccaacattggaaacaaatttgatcacaagaaatttccaatcagacattttcatattgatgtcagtgaacacacataggaatgatccacaaaattactact

SEQ ID NO: 35401 - DNA, 601 bp, Human
tcagaatgactatttattaaaaagacaaaaaataacagatgctgatgaggttgtggagtaaaaggaacacatacattgttggtgagaatgtaaagtagttcaaccactgtggaaagcagtatggcaatttcttagagagctaaaagcagaactaccagttgacccagcaaccctcttatagagtagtttaaatcccttttgttctatttctatcacctagataaacctgtgcacacatgaacttgtcttaacaacaacacatttccctgagataaattgttttgcccccctcagtgtatgrtgagggtgatggtagtttcctattttaaaaaaatagcaatagttgctttgttgtattaacatacccaatagaaatatattggtcagcttttggaaaaatagatcaagtctagtttccaacattggaaacaaatttgatcacaagaaatttccaatcagacattttcatattgatgtcagtgaacacacataggaatgatccacaaaattactactcattgttttctttcaatgatgtagcttcaaatccctatctgctagactagtcagtggaaagaaaacaagtttgagaaacctcatc

SEQ ID NO: 35402 - DNA, 601 bp, Human
aagaaatttccaatcagacattttcatattgatgtcagtgaacacacataggaatgatccacaaaattactactcattgttttctttcaatgatgtagcttcaaatccctatctgctagactagtcagtggaaagaaaacaagtttgagaaacctcatcagccgaggtgttccatctacatccctccttacccctgtttaggaaccattgcctagcttgccttctccaccagagctataattctttaaaccccatttttcatttactcaacagattgaaacatttcctaaagttgaatatkgacccagaacttggaatgtctataccacattggtttacactaagttctgtttttattaagattctttgggtcactttcttaatggaatttgcttcataattacctaaaagggaagatgcttctgtgtatgttcatttgtttcagggtaatattgtcatccatagctgctctccaatgcacaaaactgagtactcatggtatatagggaggcatatagggacattcatctctgttcctacatctttgtaaagactttggcacagagacaatacttagtaaatatgttttaattgaactgaa

SEQ ID NO: 35403 - DNA, 601 bp, Human
aagaaatttgatttggggataaaaaagaagagatataagaacaagagagttggatttctttaaaaaatgtggagtatcccacactaaaatggtatcaaagaaaagtttttttctgcaaatgtgatagccaagcatcaattgggagggttgctgtttaaaaggcagcctgtctggttaagggagatgagccagaaggagatcactgaagctttctgtctgtcctctccttacctgagtaaggaaggaggaaaatcattgtgtgttatttttagtgcagtgagaaaaagaaaatctggcttayatcatgttgaaaacaaaagtaacaccatatgttgtgcccaccgagagccattatgataatgcattagtcgggaagtgcataattgctcagctcagaaatggcaccgagtcacagcactgacaccagcaaattttttgcaattagtgtttggttcttttttctctgccaggttaaaaataataataatgatgataacagagcctctcttcaaccactgaaatgctgattttcttgtaatgtcttgtttgccggcaaactcttatttaggaagacaatccactgtctttggaataaaagatt

SEQ ID NO: 35404 - DNA, 601 bp, Human
catggttctaagggtctttactttattaactcagtgaatccttgtagcagtctataaatggattatattatcacccctgttttacagatgataaaactgagacacaggttcataaagttggtaagaaggaaagccaggcttcatactcaggcagttgggttttagagaccatgctctttattactgccctgtactgactgtgtatgtaatatgcatgtattagaaggcccataaatagaaactcattattattattatagatttctgaatagcaggcttgcttttttagtctcaagaatgyaatcagtggaaatacactagcaaactaattcatgtattttataagcacttattacacatctttcatgtgcgtaccattacgcaataattcacttaaattatctcatgtaatgcttgtagttgcattcaaggtaagtttgataatccccattttacagatgaggaaatttaagttctgagaggctagataacaagcctcatctcattcataaagcatcagaagaagagttcagctcatgtctgtctccctcagataaggtattccgtagcttctctgcagggttagaatttcagtttagta

SEQ ID NO: 35405 - DNA, 601 bp, Human
tttttagtctcaagaatgcaatcagtggaaatacactagcaaactaattcatgtattttataagcacttattacacatctttcatgtgcgtaccattacgcaataattcacttaaattatctcatgtaatgcttgtagttgcattcaaggtaagtttgataatccccattttacagatgaggaaatttaagttctgagaggctagataacaagcctcatctcattcataaagcatcagaagaagagttcagctcatgtctgtctccctcagataaggtattccgtagcttctctgcagggytagaatttcagtttagtactacaaacattgctaaaaggtcttctaaacttggggacaagatttatagaaatccacctagttattgtcagtccaaggcagcatctttttttatatagagatgagagtaaaaaatcattgatttgagtaaatcaccatttactgtgctctttctttccattttaattttcactgttaaagattcttgtctgaattccagactaacaactaccttcctcatatcaccacctgaatgtccagtaggtatctcaaatttatattcctgaaaccagaggcctgatg

SEQ ID NO: 35406 - DNA, 601 bp, Human
tgagaggctagataacaagcctcatctcattcataaagcatcagaagaagagttcagctcatgtctgtctccctcagataaggtattccgtagcttctctgcagggttagaatttcagtttagtactacaaacattgctaaaaggtcttctaaacttggggacaagatttatagaaatccacctagttattgtcagtccaaggcagcatctttttttatatagagatgagagtaaaaaatcattgatttgagtaaatcaccatttactgtgctctttctttccattttaattttcactgtyaaagattcttgtctgaattccagactaacaactaccttcctcatatcaccacctgaatgtccagtaggtatctcaaatttatattcctgaaaccagaggcctgatgatacaaaactgctcgtcttcattcttctctccaacaatggcaattctgtcttctcaggcgccctcacagaaattactggggtcatcactgattctttctttttacccatatcctacatccaaattgttggcgagccctgttggatctcggagtataacacataaaaactcccaccacttctcttcacctcccag

SEQ ID NO: 35407 - DNA, 601 bp, Human
tatatagagatgagagtaaaaaatcattgatttgagtaaatcaccatttactgtgctctttctttccattttaattttcactgttaaagattcttgtctgaattccagactaacaactaccttcctcatatcaccacctgaatgtccagtaggtatctcaaatttatattcctgaaaccagaggcctgatgatacaaaactgctcgtcttcattcttctctccaacaatggcaattctgtcttctcaggcgccctcacagaaattactggggtcatcactgattctttctttttacccatrtcctacatccaaattgttggcgagccctgttggatctcggagtataacacataaaaactcccaccacttctcttcacctcccagctcactggtctgtgggacccacccccacctatcccccaggtgattacagtagccttctcgctgttctccccacctctgcccttatgcgccagtactctcttcccatcggtgaggccagggtgaccttattaaatgtatattgagtcattctaatgtgctgttccatacagaaaccatgttttagtagtgaagttgaaactgaaattaatttaaatg

SEQ ID NO: 35408 - DNA, 601 bp, Human
atatagagatgagagtaaaaaatcattgatttgagtaaatcaccatttactgtgctctttctttccattttaattttcactgttaaagattcttgtctgaattccagactaacaactaccttcctcatatcaccacctgaatgtccagtaggtatctcaaatttatattcctgaaaccagaggcctgatgatacaaaactgctcgtcttcattcttctctccaacaatggcaattctgtcttctcaggcgccctcacagaaattactggggtcatcactgattctttctttttacccatawcctacatccaaattgttggcgagccctgttggatctcggagtataacacataaaaactcccaccacttctcttcacctcccagctcactggtctgtgggacccacccccacctatcccccaggtgattacagtagccttctcgctgttctccccacctctgcccttatgcgccagtactctcttcccatcggtgaggccagggtgaccttattaaatgtatattgagtcattctaatgtgctgttccatacagaaaccatgttttagtagtgaagttgaaactgaaattaatttaaatga

SEQ ID NO: 35409 - DNA, 601 bp, Human
acaatcctgctggacaatgcagatatcgaacgtgtccattggttcagaaaattctatcagacagcattacagtggtttcccattgggccccaagtgatctgggcccttcatccactccccacccctaatctctccaacctcatctcttttccctctgccctcactcattcagctccaatttcactggcttcctggctagttctttaatgggccaagtatcatcctgtattcaggtcctttgcagctgctcatctctctcctggagtcatcttccccctgatatctccatgtcttgctgtcrggtctctgctcaaatgtcaggttattagacagactctgcgaccaccctagttaaaacagcagcccatcaaagtctttaaccctcttagcatttactcagattactttttcatttagcatttatcaccatatatttacttatttttctctctcctcctgtactccttgaaatatgagctgcacaaaggacaagattattattttgttctattctaagcatctagtgtactttctggcagactgcaaatgaaagaaagaataaatgaaagcatgacttgtgttttattgcacaggaagcagt

SEQ ID NO: 35410 - DNA, 601 bp, Human
ttcagctccaatttcactggcttcctggctagttctttaatgggccaagtatcatcctgtattcaggtcctttgcagctgctcatctctctcctggagtcatcttccccctgatatctccatgtcttgctgtcaggtctctgctcaaatgtcaggttattagacagactctgcgaccaccctagttaaaacagcagcccatcaaagtctttaaccctcttagcatttactcagattactttttcatttagcatttatcaccatatatttacttatttttctctctcctcctgtactccttraaatatgagctgcacaaaggacaagattattattttgttctattctaagcatctagtgtactttctggcagactgcaaatgaaagaaagaataaatgaaagcatgacttgtgttttattgcacaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatgg

SEQ ID NO: 35411 - DNA, 601 bp, Human
taagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttrtttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtg

SEQ ID NO: 35412 - DNA, 601 bp, Human
tacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacawgcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaatt

SEQ ID NO: 35413 - DNA, 601 bp, Human
ttggaaatttcactttcagaatcaagtccgtcgagagattaagtttactgtccaggcattgccatggataagtattcttactgttgcactgttcttgctggagataagaggttacagcaaattacatgatgacctaggagagtttccatatggtaagtaaataacacgagtgtcaggaagagagtagtctaagcacaggttagtttccttaaaaaaacaagtctgcccttttttttttcatcttttaaaataattacaaattattcagttgttttttaatgttctattttcatgtgttcaygtcttgccacatgtgcatttctttagtttttctatcaatctgaaagtctgctgtagatgagattgtgtctggcggaagattggagtgatcagagatgggtccttgcatttgttttctattaattattgaattcaaccttctaaaaaaaacttgagtagcttatgtcattgctgaaagttaaaaacagatttttaaaatgcattattctgcttcttagaaactgtaactcttctggcatacaaccacccacttttctgtgcctgtatacttcattgtttacattacacaaatgaagtcctg

SEQ ID NO: 35414 - DNA, 601 bp, Human
cttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggygacagagcgagactccgtctcaaaaaaaaaaaagaaaaaaaaagtcagttattcagaagaaggaacaaaaaattatatactagagtaatgaattggctgggctttgaaaaatggatatgattatgagttaaaataaagggagagaggacattttaggttcttgaacccctatgatgaaagatacagaggtaaaacttccaagacagtgggaggacattgagtaaacctgcctggttagagtagaaatacaggagtgatgaggttggaaagatccgaaaggggtggagtatggaataaatg

SEQ ID NO: 35415 - DNA, 601 bp, Human
tcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatmtccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaat

SEQ ID NO: 35416 - DNA, 601 bp, Human
gatcgaggcttcttcatggccgctcagatcgtgagcggccggggctgctctctttgcggaggatggcgtctaatgagcgcagttgattcgaggtgggcgctggggcacgtctcccttttggcatactgtttgaggggtactgaggtgaaagggcggtcactgttcgggtcgtttttacacagcggttgtgcgcccgtccctgccagtcttaatgtcttcatctcctggacacgtagaatagtgggccgggatctccctgactttgctggcgatgcggctgggccttttgtagggcggccgyagtgacccccgagaagggggttgctgggaggagaagggaagagggaatttggcacgcgcagctctgctgcctttgattccaccgccgccattttgtggccgcagagcgcccgcccgctgctgttggcgcaggcgcggtcgaggcgtcgcgagattctggcttccacccgctgtgacgcgcccgcgaggccgccattgggctggctttgcggagggcgcgggcggctccgcccgcacttctcggcctttcctaactgcggcagatgggagggggccggagagcccggagagtgtgcggctg

SEQ ID NO: 35417 - DNA, 601 bp, Human
tctgctggcatatttttctaagtagatttatgtagcttaagtgtgtaacggagatttttcttccctttttgtagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccarttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtat

SEQ ID NO: 35418 - DNA, 601 bp, Human
gtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgttttttgaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgat

SEQ ID NO: 35419 - DNA, 601 bp, Human
ccttcctccacaaaggggtcctggaggtgcacgttctcgcagccttccatagcttgccccaattcaacaggcaattcaaaaacctaggtgctgttgaaaggaacgcctccctaagcctgatgtccctgggatggacacagctggtcgccgtctatcctaccttggcctgcaggggccggggccctcctagaggcgtccccgcccccatccactccgaacagccgaaaaccgtctctaagtcacctttctgactccccttccgctgctccagctagatccaggaggtgagtcaaccaccccygcccactctggcatcctcagatcgcctctacgcccgcaagagcaacaaggacccccgggaacccacctaagatcgtcatctctctggccatcacagtcccgccgaacaggcttgtgatgactgtaccagacgtgaggcaccgcccccactcctcccggcagtcccgcagccccctgggaaatgtagtccgcttgctctgaggcaatcggagaagctatcgctctgaccaaagcaaggacttcatctaccgtgagggcgcggggcaaagagcctccattcaaccgctgccagtgacgactg

SEQ ID NO: 35420 - DNA, 601 bp, Human
acatttcagaagcatttcatcaccttggagacgcggggtgggtgtgtgtgtgggtgggggataggtaattccaaacccgatgtgatggaaaaagcctccaaattcagcatccctgagccgacagatccggatgtagctcctcccccttcctccacaaaggggtcctggaggtgcacgttctcgcagccttccatagcttgccccaattcaacaggcaattcaaaaacctaggtgctgttgaaaggaacgcctccctaagcctgatgtccctgggatggacacagctggtcgccgtctatcmtaccttggcctgcaggggccggggccctcctagaggcgtccccgcccccatccactccgaacagccgaaaaccgtctctaagtcacctttctgactccccttccgctgctccagctagatccaggaggtgagtcaaccacccctgcccactctggcatcctcagatcgcctctacgcccgcaagagcaacaaggacccccgggaacccacctaagatcgtcatctctctggccatcacagtcccgccgaacaggcttgtgatgactgtaccagacgtgaggcaccgcccccactcctccc

SEQ ID NO: 35421 - DNA, 601 bp, Human
ctttccacttccagctacaggcaacatttcagaagcatttcatcaccttggagacgcggggtgggtgtgtgtgtgggtgggggataggtaattccaaacccgatgtgatggaaaaagcctccaaattcagcatccctgagccgacagatccggatgtagctcctcccccttcctccacaaaggggtcctggaggtgcacgttctcgcagccttccatagcttgccccaattcaacaggcaattcaaaaacctaggtgctgttgaaaggaacgcctccctaagcctgatgtccctgggatgracacagctggtcgccgtctatcctaccttggcctgcaggggccggggccctcctagaggcgtccccgcccccatccactccgaacagccgaaaaccgtctctaagtcacctttctgactccccttccgctgctccagctagatccaggaggtgagtcaaccacccctgcccactctggcatcctcagatcgcctctacgcccgcaagagcaacaaggacccccgggaacccacctaagatcgtcatctctctggccatcacagtcccgccgaacaggcttgtgatgactgtaccagacgt

SEQ ID NO: 35422 - DNA, 601 bp, Human
aaacataagcgaagaaagatgcccctttagtttttaatgaatctcgtatttggtatcaggaggctgtgttatacacctgtgtccgctcatattacatatgacccaaaacatgaattttcagggctctgtgttactaattgttagctcatcctcatcaacacataactcaaagaaataaaaccaagtgcgaatcccactttccacttccagctacaggcaacatttcagaagcatttcatcaccttggagacgcggggtgggtgtgtgtgtgggtgggggataggtaattccaaacccgatktgatggaaaaagcctccaaattcagcatccctgagccgacagatccggatgtagctcctcccccttcctccacaaaggggtcctggaggtgcacgttctcgcagccttccatagcttgccccaattcaacaggcaattcaaaaacctaggtgctgttgaaaggaacgcctccctaagcctgatgtccctgggatggacacagctggtcgccgtctatcctaccttggcctgcaggggccggggccctcctagaggcgtccccgcccccatccactccgaacagccgaaaaccgtctctaa

SEQ ID NO: 35423 - DNA, 601 bp, Human
cttcaattgttgaatttctctgttttagatcaaattctgctggtacagaaatgacagcattggcaactggcattccaagatatgcctctgccatttcctttaacttcaacaatagtcgagagccaacatattctggggacactgtgatggtctcattacttgtcacagaaaactcaaccattccatttttgtttaaaacctgtgaataggatttgcaaataagtaaataaataaaagagtaaaagcatacagacatacatatatacataaatactagatttcatgagaacttacccttatytttacaaaatcaaaaaatgcatttgaaatctatctagtacatttaccaagattagaacttgttaaatgttatacattaaaatctgtacaatgaatccatattagttttactttttttttttttgagatggagtcttgctctgttgcccacgctggagtgcggtggcatgatctcggctcaccacaacctccgcctcctgggttcaagcgattctcctgcctcagcttcccaagtggctgggagtacagatgcgtgccaccatgcctggttaatttttgtatttttagtagagacagggtt

SEQ ID NO: 35424 - DNA, 601 bp, Human
tggaatatatgagcgataaaaatttaatcattatgccgaggtgggcggatcacgaggtcaggagatcaagagaccctcctggctaacacggtgaaaccccgtctctactaaaaatataaaaaatgagccgggcgtggtggcgggcgcccgtagtcccagctactagggaggctgaggcgggagaatggcgtgaacccgggaggcggagcttgcagtgagccgagatcgcgccactgtactccagcctgggcagcagagtgagactccgtctcaaaaaataaaaaaaaataaaaaatttaakcattatatactatcactaagtgctatggaaattaaagaggcttatgttgagcaggtaaaagatcaggtttctttgaatgaaattcctgctttaaactaaatgccatacttatgagcggtatgcaaagtagtatggcattatgtatcaggagctatgacaacattcaaactctaaagaattattccagagatcataacacccttcacttcagctctctgattttaccacttattctactctggccacactgaccaacttcctatcctctatgtaccagcaaattcccagcttatggctgtt

SEQ ID NO: 35425 - DNA, 601 bp, Human
ctcgtgatccacccgcctcggcctcccaaagtgctgggattacaggcgtgagccactgcgcccagcctctccctgcatttttcttaccagacattgctcgggttagaaacatccctccttgtttattcagtaaagacacatctagagttcctccgcccaagtctatcaccaagacgtggaagacgtcagccttgtggagaccataggccatagctgctgctgtgggttcatttattaccctcaaaatcttcagtcctgtaagattggttaagggaagaaaaattcatgagaggatgcgatmaagtaatctcttcccacttacagcatgtttgtgtcttctgtgacatgaactccaccactgagtaataatgagagcagtcacaaaccgaacagaagcatgaaatgggaacagtaaacataggctcttctaaatgctatctttaaaattattctgaaagattacaatataaagaaataaaatccaaggttcagtgcaataagtcattctactctttattaattaacacttaattttcaaaaagtctcccagccttttctaacattcatattctactttggaatatatgagcgataaaaattt

SEQ ID NO: 35426 - DNA, 601 bp, Human
catatgtttgatagatctgtttatataagtactgaagcaatctctgattgaagtcctgtcctccaagtttattgtttcctgagtgaaaaataaaagtttaatatagttatgcatatatgtgtgtatgtatacacgtatgttattatgtatacgtaaaaattatattctgggaataacaaatccctgtttcatgtatcattacaattttattcatacagagactggttaaaaataactgtgttgctgggcatggtgtctcacacctgtaatcctagaactttggaaggctgaggtgggaggrttgcttgaggccaggagttggagaccagactgggtaacatagcaagaccctgcctctataaaataaatcaataaataaaaatttaaaaaataatgactgggttaaagctatcttaacccaaataagtactatttaaaaactagtgcacatcagggtcaaaattttaaattatataaaaggaagtatctcttcacaatatcaaataatttttcagtaaatagagattaagaatacagattggcttataagtagctatttaaaaacactgaatgtcattctcaacagaagaaagtgcttctt

SEQ ID NO: 35427 - DNA, 601 bp, Human
aaaatctccgtaaaacggaaccaaaaccatttagtagctcaattccatgctatattccccagggcttactgaaaatataaacaaagaaacaaatacagtaggtaattgatgctatttgccaatgtttgcaaaggtctcggataacaaaaataagatagcaatcatggctttattatgacattaacacattcttcaaatgcaattaccaattttattctctaaccaaacagaataatggaaatccaagcagagaatgatgtacaggacataaaggaactagaatataattgggtatttctaytatatggtgctgaaacatttgaatacctttagaaataaaataaattcatctattaaacacataaaactcctggagaatgcagattacaagaatatgacacttaacaggatactgaatttgtgaatgtaaatttgttatataatatggcagttactgaatattacgtatgcagcttatgctaataatactgctatcttccaaccactgtaaatacctgacatcaacacggtccttcaagtatagttcaaattattagttacatgtgataatacaagtaattaccagctcctgctaatacaa

SEQ ID NO: 35428 - DNA, 601 bp, Human
aagaactccttggacttatatgtgaaaaaatgttcacttgctgagtagcagatcacataatattgaaaagatcatatgtgaaaaacatcacataattttgaaaaattatcttgcacataatacgtaaatattcagtcttccaccacaccatacgtacatttatatttataatgataggcattaatcacagaaacttctattaagaaaaggcactcgcataagcaccttgacttcctgcagtggtccagtgtcttgtccttacactggaggactcacagtttccccagcttctaccttcagkgaaactgtatactgcttctggacctttattatttgcacgatcatgcccgtgctgttgtttacgacacatactagcaatgagccattcagcctatttatttattcagggcccaaaatctgaacaataacaacttaaaaaaacttattgtaacccaagcaagatgaagactagaatcagaaaaggccttatcagacaagtaatacatactggtttaattaaataccctggagtgtggtggccttatacataaggtctagccaacattcattcgttcctattccaagaccctgcttatcaacg

SEQ ID NO: 35429 - DNA, 601 bp, Human
atttagggaatggagctccccaaaatcaaatgaatacctcatgacacgtgaaaatgatatgaaattaacatgactgtgtccataaataattgtacttactcatacttcacgctacaatagcagagttgagtagtttcaacagactagatggcctaaaaaaaacccaacacagtcatgcactacaaaatgatgtttgggtcaatgaaggaccacatagatgacagtgctcccataagattataatggagctgaaaaattcaagattcacctagtgacactgtagctgttgtaaggtcaatasattactcacatgtttgtggtgatgctggtgtaaacaaacctgctgtgttgccagtttaacacatacagttatgtatggtacataaaacttgataacaataataaacgactatgttactggtttatgtatttactatactttttatactatattattttagagtgtgctccttctacttactaaataaaaaagttaactgcaaaatggcctcaggcaggtccttcaggaggtattacagaaggcactgttattatggagatgacagctccatgtatgttactgctcctgaaaaccttccag

SEQ ID NO: 35430 - DNA, 601 bp, Human
taattttcacatttttaaatggctgtggtcttcatcacagtgccttacggagcggagatccctaaaatcaaatgaatacctaatgatatttagggaatggagctccccaaaatcaaatgaatacctcatgacacgtgaaaatgatatgaaattaacatgactgtgtccataaataattgtacttactcatacttcacgctacaatagcagagttgagtagtttcaacagactagatggcctaaaaaaaacccaacacagtcatgcactacaaaatgatgtttgggtcaatgaaggaccacmtagatgacagtgctcccataagattataatggagctgaaaaattcaagattcacctagtgacactgtagctgttgtaaggtcaatacattactcacatgtttgtggtgatgctggtgtaaacaaacctgctgtgttgccagtttaacacatacagttatgtatggtacataaaacttgataacaataataaacgactatgttactggtttatgtatttactatactttttatactatattattttagagtgtgctccttctacttactaaataaaaaagttaactgcaaaatggcctcag

SEQ ID NO: 35431 - DNA, 601 bp, Human
acagcttcacggccaaatctagcctgccacccatttctgtacaacacttgcaccaacaataattttcacatttttaaatggctgtggtcttcatcacagtgccttacggagcggagatccctaaaatcaaatgaatacctaatgatatttagggaatggagctccccaaaatcaaatgaatacctcatgacacgtgaaaatgatatgaaattaacatgactgtgtccataaataattgtacttactcatacttcacgctacaatagcagagttgagtagtttcaacagactagatggcctaaaaaaaacccaacacagtcatgcactacaaaatgatgtttgggtcaatgaaggaccacatagatgacagtgctcccataagattataatggagctgaaaaattcaagattcacctagtgacactgtagctgttgtaaggtcaatacattactcacatgtttgtggtgatgctggtgtaaacaaacctgctgtgttgccagtttaacacatacagttatgtatggtacataaaacttgataacaataataaacgactatgttactggtttatgtatttactatactttttatactatatta

SEQ ID NO: 35432 - DNA, 601 bp, Human
aactgaggcagaatataagcctcagggcaataccccgttttcttcacaggcactcctgaggcataagaaataaaagatatataaataagcaaaaatatcctaagaatttgaacttatactggtaaaagtaaaagatacttgttctttgagttaaaaattccaatcaataacctacaccaggaattggcaaactacagcttcacggccaaatctagcctgccacccatttctgtacaacacttgcaccaacaataattttcacatttttaaatggctgtggtcttcatcacagtgccttacrgagcggagatccctaaaatcaaatgaatacctaatgatatttagggaatggagctccccaaaatcaaatgaatacctcatgacacgtgaaaatgatatgaaattaacatgactgtgtccataaataattgtacttactcatacttcacgctacaatagcagagttgagtagtttcaacagactagatggcctaaaaaaaacccaacacagtcatgcactacaaaatgatgtttgggtcaatgaaggaccacatagatgacagtgctcccataagattataatggagctgaaaaattcaag

SEQ ID NO: 35433 - DNA, 601 bp, Human
acttcagccccaccccaaaagttgactggctggcactgtcccctcagatgtgaagaaaacctgctcagacctcattcagtggcataccagcaccatctccaactacttcaaggaatgattactaaagcagagtcaaacaaaatttcattttagttcacataaacatgagaaagcaatctagcagttttaggaatatactgggccatatcaaaggatacacataagtatatggtgttaatggctaatatattgggaaagactggtctcgtgaattaatacaactttgagcttttaaaaaagmtttttctgcatttaaagcatgttatagctaaggaggctttttttgcataaatacttagaaaaaggaaaaaaattactccaaatatttctacaaaagaagcttcttagaagaaaatgactctaggtagacgttgaaggaaatcagaaataaatatttagaaagatttcagtgatatacaacaaagagattagaagaggttttcaggtaagcttactgtaccaatggaattaggcaggagattgaaagtaaaaggatgtaaaacagatgacaagtaatactgaatgcaaaatagagggactt

SEQ ID NO: 35434 - DNA, 601 bp, Human
acactggagagccagctagctcttttgagccgagtcctcctccccctccaaatacaacaccctggtaaaaaaaactacagttctgggaacctcacaggtgacctcccctgaggaatgctcagacaaggggaagaggctaactcacataaaacagcaaacccctatgatttacagtggaagaaatacctacctacttatggtaggattacagtacctagcacagtgccttgtcggtagaaaatgtttaataataaatgcatggctgcttttttagcctgacgttcaacccttttgtaccaarggaataaaaaataggtaacctgatacttgcccacctgtcagggaattttctgtccttaacaaagatgaaggcaaaataatgatgaactctatcatctttttctaaaagccatgacagaccattacccttatgtttacatttgccttcaacactgccatccgctacaaatttttccctagtgttataatttctaccttcattattttacaactgtttattatttagactgtatgctttttaataatatatgggaaaacattattttcattagtaagatgactccaaattatagagaggatg

SEQ ID NO: 35435 - DNA, 601 bp, Human
ttaaaaagattcacaaacttccaaattgtggtaagagtatcgtggactcacctctgaacactggagagccagctagctcttttgagccgagtcctcctccccctccaaatacaacaccctggtaaaaaaaactacagttctgggaacctcacaggtgacctcccctgaggaatgctcagacaaggggaagaggctaactcacataaaacagcaaacccctatgatttacagtggaagaaatacctacctacttatggtaggattacagtacctagcacagtgccttgtcggtagaaaatgyttaataataaatgcatggctgcttttttagcctgacgttcaacccttttgtaccaaaggaataaaaaataggtaacctgatacttgcccacctgtcagggaattttctgtccttaacaaagatgaaggcaaaataatgatgaactctatcatctttttctaaaagccatgacagaccattacccttatgtttacatttgccttcaacactgccatccgctacaaatttttccctagtgttataatttctaccttcattattttacaactgtttattatttagactgtatgctttttaata

SEQ ID NO: 35436 - DNA, 601 bp, Human
aggacctcaggaaagagggcgtaattgtaggaatgtggcttattgtattgaaatgagcctggggttccactaggcacgtctgcctgtcgtcgctgacatgccggtttacacttttcccttaggaggtaaatcgggtgtaattggcgactcccgcacactgacacgtgtggggacggtgtccctctcctctggacgttggctcggtgtgggaaaggcatgctttttcacggacagaactcgcgcttttggagaagttgctccgagtgttttactcttagtagaaatgaaagttctcggtggygagacgagagcggtcatgcgagcgcagcctgcggagactgacttccaaaggcacctctccaacctgttggaagcctcggggcagtggtgaggaagaacgcatttgtcccttgatttccaaaaacgttcttggagattgccttttatttatttatgcgtccggattctccagagggaagagctgcgaggagttagtaatcagaaatgtcgggctgtgatcccagggccttgtggtgctgggagagaagaacagggagccgtcattccatcgcgagtccagtgccggatctccttttcccac

SEQ ID NO: 35437 - DNA, 601 bp, Human
tggacttcaaactagtgagtgtatttttaaggccctgcttgttaaagaaaggcttgaactggcctctcctcatcactgcttcttccaacaggccctcatcaccttttttcaagtcaagatttcatcccatacatgcatgactcaatcagatttggaaatgtgggtaagagaaagatgtcaaaggaaatgtgaagtattcacttctctattagtcacaccttttacaccatagactccaaagaggcgttaagcacctggttttcctttggctcagaaaaaccaaccaccaaaaaccgccgttttttaccatttatatttagccataaagaaagaaaaataattagataaatcatccactacatccaataattctcagcgccttctcactcagttcagcctctctgaacaatagtaagcaccctggataccagccactttgggggcaacatagtcaaactggcagagaaatcaagtctattgagaaactgctttttttcatgggtactaattctagtgtcataaggaaatacctatactaacttgcctattatgatagttataaactgttatcacaaaacagtcactgatatgttttattagt

SEQ ID NO: 35438 - DNA, 601 bp, Human
catccactacatccaataattctcagcgccttctcactcagttcagcctctctgaacaatagtaagcaccctggataccagccactttgggggcaacatagtcaaactggcagagaaatcaagtctattgagaaactgctttttttcatgggtactaattctagtgtcataaggaaatacctatactaacttgcctattatgatagttataaactgttatcacaaaacagtcactgatatgttttattagttagaattgggatatatatatgtgtgtgtgtgtgtgtgtgtgtgtgtgtggatatatatatatatgggtgggtgttttgttgcagctgctgatctttttctttgcagatggtacaaactctcccgagtcaatttcctgggcctatgtccccacctagctgactgaagttatcaacaggggtccagtttgtgcaggctgctagccctattggaagagtggggatgaggtgggagaaagcaaccacaacgtgtgtgggcaacctcaattggcactcataaaatgttagaatgtcaactctctcccttggccactaaatctctcacagggtagtttttcttgcctaactcaggt

SEQ ID NO: 35439 - DNA, 601 bp, Human
atccactacatccaataattctcagcgccttctcactcagttcagcctctctgaacaatagtaagcaccctggataccagccactttgggggcaacatagtcaaactggcagagaaatcaagtctattgagaaactgctttttttcatgggtactaattctagtgtcataaggaaatacctatactaacttgcctattatgatagttataaactgttatcacaaaacagtcactgatatgttttattagttagaattgggatatatatatgtgtgtgtgtgtgtgtgtgtgtgtgtgtgtrtatatatatatatgggtgggtgttttgttgcagctgctgatctttttctttgcagatggtacaaactctcccgagtcaatttcctgggcctatgtccccacctagctgactgaagttatcaacaggggtccagtttgtgcaggctgctagccctattggaagagtggggatgaggtgggagaaagcaaccacaacgtgtgtgggcaacctcaattggcactcataaaatgttagaatgtcaactctctcccttggccactaaatctctcacagggtagtttttcttgcctaactcaggtt

SEQ ID NO: 35440 - DNA, 601 bp, Human
tcgaattatacgaattgcactgtcgcttttcacattgtaattaaaatacatcttgtcaggtcctacctctttccagaaactatcagttgactatcttgtattatattttctcagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaaggtatggatataatgctttttacccagtttgcttatacatattatcagaaatcagtgraaaaaagctaatatttacattgggatggtgaatttttctagttcctttttcctttcaacattttatttttatcatatatatctacattttaaaataactgaggactatttattctaatttctcaaaattaacagaggacttgtatacatacatctttgttctatttaagaaggagacttttagggctaattcattaccaaatgtaaatatcggtggcttttatgctgcttgtttcaactctcatgaaatcattgtgtgaatattattccaaacttattaccacttttaaatggttggtct

SEQ ID NO: 35441 - DNA, 601 bp, Human
cttgtttcaactctcatgaaatcattgtgtgaatattattccaaacttattaccacttttaaatggttggtctcattaatgattgctcaactgtaatgtgtttttattcctttttgcgatttatggtcgttcattccataatctttgaagattgttttctttgtctcttttggcatcagttgtccgtacagatagtctgaaagggaggagaggtcgtctgccttccaaaccaaagagcccattacaacaggaaccttctcagccctctccaccttctcctccaatctgcatgatgaatgcycttgtccgagctttaacagactcaacacccagagatcttgattattccagagtaagttttatgatttcctgctttcaaatgaatgatcagggtctctatttatggctactagtaataagagttgattgaatgattttgtgtctggcaccatgttagacagttttcatactttttctatatttctcgcttcatttagcaattcagtgcatccattgcagcaaataatttttgccttattgaatctctaaatgccttaacaagtgaccctgacagtgctgcacctgtcatacacattgttgc

SEQ ID NO: 35442 - DNA, 601 bp, Human
ataagctatttcctgggagcaagtgtttgctttggaacattgtatttacctcgtgggtttctgtttaacaagttactattctagcacacctgatggggccctaaagagttcccacaccttctcaacccccagttttattccaagagaacactcttagatagaaagatttagtccatcctatcatactcagtgacgccaaacacaaaaaggaaaagtgatttttcaaaaacatagaaccttggatctaagctcctctagtaagttccacatgtagattttttaaagtttattttattattgkttttattcacaaatagcctgtttaactccatcttccttgcttcctttcagttatatatttttaggagatgataccaactttttaccaaatattatcagaaaaatccatctttcccctctttctctttcctgccatcacctccccaatttcatatcactaccagaaactcctgtttaatttttaaagtgcagattgccaggcctcattgccatctattttggtttggtagactgtggaagtccagaaatctgcatttttaacatatgctttaatgattctgatgtcatcagggtccatgtt

SEQ ID NO: 35443 - DNA, 601 bp, Human
gaatgagatgatgatggacataatataaactatcaggacagatttagaaatagccctctgcagccccaatgttaaaagcagagaaggtaatacaaaataaggacttgttttatgttaggccaccctttaatttgtgatagacttctggcacttacagggacttgatttttgttttgttttgttttgagacagagtcccactctgtcacccaggctggagtgcagtggcacgatcttggctcactgcaacctccgcctcccaggttcaagtgatcctcctgcctcaagctcctgagtagctrggactacaggtgcacaccaccaagcctggctaatttttgtatttttagtagagattgggtttcactatgttgcccaagctggtctcaaactcctgacctcagatgatccacccgccttggcctcccaaagtgctgggcttgcaggcgtgaggcatcgcacctggccagggacttggtatttttaaagtgtgcacaatggaattgtagtgtctagcctcaggccttggcagtttttaacatttaagaaaatcaaggacaagccctgtctcaggatccctggagggaacagtctcatgttca

SEQ ID NO: 35444 - DNA, 601 bp, Human
ttacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaaraaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaa

SEQ ID NO: 35445 - DNA, 601 bp, Human
atggagataagatccccctttttctgcctccagggactgatgagatgcttgtcaggtgattctggtgatattgatgtgcaggcctgaagcactgtgtgagcctcgcacagcagtcacagtcgtaaaactagcaggaatgctcaagtaactaagacacaaaatcctgattttttttttttttaaattcatggtcattccctgaaacaaaccatcataaaaggagattcatagagggaagaatctgtgtgtccatctgtttccttaatggaccatttggagcagagtctgagaagagcatgcrgaggattgtgaccgggacctgtcctggctaatgggtccccagacctgagggtgggcacagtttctgaccaagagtctgatgagacaagaaacagtttctcttctctttgcaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcag

SEQ ID NO: 35446 - DNA, 601 bp, Human
ttctgaccaagagtctgatgagacaagaaacagtttctcttctctttgcaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgagggtaagcaactctgtagccagctggacccccactctgcctcggagaatmctgcccctagggagccaaaggccaggagagaaacttctcagccaggtaaccacgtgatcatcattgtgagatcgtctgcacgtctcccgctgcacttgcagctcaggctgtgtttgaaaacagcctgagacttgaaagcagctgtcccttgacccaagactcctgctaagagccagcacggtgccctctaactccacctcaggactccatcgagtgggtcctgagcgcccactcgagctttgcccatggcttatgtcccctctgtgattttgataaacacagctccaagggagtgtcatt

SEQ ID NO: 35447 - DNA, 601 bp, Human
tttcagtgttttttctttttctttcttttttcttttttttttttttttttttgagatggggtttcactcttgtccaggctggactgcagtagtacgatcttggctcactgcaacctctgcctcctgggttcaagcgattctcctgcctcagccttgcgagtagctgagattacaggcgcgtgccaccacccccggctaattttttgtatttttagtagaaacggggtttcaccatgttagctgggctggtctctaactcctgacctcaggtgatctgcctgccttggcctcccaaagtgcwgggattacaggtgtgagctaccccatgcttcctttttgataggaaaacctttttgaaggagagctagcacctttcttgggagggatgaccccattgccctgacctgttggtgcaccacgttcccagtcctccaacccattttctcctccagccacctctgtgaggctgcccagttggcattttgacactccagcttttgtgatggttttgagttttcctttctcgatttctaacaatttattttattatttttttgagatggagtctcactctgtcgcccaggctggagtgcaatgatgt

SEQ ID NO: 35448 - DNA, 601 bp, Human
ctcactgcaacctccgcctcctgggttcaagcgattctcctgcctcagcctcctgagtagctaggattacaggtgcgcaccaccacgcccagctaatttttgtatttttagtagaggcagagtttcacagtgttggtcaggctggtctcaaactcctgaccttgtgatctgcccacctcggcctcccaaagtgctgggattacacgtgtgagccaccgcgcctgaccgatttctaacagtttttttgaactgagtagaaatcactgtgaagaagatcacatgtgaaggtctggtctccactttttgctgctaataagagactaagatctcctttaaacggcttcctccctgtctgagtggagtggtggtgtcatgagggtgcaggtagattttaatcgtaactcaaaaactcccaaccttcttctggacgctcttccacagtcaggcccggaggcatggtttgctttgtgcccacgaggtcttggaatggtaccagcatgcaattatggtagatctatttcatgtttttcagagtattggatgcatatcttctccctacccaaaactgcctttctaaatttgacaatgaaaagatgatcca

SEQ ID NO: 35449 - DNA, 601 bp, Human
tgtaaaaattgaacaaatatgtaaatatatgggtttggaacaaaacttggttaaacccattaccttagaaaatgggaagatttgggaagtcatgactataatttaagctggtagacaataaaaaatccattaatgtgaagacacaacagttgcagtttcaggaggtgtgggccccactgcatccacctcgctaacacacccagggtccccccagcatctggacgtggaaataccattaatgtaatgaggtccagtctagcagcaccagacacacacccaggggtgctgatgtgattgatcrtcagaaagaatccgtgtggggcggggccccagctgtgatgtgagacttacactaaagtcaccaaccacaggaaaaggaaatgttgggtgagaaataataattatgatttaaatacatattcactatcattaattctataggtaacaataataagctagggcctgtcattgggtgaggacttactttgagctgtgcagagtcttttacattcatgatttcatttcatcctctcagtctgcagagtgcttttctacagttccccattttaggaacaaggatacagaggcttggagctgttag

SEQ ID NO: 35450 - DNA, 601 bp, Human
ttaaaataccatatttgggctgtaattgtatcaactcactaggatgacactggtcatcttccacggatgaagaactcattgacaattataaatggttttctttgcgtggttgcttagtaaatgcccttttttggtgcagtcttttaaagcgtgatgcagtgggagaaaacttaacccatgtagtccttgtggaggaaaagattaggaactattggtctacacagctgagtcctctcctggctgtccaagagaccctgacagagtgcagttgttttagattcagaagtctcagtgactcttyggtggtcacccagttgccctgtgtcctttaacacagctctgttagtccctccttcccactctgacagaggggaaagtgccctccttggaagcctcagctgttctttaacggcaggcgccgtctctgtcacactgcagacacttagaagggtgacggtggggaagctgggagcagcctccctgtctctttccctggactcttttcttctcccctaatataatgtcacttaggttaaaagttccagaaatactagccatgagcaggaatatatctgatcatgctcctttacatttgtgttac

SEQ ID NO: 35451 - DNA, 601 bp, Human
cactgcagacacttagaagggtgacggtggggaagctgggagcagcctccctgtctctttccctggactcttttcttctcccctaatataatgtcacttaggttaaaagttccagaaatactagccatgagcaggaatatatctgatcatgctcctttacatttgtgttacccatcgaagggtttttatcttaaagtatttcattttagcctacaaaatataagcactttgagctccacttggaagataagtcaataggcaaggagatatcaggcgagttggcttccctgatcctagcaayggagacctggactcagtggcatccttctggcttctgcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagaatatgatgtgccacttggtgtggtgacatcacccttcctggcctgccagctgtgtgt

SEQ ID NO: 35452 - DNA, 601 bp, Human
tatcttaaagtatttcattttagcctacaaaatataagcactttgagctccacttggaagataagtcaataggcaaggagatatcaggcgagttggcttccctgatcctagcaatggagacctggactcagtggcatccttctggcttctgcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgascctcttcagctaggagcagccacacacgttagcaaggaccatctcctccagttgagaatatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccag

SEQ ID NO: 35453 - DNA, 601 bp, Human
agataagtcaataggcaaggagatatcaggcgagttggcttccctgatcctagcaatggagacctggactcagtggcatccttctggcttctgcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagartatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggc

SEQ ID NO: 35454 - DNA, 601 bp, Human
gcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagaatatgatgtgccacttggtgtggtgacatcacccttcctggcctgccagctgtgtgtggcatggtgtgaaaatagggctgaaattggatgtgrtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggcgtgttctgaagcagcatctccaggcgtctgccactcatctgggattgatggggaggagtgcgggccttctgaaaccaggcatctcacaaatg

SEQ ID NO: 35455 - DNA, 601 bp, Human
agcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagaatatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaarttttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggcgtgttctgaagcagcatctccaggcgtctgccactcatctgggattgatggggaggagtgcgggccttctgaaaccaggcatctcacaaatgcaaacactaatgtgggtgtcagagtaccccacttttgcaccgtcagttgctcct

SEQ ID NO: 35456 - DNA, 601 bp, Human
accatctcctccagttgagaatatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgacygtgattgcaacaagcagggcgtgttctgaagcagcatctccaggcgtctgccactcatctgggattgatggggaggagtgcgggccttctgaaaccaggcatctcacaaatgcaaacactaatgtgggtgtcagagtaccccacttttgcaccgtcagttgctccttctgaagggaggaatggggacacaggacagtgggaagggacttccttttggcaggtagcagagaaggcagatgagtgagctccgtgacctaaaactcacccagattcagccaccagaagagctgaggttccaag

SEQ ID NO: 35457 - DNA, 601 bp, Human
aggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggcgtgttctgaagcagcatctccaggcgtctgccactcatctgggattgatggggaggagtgcgggccttctgaaaccaggcatctcacaaatgcaaacactaatgtgggtgtcagagwaccccacttttgcaccgtcagttgctccttctgaagggaggaatggggacacaggacagtgggaagggacttccttttggcaggtagcagagaaggcagatgagtgagctccgtgacctaaaactcacccagattcagccaccagaagagctgaggttccaagtgggacactttagtgaggcgagctggttaccagagccgggcactcgcccggggccacaggcccctggaaaaactctgcggtggtctgttgctcgtttggtgtgtcctgggtgccctgtgctgtactggagtgtgctt

SEQ ID NO: 35458 - DNA, 601 bp, Human
taatgtgggtgtcagagtaccccacttttgcaccgtcagttgctccttctgaagggaggaatggggacacaggacagtgggaagggacttccttttggcaggtagcagagaaggcagatgagtgagctccgtgacctaaaactcacccagattcagccaccagaagagctgaggttccaagtgggacactttagtgaggcgagctggttaccagagccgggcactcgcccggggccacaggcccctggaaaaactctgcggtggtctgttgctcgtttggtgtgtcctgggtgccctgtgytgtactggagtgtgcttagagatttctgttacatcatttagggcatgtaatgccttggaaatcgtaatgataccttagaagaggcagctgattcactattattttctcaacttaaacagcttataatagaacagtaaaatgatagtcccagagttttatacttggaaagtgatagatagatctggaagagaccctaaatatcaccctgtccatccctgtctccttcctcctcctctctctctctctctcttttttttttttttttttttgaggcagtctcactctgttacccaggttgga

SEQ ID NO: 35459 - DNA, 601 bp, Human
cccaggttggagtgcagtggtgcgatcttggctcactgcaacctgtgcctcctgggttccagtgattcttctgccttagcctcccaagtagctggaactacaggtatgtgcccggctaattttagtatttttagtagagatggggttggccaggttgttcttgaattcctgacctcaaatgatccgccagcctcagcttcccaaagtgctgggattataggtgtgagccactgtgccctgtcctgcttctcatttttaaggtgaggaggcgattaagactttacaaattaatgcttctgtsttaagttggggcagaccctggggttcaggcttggtgtgagagttggaaacacactttctctactcatctttattcaggatgcaacagggctttctggcctttaatcacaaaactgtcttcgatttcatgagctggccatgctgagtagaaggatatgtttgcctcaccaagggagatttagagattcctgaaagattgtccacgtgtttaagtagttgaggttattcagccatttgcaggttttatgaaagtcctccaggaaatagctcattttaaagctgatatttttttgacgatgcc

SEQ ID NO: 35460 - DNA, 601 bp, Human
tctttgagtttgaaaatagatttggaccagccctgaagacactggtagaaccctgggaaaggctccaggtgacttacaaagcttctcttaaccagcagcgctgaaggaacaatatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtcyggccacacttgggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggatt

SEQ ID NO: 35461 - DNA, 601 bp, Human
tgaaaatagatttggaccagccctgaagacactggtagaaccctgggaaaggctccaggtgacttacaaagcttctcttaaccagcagcgctgaaggaacaatatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtctggccacactygggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggattacagaaactc

SEQ ID NO: 35462 - DNA, 601 bp, Human
agctcccaccctgcctggctcagatcttcccatttttttcctctggcactaacctcaccttttgtttttttgtgtttgtgtttgtttttgtttttgcagagttggattacagaaactcctatgaaattgaatatatggagaaaattggctcctccttacctgtaagttcgtctgcctcgggccacttaggggactcgctttcctgccttcaggggcctcctcccctgtgcagagtgtctctgggagctcagaccccaaatcgagtgttttctgtgtacacagcttcccgggtgcacagcartgatggactggggctggggggttgaggtttgtactcaatccacttcgtttgacattttcagggagaaaatgatagaatacaattagacgtcctgcagaattactttcctagactgagaaagagctagagatttctttaaaaaaaaaaaaaaaagaggtggtgatggtttttcaggtatacgattagctgtttttgagaaattgttttaattaactgaatattttctctgggcaataagcctttctccctggtttttcattttaagaggttatgatgggcactgtctttcctggcataata

SEQ ID NO: 35463 - DNA, 601 bp, Human
catctccgttgcacgttcaggccaactgtacccaagctgatatgtgattttgatccctgcagcaggacgacgatgccccgaagaagcaggccttgtaccttatgtttgacacttctcaggagagccctgtcaagtcatctcccgtccgcatgtcagagtccccgacgccgtgttcagggtatgacttccatgatgagagagttacacatcatgctggatgttctaaagcctctgagcaccttcatgctgttattttgacttcatttcagtgcatagattcaggcggctgacatgccacatattttttttttttttaatagagacagagtctcaccatgatgcccaggctggtttcaaactcctgggctcaagggctcctctcacctcagcctcccaaagtgctgggattataggcatgagccacaatacctggccagcccacacttcagtctctctgaatgtccacagggacataaacgcattggttttgttactggctaccctttggactaaagtgaaatccttcagcagttgactgtgtgtcccactccctataatctcgcccagtgcacacacactttattccatcatttgtctaaag

SEQ ID NO: 35464 - DNA, 601 bp, Human
catatatatatatatttggaagtatttcttgaagagttatgttacgtttggaaaacccaccagctaactggcctttcaccttccgctggctagctcccactcactgaccagggagtgagggtggcgtgggggtgggaggacactgaaggctatgcttttggggagggggtcgggtctgccaatctcaagatgtgcattgtcagcatgtgggaattagtctagatgaaaccacaagtaatggcagctaattgatactctctttagcctcaaggcaaaaatgtccagcaaatggctgcatggyccttgcttggaatcaatatcactctctgttctcctctatttttcttgtgtgtcctcctctctgccggctttcagacagctcccgagggctcctttgcctctgctgacgccctcctcagcaggctagctcaccccgtctctctctgtggtgcacttgactatctggagcccgacttagcagaaaagaaccccccactattcgctcagaaactccaggtttgtagcccacgtgtgaccttttgggagtttgtcaaaacctcagtagagaatgaacccccgaggcccaaatgaaataaggcag

SEQ ID NO: 35465 - DNA, 601 bp, Human
ctcggatgtggaaaccattgacgtctgtcttgatgcatttccctgcggtttgcccacactccctgtgggcaggaggagttagagtttgccatcatgcggatagaagccctgaagctggccaggcagattgctttggcttcccgcagccaccaggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcrtcactcttgcataaatacacactgagcacatagctaagatccatttaagtcgataatgctaaaccgcgggatagtaatgctggttaaatgagagagaatacagagaccaatgtatgggtcagtagggtaaagaaggctagcctaagatggcaaagttggatagaaaactggttagcaccaattcaacagagcaaaacaaaatcatgacctttgagggttttttttttctacagataccatttgcttctctattgagcaaacataatttgcaacttttctattttctgcaagttaacatct

SEQ ID NO: 35466 - DNA, 601 bp, Human
caggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcgtcactcttgcataaatacacactgagcacatagctaagatccatttaagtcgataatgctaaaccgcgggatagtaatgctggttaaatgagagagaatacagagaccaatgtatgggtcagtagggtaaagaaggctagcctaagatgrcaaagttggatagaaaactggttagcaccaattcaacagagcaaaacaaaatcatgacctttgagggttttttttttctacagataccatttgcttctctattgagcaaacataatttgcaacttttctattttctgcaagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgt

SEQ ID NO: 35467 - DNA, 601 bp, Human
aagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgtttgtttgtttgtttttttacaaaaaacggcagtgggccatttggcctgtggagtttcccaattcctagttttagcatggagtatgacattgacagggcatgcagaaatcttttygcctggcttccaagtttggggtaacttttattaacaatttgaatgagttgctgatgacgtgcagaacgtgtgtttgcccctggactgcccatgcaaaccttggtctctgagggcggcctcgttcccacccctcaccccaccccaagttggacagcccgatgaacctggtgtgtcagactgtgctctgtggctttgaacaagtaggtgaacctcttcgagccttagtattgccgttcgtgagatgaggccaataatagccagtgtacaggttgctgtgaggatgacagatgtctggtgtgc

SEQ ID NO: 35468 - DNA, 601 bp, Human
caaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgtttgtttgtttgtttttttacaaaaaacggcagtgggccatttggcctgtggagtttcccaattcctagttttagcatggagtatgacattgacagggcatgcagaaatcttttcgcctggcttccaagtttggggtaamttttattaacaatttgaatgagttgctgatgacgtgcagaacgtgtgtttgcccctggactgcccatgcaaaccttggtctctgagggcggcctcgttcccacccctcaccccaccccaagttggacagcccgatgaacctggtgtgtcagactgtgctctgtggctttgaacaagtaggtgaacctcttcgagccttagtattgccgttcgtgagatgaggccaataatagccagtgtacaggttgctgtgaggatgacagatgtctggtgtgcggagagtggcaccatgcttgacaca

SEQ ID NO: 35469 - DNA, 601 bp, Human
ttcccacccctcaccccaccccaagttggacagcccgatgaacctggtgtgtcagactgtgctctgtggctttgaacaagtaggtgaacctcttcgagccttagtattgccgttcgtgagatgaggccaataatagccagtgtacaggttgctgtgaggatgacagatgtctggtgtgcggagagtggcaccatgcttgacacatagtaggtgtgtgataaaggaaagctgctgttgttagctgacacttccctcttgcttctgttacctgatcaggtgctcccagcatctctcctcggtrggtggatccgggtcccattttacagatgggagatggagccacttgacagtgattcaccagcctgttggggactagaactcaggtctccaagtgagaggcccctcgctgggtgtggtggtacacacctgtagttccagctactcgggagactgaggtgggaggattgcttgagcccaggagttccaggttacagagagctgtgatcacttgattgcactccagccaaggtgacagagcgagaccctatcttttaattgaaaaaatacaaatgggagcccctggcctgcctgcctggagtaa

SEQ ID NO: 35470 - DNA, 601 bp, Human
tggaaactcctgatgcataggaagagaaaacagcagctgtgtatccaatttgcctttttttctggccatatatttcagcggtaggtgacacagctctgtcattttgccaacatggtcttaagctgttgctagcacaaagatgaaatcacttggaatgaaaaatatcatattgcatggatgaaaatcaccataagctagagtggggagtgattttccggttgttccctagagcagctttgacttccatatctctctagactgatggagagctgagtcagccttgcaggagctgcagtggggrtttctccatctcagttagaaaatgtgagaaatgaggagaagtccttaggggccggggtgtcaggctgcagtctcaccattactttccttccacatccttctggtcaaacggaatttggttgtgtcctcctgggagtgaacctgaccaaggtcactggaaatgtggtacaggagccctgaatttaacactcagccacgtcagatagaacctgaatgttgtgtctgggtggctctccaagaggcacaggctgtgggcctttctggattgggggacccaatataaagacggaaggatgtgtct

SEQ ID NO: 35471 - DNA, 601 bp, Human
gtagtgtccatttgaattttcttagaaaccccattattttacttattttttttcattccctttcttgttttacaaaggattttaggcagcataaagataattaattccttcattagtcatatttagtttctgcccactatgataaagttagttttaattaaatcaattttctcctgcgctgcagggagcctgcttattttgatcagaattgaatctcattctgggaaaccttgtgccccagtctctgagattctccattttattcatcttcagaaggtccacgctgagtttgatggtgacwaatgttgttttcattttgaaattttattgctcattaaaaaaaacacacacatttgttgactttaaaagtgaatagtttttgtttttccttttaaaatcctttgcctttttaaaatttttttaagacagagtctcactctgtcacccaggctggagtgcagtggcgcgatctcagctcactgcaacctttgcctcctgggtttcaagcgattctcgtgcctcagcctccccagtagctgggattacaggcatgcaccaccacacctggctagtttttgtatttttagtagagacagggttt

SEQ ID NO: 35472 - DNA, 601 bp, Human
ccacttgttcagggtctaatcagcagatgtggatattgtcattgacccagtttttaattttcccattaacgtaacagacttcatggcaacagaactcttacataactctaacataactccaacataactcttacatccagagactctacctagccaaaggtgatattggttgacaactacagtaggctttaagctttgcgtgactcacatcctttcaaacagagctaaacaaatgcccccaaaatggaaatgtaaacagtcttacaaaagtgatcaaatctgtggttattcaaaactaggmaaacatagactagaattcaacattattcaccattgagatctcattttggaagtggaggctgctgaatagtgccctgggttctcaggcgctgtgcctaagtggctcagtgagtgataaatggcagagataagcaggtaccagacatgctggactccaaggcctcggagcttaaggggcctctgccattagcccctttgtctgcctgcccaggtgcagaatgatagatctccatccatagactggactcggcatttccctgttcatcagtctttgcactttctcatacttttgatgttcttt

SEQ ID NO: 35473 - DNA, 601 bp, Human
aaatctgtggttattcaaaactaggcaaacatagactagaattcaacattattcaccattgagatctcattttggaagtggaggctgctgaatagtgccctgggttctcaggcgctgtgcctaagtggctcagtgagtgataaatggcagagataagcaggtaccagacatgctggactccaaggcctcggagcttaaggggcctctgccattagcccctttgtctgcctgcccaggtgcagaatgatagatctccatccatagactggactcggcatttccctgttcatcagtctttgcrctttctcatacttttgatgttctttgtttcaaaaccatacaattggcccattcatgagagggtgagtgtaatcctctttgtcgtatgattaatgctaactgttttttttttaattaaaaacgattccacagagagaggctgctcacccaacagacgtctccatctccaaaacagccttgtactcccgcatcgggaccgctgaggtggagaaacctgcaggccttctgttccagcagcccgacctggactctgccctccagatcgccagagcagaggtatcgtggcatgtggtgtaattac

SEQ ID NO: 35474 - DNA, 601 bp, Human
ggggcctctgccattagcccctttgtctgcctgcccaggtgcagaatgatagatctccatccatagactggactcggcatttccctgttcatcagtctttgcactttctcatacttttgatgttctttgtttcaaaaccatacaattggcccattcatgagagggtgagtgtaatcctctttgtcgtatgattaatgctaactgttttttttttaattaaaaacgattccacagagagaggctgctcacccaacagacgtctccatctccaaaacagccttgtactcccgcatcgggaccrctgaggtggagaaacctgcaggccttctgttccagcagcccgacctggactctgccctccagatcgccagagcagaggtatcgtggcatgtggtgtaattaccctcttcctgccacttataaatacgtatgctcgtggtccacaaagccagagtctttggagacagactttgtcctctgaacgctgcaggcaaagatgtgtggcacaccatgcgttttgatcttcctagacgctatcgtgtaatgggccttttggccttgttgaatttacaacaaaaagcatgcccctttcagttgctcc

SEQ ID NO: 35475 - DNA, 601 bp, Human
gctcagagctgaattcactcatttggggctaacctttctcttcttctctctgaaactagatcataaccaaggagagagaggtctcagaatggaaagataaatatgaagaaagcaggcgggaagtgatggaaatgaggtcagttggggagctgggccttcctcgtgcctgagggatacttacctgtggtttaataatgaccggagctggtgtggtccacagaagagtgtcttctgtggaagttctctcttctttattacacacagttcatatttttctaaaagtatttttactctattactrttactaaaatagcatgcacatgaattaaagaatgcattcaaataaatgtatgtacaatgcaaaacagatctccccactcagcctccagttccacaactcgcaggtgactatcttctgtttctggtggatccttccaagaattttccatttctcatcacaaatgtaacaatgagtgtaaacagcctcttttttctccaaaataaatgagagcttgcagtatacatcattctacactctttttaattaattaatttatttttttgaaacagagtttcgctcttgttgcccaggctggagtgc

SEQ ID NO: 35476 - DNA, 601 bp, Human
gttctctcttctttattacacacagttcatatttttctaaaagtatttttactctattactattactaaaatagcatgcacatgaattaaagaatgcattcaaataaatgtatgtacaatgcaaaacagatctccccactcagcctccagttccacaactcgcaggtgactatcttctgtttctggtggatccttccaagaattttccatttctcatcacaaatgtaacaatgagtgtaaacagcctcttttttctccaaaataaatgagagcttgcagtatacatcattctacactcttyttaattaattaatttatttttttgaaacagagtttcgctcttgttgcccaggctggagtgcagtggcgccacctcggctcactgcaacctccaactctgccaggttcaagtgattctcctgcctcagccacccaagtaactgggattacaggcgcctgccaccatggctggctaattttttgtatttttagtagagtcagggtttcaccatgttggccaggctggtctcaaactcctgacctcagatgatccacccgcctcggcctcccaaagtgctgggattacaggcatgagtcgctg

SEQ ID NO: 35477 - DNA, 601 bp, Human
aattaatttatttttttgaaacagagtttcgctcttgttgcccaggctggagtgcagtggcgccacctcggctcactgcaacctccaactctgccaggttcaagtgattctcctgcctcagccacccaagtaactgggattacaggcgcctgccaccatggctggctaattttttgtatttttagtagagtcagggtttcaccatgttggccaggctggtctcaaactcctgacctcagatgatccacccgcctcggcctcccaaagtgctgggattacaggcatgagtcgctgcgcctgrcccaccactctttttaaatttaatagcatatttttgacgtattttttattcctctctgcctcactctgtttaacaggtgcttaatggtccattgtatggatataacgtaattaatttaaacagtctctgtggacaaacatttaggatgtttcctgactgtagcttaaatgatttattttcatttgtggtatgttgtaatagaaatatagtcaccatgtatagtgtacataagtgcaatggccgatactagttttttttgtgtgtgtgtttttgagacggagtttccctcttgttgcccag

SEQ ID NO: 35478 - DNA, 601 bp, Human
ttctcctgcctcagccacccaagtaactgggattacaggcgcctgccaccatggctggctaattttttgtatttttagtagagtcagggtttcaccatgttggccaggctggtctcaaactcctgacctcagatgatccacccgcctcggcctcccaaagtgctgggattacaggcatgagtcgctgcgcctgacccaccactctttttaaatttaatagcatatttttgacgtattttttattcctctctgcctcactctgtttaacaggtgcttaatggtccattgtatggatataacrtaattaatttaaacagtctctgtggacaaacatttaggatgtttcctgactgtagcttaaatgatttattttcatttgtggtatgttgtaatagaaatatagtcaccatgtatagtgtacataagtgcaatggccgatactagttttttttgtgtgtgtgtttttgagacggagtttccctcttgttgcccaggctggagtgcgatggtgcgatctcagctcactataacctccgcctcccgggttcaagtggttctcctgcctcggcctcccaagtagctgggattacaggcacctgcc

SEQ ID NO: 35479 - DNA, 601 bp, Human
gtagagatggggttttaccatgttggccaggctggtcttgaactcctgaccttaggtgatctgcctgccttggcctcccaaagttctgggattacaggcatgagccactgcacccagccccgatactagtttattatcaaaatcaattgcattcctggctaccattttaagcagaaaagcgaactgtaggtaatcatatcccgttttctaggtcatcgtaggatcttcctgaaaattctcctgttcgttccttctttctgctgatggttccctgtgaccacctctggacattgagcctagygtgctatttcacattcaaacgaaagccctgcatttgcattatttttaaacctctttgttttttctcttatttgggggtatgggtggttctagtttttttacatgcactgaaaatgaggcatggcacccaggaaggctgtaagttctgtctctaatttcttttgcctcctgggagctttgccttcttggtgcctggggagtgcttattcgtggtttgagaagtcgtaccactgaggggcccccaggaggtgccatttactagctgatgtggtaggatttcaagatgtcaccagctggtgca

SEQ ID NO: 35480 - DNA, 601 bp, Human
aaatcaattgcattcctggctaccattttaagcagaaaagcgaactgtaggtaatcatatcccgttttctaggtcatcgtaggatcttcctgaaaattctcctgttcgttccttctttctgctgatggttccctgtgaccacctctggacattgagcctagcgtgctatttcacattcaaacgaaagccctgcatttgcattatttttaaacctctttgttttttctcttatttgggggtatgggtggttctagtttttttacatgcactgaaaatgaggcatggcacccaggaaggctgkaagttctgtctctaatttcttttgcctcctgggagctttgccttcttggtgcctggggagtgcttattcgtggtttgagaagtcgtaccactgaggggcccccaggaggtgccatttactagctgatgtggtaggatttcaagatgtcaccagctggtgcagatgtaccggcatttggtagcccgaatgtcagcccgtcagcctctggagctagactaggtgaaaaccaggctctgcttcccagccactccggggcatcttacttaactctgcctcactttgcttattaacttgaaaatg

SEQ ID NO: 35481 - DNA, 601 bp, Human
tagactaggtgaaaaccaggctctgcttcccagccactccggggcatcttacttaactctgcctcactttgcttattaacttgaaaatgggggtaaataacagtgcctcaacagagtagagcagaaggattatgaacaaaggctgcggagtgtgatgcttggattcacatctgggctctgccacttggcagccttgggatcctggaagagtttctgaatcactctgactccaccccagtgtcttcatcagtaatgctgggaacagtgagagcactgcctcttagggtcattgtgagggtaragtgaaaaaacagcacagctaaggtattttcaggtccccggtctctccacgcttccaaaaggacacgtcccttacctccttgtgtcctcagcagtgatgagtggttagacagggcagcctcaaagatctatcacagcttggtgattctgagatgcaaggaggtgttgtttaatggcagaaaacacagaattgctcctgtgtaggatttggaaagaaccctcggaggctcatctcatggttacctttcttgggagtccattctggggtgagacactgaccttgggaccaaggttgagcagc

SEQ ID NO: 35482 - DNA, 601 bp, Human
tcccatacagccctgaaaggtggggtctaggaaaatccttactctaccaaggagtaagcagagcgcccgcagcttccatgaatgtcgtgctcagggtcacacagctgggaggggcaagctcagcgggatcccaggcctcctgaccggggtgggggtctctatggttttctgtcattagggtcctggatcttcaacagttatccgctcttggttctcttgtggggaataattattggataatgtaggtgaacccctgattctttttgagaagtttcttccagcagattggctttggagaaargacgtcttcacacatcagtccttccatttggggacagctgggaggcagtatgacaaacaggggatcttagtgcttttgtgcagttactgtctattgaggcttcccaagaagtttactctgggccagtaggagatgagatttgtgttcagtgatgccagatgcatgagatgctttggaagaagatgcggataaaaggtaatagggttccaaggagaaatcaaggaaggcttcttgaaagagacaccatttgaattggaccttgagaaacagactgtgaggggtagaaatagagagaaagtg

SEQ ID NO: 35483 - DNA, 601 bp, Human
caagtgatcctcccacattagtccctcgagtagctaggatcacagacgcagaccaccacacctggttaattttgtattttttgtagggatggtgtttcaccatgttgcccaggctggtctcgaactcttggactcaggcaaaccttctgccttagcctcttgagtaggtaggactacaggtgcacaccactatgccttattaatttttttttcatttttgtataggcaggatctggctgtgttgcccaaggtggtctcaaaatcctagccttaagtaatccaccagcctcagccttctcartacctgggactgcaggcatgcaccactctacctggtttgattttttttcttagtgggcagtgagggatgttgaaggctttgcacaagggagtggcatatttagagtcacgcaccaggaaaatgagcgtgcagggcgagggctgacattgaaggtgaccctggaagttggggccctgctggacatgggtcaggctgtggcgtccagctgtgtgagatggaaaaccattctgttgtcatgactccaacgtgtctttacttctcttataggaaaatagtggccgagtatgagaagaccatcgc

SEQ ID NO: 35484 - DNA, 601 bp, Human
ggtttgattttttttcttagtgggcagtgagggatgttgaaggctttgcacaagggagtggcatatttagagtcacgcaccaggaaaatgagcgtgcagggcgagggctgacattgaaggtgaccctggaagttggggccctgctggacatgggtcaggctgtggcgtccagctgtgtgagatggaaaaccattctgttgtcatgactccaacgtgtctttacttctcttataggaaaatagtggccgagtatgagaagaccatcgctcagatgataggtaggtgtcctgacctgcggggsctcaggccggccccgatgtttctgaactatgaggaggccttggaagataggaggctcagagtgggtttctggtagagcgtgaagcctttcagggaaggaccagagcattccagaaaatatggctttgccccaggacagagtctggggcttcttggtaacacccccctgaactgtgccatagcattattcacacccatggaaagccatggcagtcacctgccagccaccatctgactcagccaaggactctctaccttgtggggaaagagattccttttgggtgggatatttgggggattt

SEQ ID NO: 35485 - DNA, 601 bp, Human
cttgtgggagataataggaatcaaatccctagaccctaacttagtttagactcaaatgacacctcagcctttccacaaggacccagggacaaggacagtggaccacggcgtgattgtccgcctccttcctcccgtgaccatggcaggccctgttcactgaccccagcactgtttctcactgagattggacgctgcctcggaatccttcttaacacggcgtccctggcagccagtactgagaaatttgctttggctcacaataaaagaaggcctcaagttataagctacacatccctgggcytttttttcttttcttttctttttttttaaataatgagaaaagatcttgcagaagttctaagcccaagtttttatgctaatggtcactattcagaaatcatattataactgggtctgtgggatttttttaaaattaattaattatttgcttaggtttatgataatccattttttgtttgttttgggatggggtcttgctacgttgcccaggctggtctcaaacttctggggtttagcgatcctcctgccttggttgcccaatgtcctgggattacaaggcgtgagctaccatgcccagccc

SEQ ID NO: 35486 - DNA, 601 bp, Human
ttataggcatctgccatcatgcctggctaatttttgtatttttagtagagacggggtttcactatgttggccaggctgatgttgaactcctgactttaagtgatccacctgcctcggcctcccaaggtgctgggattgcaggcgtgagccgctgcacctggcccgataaccagttttttttcttctaaggatatatggagtaaaaactccaggtcactgcagaccacgctttatgtgtccaagtttgacactgtgctggcacctggtccccacccccaagcatatggatgtatgagtcacrtcacacctctagcttgtcccaaggtaaatataatagtagcctcaggaatagtgaagaggccaacaattgagtgctttccattcaaaggagcttcaattttgatttattgtaacaaagttcatttcacccagaaaagaagccctttcatgtttagcctcatggtgcatgcttcctatcaaagtgaaacttctttattaaattggtataagaatttatgaacacatatggataagataaaaaaaaaaactcttggagttgaaaatgctggcaaaaatggtcaggctaagggattgatgtctt

SEQ ID NO: 35487 - DNA, 601 bp, Human
actgtagtcgtattttgaagtcaaaccagctccagcccacatgtctagctcttcctggctctgctccattcagctttcacagatgctccacaccagtgtgacatcagtcctgccgttgttattcatttgcatcaaatgttactggagagatatgttttgttaagctcacatagtgactatttagaattcagaagagagagagacttctgtgctttctgcattccaggttgttgcaattgatttttttctgcttttctaacaactgccctgattatctgttttgcttccattttctgttgcwtcttgccctttgcttgcaaaacaaacaggcaagcctggtaagtaaacgcttttccccctaatttgacacctgcccattgcaaccctttgtttgtttgtttttctatttttgttatttttgctttgtgtattgctgcattccccccacatgatttcatgatgttttgcctgaaaaagccagaaaagtcttcaggagcattgttttgttgttgagtgtagggtgtctttctcctgatttgaagaacctaactgcgtttgtcatgtacaaaaggatttgtgaagcattcttgcctcccccgtc

SEQ ID NO: 35488 - DNA, 601 bp, Human
tggtaagtaaacgcttttccccctaatttgacacctgcccattgcaaccctttgtttgtttgtttttctatttttgttatttttgctttgtgtattgctgcattccccccacatgatttcatgatgttttgcctgaaaaagccagaaaagtcttcaggagcattgttttgttgttgagtgtagggtgtctttctcctgatttgaagaacctaactgcgtttgtcatgtacaaaaggatttgtgaagcattcttgcctcccccgtctcctgggaacggggtaattctatttttaaaaagggktaggttgagaggaaaggaaacctgaggcaggtgaagtcttggatccaggaaatcagatggacttggtttggtaaacagctcctttaccaagtcaggtgaaacatacacatgggctcagatcagcccagaatatacaccatacagcgtgctgggaactaagaaagcagccagaattccaagaataaaaacaagcatttgattattagagacatgttgaaaggccctttcttttaggagtgtgggtgtggcaagcaggttgttggcgattctatgttaaaaagctccctcttcgcaagccac

SEQ ID NO: 35489 - DNA, 601 bp, Human
ctcagtgaacagtgacttagcttctcaaaccctctgttccgccttctgtaaaatgagggtgagaaaagctgcccgggtggttgtgatgctctaagttgttcactcgtcgcatggacatgtatcaagacatcctgtatgcccggcactatcctaggccctggggcagagcaagtggacaaaacagactctggtgcctgccctcacagagcgtgcattcatcagggagatgagccgctgatacaccagcataggcacgcacgcacacacgtgcacacatgtgtgcacacatctgatacaatgataaggggtggctgctgctgcaaagaggaaaatgaaggactctagaggaagaggagccatttccagtacctctggggaggtgacatgggatcagagccctgagagaatgttggagagccctggaagccctggggcgggaccccctggggcattggaggccttcgtggctggagcagagaggcctgggagggtagagggcagagcatgtgggcaaggatttgggtgttatttccatttcagagggaggtcactgcgggggagctctgagcaggagtgaggtggcctggtttgcacattagga

SEQ ID NO: 35490 - DNA, 601 bp, Human
aggccctggggcagagcaagtggacaaaacagactctggtgcctgccctcacagagcgtgcattcatcagggagatgagccgctgatacaccagcataggcacgcacgcacacacgtgcacacatgtgtgcacacatctgatacaatgataaggggtggctgctgctgcaaagaggaaaatgaaggactctagaggaagaggagccatttccagtacctctggggaggtgacatgggatcagagccctgagagaatgttggagagccctggaagccctggggcgggaccccctggggcatyggaggccttcgtggctggagcagagaggcctgggagggtagagggcagagcatgtgggcaaggatttgggtgttatttccatttcagagggaggtcactgcgggggagctctgagcaggagtgaggtggcctggtttgcacattaggaagctcagtctggctgctgagtgctggcttagggacagtcaacacctagagcaatcagcagggtgcccgccacatggaagggtccagtcagcgctggctcccgttgttctgttatttccagatgtgatctgtctatggcagccagccctcgga

SEQ ID NO: 35491 - DNA, 601 bp, Human
tctatggcagccagccctcggagtcattccaggtggcaggcagccccctccccagtgacgagggcctggtagaaagacaggtctgctgagctccttccccaggagctctgagtgggcgcttctcccttccccactctgctgtcaccaagagagcaaatggttcctcacccacctgggccggggatggatccgcacagaggacagaggggtgttttgtgtagagtagtcagagaaggcctttcccataagtgtagaaatgattttctaagcagccataaaaaaagaacaaagtcatgtcctwggtaccagcatggatgcagctggaggccattgtcctcagggaattaatgcagaaacagagcgccaaacactgagcattctcatttataagagggagctacacattgggtacacacggacacaaagatgggaacagaagacgctggggagttcacagtgggggtagaagggagacgggttgaaaacctgcctttcaggtactatgctcagtacctgggtgacaggctcattagaaatctgtaccccagcattagtcacacagtatggccatgtaaccaacctgcacatgtgccccaaatct

SEQ ID NO: 35492 - DNA, 601 bp, Human
gaagggagacgggttgaaaacctgcctttcaggtactatgctcagtacctgggtgacaggctcattagaaatctgtaccccagcattagtcacacagtatggccatgtaaccaacctgcacatgtgccccaaatctaaaaatatacattttctagatatttggggcagattattagcttgggatggccaagggccggagaggtggggcagaggacaatggttcctctcaccaggatcagccactcggaactgagccaacactgaattaatattgtacatcactgagaagctaaccttgacrgaaatagctccgtgtttcttggagttacaacacttgctgtatcgaagacgctatctgtgcctgcgtgaatggaatttcagaggagatgcttttttgggctctgggtttccagatgtgttaaggatctccaaagacctcctctctgtcctgatacataggagggcccatccctcacagcccagacctcacaccctttaatcgtcccaacgcaaaattcactagcgatgtcttcttttttactttacggatctgtctgcttgctgtcaacaaccacatagaatcaccagggacaccaatata

SEQ ID NO: 35493 - DNA, 601 bp, Human
gggaagcaggaggtgtctctagtgatccacaaaagagtgataattctgagctccctgtctccgcagggccaatgctgagattgctcaggttcgaggcaaggcccagcaggagcaagccgcccaccaggccagcctgcggaaggagcagctgcgagtggacgccctggaaaggacgctggagcagaaggtaataggggaggggtgtggcctccaggtgggccgggctgctgctctctgtgctgctggccagtccagctagacaggctgggcttccctggccactgctgctcctgaagacgarttcatgcttcatgagcatacccttggttccttctagaagttccaatttcatgccagccctaagaccagcttcctttccaccgttcctggaactgcagcctgcatgtgtgtttactgccattttcattccttttcaacattcgtttatttgttggatatttattaagtgcctacaatgtgttaggcgtagcccttgaacctctgcatccggcatgcttactgggtgagtggatggggtgcccaccaggccctggcagtggtggccagctgatgcagaacatgagcagtgtcagggctggaa

SEQ ID NO: 35494 - DNA, 601 bp, Human
tgctgctcctgaagacgaattcatgcttcatgagcatacccttggttccttctagaagttccaatttcatgccagccctaagaccagcttcctttccaccgttcctggaactgcagcctgcatgtgtgtttactgccattttcattccttttcaacattcgtttatttgttggatatttattaagtgcctacaatgtgttaggcgtagcccttgaacctctgcatccggcatgcttactgggtgagtggatggggtgcccaccaggccctggcagtggtggccagctgatgcagaacatgrgcagtgtcagggctggaagggcgcccaggtggcctctaattccagggacaggggtgatcttcccgaggacactgagcttgtgcgcaggtttcctccttttggatctggcacccctccatccactgtgagcactgtctccctgggtgtccagataagaagctccctcagcccaggagggccctctgagcgttgggctgttgagactgcgtgtgtgtgagtgagggccagcctccctccttggatgtgtttctcaaggagaggatttccagatgtgcagcctccttccagtcaatttcctga

SEQ ID NO: 35495 - DNA, 601 bp, Human
ccaccgttcctggaactgcagcctgcatgtgtgtttactgccattttcattccttttcaacattcgtttatttgttggatatttattaagtgcctacaatgtgttaggcgtagcccttgaacctctgcatccggcatgcttactgggtgagtggatggggtgcccaccaggccctggcagtggtggccagctgatgcagaacatgagcagtgtcagggctggaagggcgcccaggtggcctctaattccagggacaggggtgatcttcccgaggacactgagcttgtgcgcaggtttcctscttttggatctggcacccctccatccactgtgagcactgtctccctgggtgtccagataagaagctccctcagcccaggagggccctctgagcgttgggctgttgagactgcgtgtgtgtgagtgagggccagcctccctccttggatgtgtttctcaaggagaggatttccagatgtgcagcctccttccagtcaatttcctgagccttggggttcccctgcgtagtcatccacgagcccagcagcctgggttggcagcacaatttttgcattttgggccttgataggcagtgatgggg

SEQ ID NO: 35496 - DNA, 601 bp, Human
agttctaacctagaaacagagggcacgtggctctgggctggaacatgtctcaggagttctgaggttttcagggaagggctctgcacagcctcagggacaggcttttggtgaagactgatcttccatgggaatctcaaggaaaagctggctgcaaaacatccccagtatgctggagggatccagcccccttggagaaggccattggagatcggtcgtgctgttgaacttgatcagcatcagagccagcatgtaacctatctgaaagcaaagccacacgtccatgatggagggatcgtcccgytggatcccctcactttctgagaagatggacagtgtaggatcatctgtgctagacaaacctgtggttggttccccttgattagacaggcaaggtgtggtgggagaatcaccttaaagccagctcgcatctgccccccaccccccatgaccctgtagccacagcatcacctatttggcatccctctgagcaatgccagtgatcccattcacgtagaactgcgtaaccctccttatgctacatctcaaaaaagccaccgaggggtttaccccagacgctcctcacctcagatcacatccttcc

SEQ ID NO: 35497 - DNA, 601 bp, Human
agagaggttgtgtaacttgtggaagatcacacagctacagctgggatatatactcagattgtttggctccaagtcatttgtctcactgctttagtggggaccaaggggcctggtggtcccccatctccccaaaaagccccatgagcattctgactggccagatttcaaacatcagcaacttcttccttgtcttcacttgcagaataaagaaatagaagaactcaccaagatttgtgacgaactgattgccaaaatggggaaaagctaactctgaaccgaatgttttggacttaactgttgmgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatt

SEQ ID NO: 35498 - DNA, 601 bp, Human
gtagtgtgactgcttggtttgtggtatacattttaaggcaaccactctttctttcaggtacagatatttggcagctttagtacaggtctttatcttccaactaggtgagtaccagactgcatggcatgggctagtggggggctgggatggtgtctatgcaatattaagggctacaaatagattctttgtaattgagtctaaggcgagaaatgccagctaaaggaaaagactgtggttacagagggaaattggcagaaagatttaatttagtgttatgatgaattcattgctttgcattttkcctctcacacttaatttgttggggtgcaaaaatgcttcatgctggaaatatgaagaagacaggtgggaggactgtgggaagtaaacgcaatagaagacattctgctgatattttaggacatgtgtttgaaaaattgatcttatgttttgatgaagattcaagcaaaattctctttaaatagtattttctaagtatttttacctgataggaaaatgtcaaacaagtttgcattctaaaatacaaactagtattttctcattaaggattcttgatagccaaataaatttcctgtgcactgtc

SEQ ID NO: 35499 - DNA, 601 bp, Human
gcattctaaaatacaaactagtattttctcattaaggattcttgatagccaaataaatttcctgtgcactgtctcattaaaagcttaccttctattaacccactgctagttagcatttggaggccgaagaggctataatctcaggatttgggggttgacattagcagggccagtgggtaattgaacaggtttgggtatccaggaatctctgggtccgcaggagtgatccagcgtaggcagtgccggagtaggtgctgggagagcggggcctcagcctggtttgggggcaggcattttcatytgaatcccctcacatacctagtgctgttgggagaatgatttaaccttcttgctttccatcttatgctacaaatatggaagtcttcccttaagttcagcgaggacttgctgtagttcatgaactgcacttcacctccttaggggccataggctagtgggattgtgtcttggcctttgtgggagacacaggcacatgtgccttggtgcttatcctccccacacgaatgtgtaggctgtggcgaggggagcagtggctgacgtgcgttttcttctgtcagcgacatagacctggtggtcttcg

SEQ ID NO: 35500 - DNA, 601 bp, Human
gatccagcgtaggcagtgccggagtaggtgctgggagagcggggcctcagcctggtttgggggcaggcattttcatctgaatcccctcacatacctagtgctgttgggagaatgatttaaccttcttgctttccatcttatgctacaaatatggaagtcttcccttaagttcagcgaggacttgctgtagttcatgaactgcacttcacctccttaggggccataggctagtgggattgtgtcttggcctttgtgggagacacaggcacatgtgccttggtgcttatcctccccacacgartgtgtaggctgtggcgaggggagcagtggctgacgtgcgttttcttctgtcagcgacatagacctggtggtcttcgggaaatgggagcgtcctcctttacagctgctggagcaagccctgcggaagcacaacgtggctgagccgtgttccatcaaagtccttgacaaggctacggtgagtgcctggctttggcccctctgaccgggcaggagccttgtcacatcccaggtggtcacaggatacgcctgcgtcacgagcttgtggtattttacacagttattggctacagttttgaagatt

SEQ ID NO: 35501 - DNA, 601 bp, Human
gacagtctgaacttttgggacttgtgagcccattaaactgttcttggaatgaaaatatatgattgtgtctacttgtgttaggatgaataggaaaggagagtcatctgaaaccggacactgacattcaggtgctgcccattatggagagtgtggctcaatgattaaaccatggtttttatgattaccatttgctatgttatgttaaagaggaacaacttagctgttcctttcgtggttccaaaaaatatacatatatgaaaagcctcttatctttgggggaagtttgaagatgagactgttkctggtgtgtacttgctaaggtttatgtcagttcaagattataagccccccagggactatgaggtacttgcctgttgtatgacagttcttagctcacctgtgcgaccggctagcatttcatttttaaatttgtgtgtcaacttgtgtgtgattcacatccttatagtgtttagcagaatgtaagttaaggcaggagcttcctcctgcctgtgtggtgataggggagggggcattcacatgtttctcattgtcaggtgcttttgattgaggctgggggcaagttttaaaacatgatatatgc

SEQ ID NO: 35502 - DNA, 601 bp, Human
cttagctcacctgtgcgaccggctagcatttcatttttaaatttgtgtgtcaacttgtgtgtgattcacatccttatagtgtttagcagaatgtaagttaaggcaggagcttcctcctgcctgtgtggtgataggggagggggcattcacatgtttctcattgtcaggtgcttttgattgaggctgggggcaagttttaaaacatgatatatgcactgaaaagtgcacatgtaccaggtgcacctcttggtgagagttaacgaagtgcacatgctcatgtcactgtcatgtggaccagagygagcaggcagcaccagaggttccctccaggcccaggttccagaaggggctgttggctcttctcattagcacgagacaagccctggccggccactttctcaaatgcttacgggccttattgcacttagctctcccagccactctcatcagcagatgctgttgctgttcacattttacaggtgaggaaactgagatgcggagaggtgaggtcattagcccaaggtgggtcagcggcatagtccaggccgctgttgtctgctgctcctctgtgtgtgccaaggggcagcggggaggtgggtgg

SEQ ID NO: 35503 - DNA, 601 bp, Human
cagagggacctgaatgaagtttttacaggtggaattagctcatacagcctaattttaatggccattagctttctacaggtatgtatgctttcttgagactgtttctgttgagacatgtgtaagagtagactcttccaaccagttgcctagtgggttccagcagcctttgctctccttttactgtattgtttcaatttggtagaggctgatttctgattcttacaatcaaaccctcttgattaatgcacctttctggatgctcattttgtactgggtgtaactgttggtgcaggggtgcccrtctggttctgtgagtccagtgcacatcagtccaagctcagggaattctctgtattcagaaatgtccatttcatggtaaacaataaacatttcttggtgcttgtctgtgatttatattgaaaaaaatttgtctcagaataaagttgagtaccacatatgagaaaaggatttacaagagagctttctcagactgatgaaacatcattattttgtcttaaattatatgtggtccttattttgctgagtaacatggaaaatctatcaatagaaaacctacgtgttttaaaaagtattgttaaat

SEQ ID NO: 35504 - DNA, 601 bp, Human
tatgtgattttggctaaaagacaaggaataaggaagggaataaaggtcaggccagaatcggaatcctcctcttgtgtggtggaaatatgcagagaactccggaattcttctgaaccctaaaaacatttgtatgctttctagctgcagctcctcctggcactctgtgttataaatagtttcaagcaccgtgcttctctgagggctttctctcatgtgccctcgtccatccctttcgagttggcactgtccgatagaattctgtgatggtgatggccacttctgcatggtccggcaaggggcwgggcgccacatgtggctactgagtattgcagtgtggctggtgagagcaacaagctggatttttaattaatttgttttaattcatttaaatagacatgtgggcaatgcaggtctggacagctgagaattatgaccctcaggaggtgtggtggacagtggtttacttccgaacaagcccagtgcctgcttttgaagacgatatggcactgaactgagagtggtgctcatctgtgtgacaagcaggatggaagcttgctataaatattgtgatataatgctaatgacctttacacagctaaaa

SEQ ID NO: 35505 - DNA, 601 bp, Human
cgccacatgtggctactgagtattgcagtgtggctggtgagagcaacaagctggatttttaattaatttgttttaattcatttaaatagacatgtgggcaatgcaggtctggacagctgagaattatgaccctcaggaggtgtggtggacagtggtttacttccgaacaagcccagtgcctgcttttgaagacgatatggcactgaactgagagtggtgctcatctgtgtgacaagcaggatggaagcttgctataaatattgtgatataatgctaatgacctttacacagctaaaatcartcctttcacttttccggttttatgtgatactgccatactagtcagtctaacactgacccctgttggttgtgcttcagcataacgaaattaggatgacgagaatctgaaattacatctaccatccaggtgactaagttatgcagaatatagtccaacttatttgcccatatttggttaatcagatatctgtgtttgcaggaagtttgctgtatggattaccaatttcaaaaatcaaactacactaaaattcagatgagtccgttgtgttccttttgaacactcctcgttgaagaggctgct

SEQ ID NO: 35506 - DNA, 601 bp, Human
ttgttgtttatagatggcatgatttgtgcaggctcttgagtggttttcttggtagcacggtatggcagtgtatcatccatttttgtccgttggatgagtcacattggagacattggcattgtcttcaagtgtctgctgaaatgtactcaaaaaacaaagacccacataatcgttgagttataatataaatctagaaaagataaaactccagtacttagaacatatatcctttaaaagaaatccacacttaacctgattgtgaagaatgagttgtttgtagattaaaattcgaaacagtgcwtttcttatgaaaattaagcttctcctgactggcttccttggtgactgctgtgacagattcctttgatttgctgtcccagttttccacacgtgagaattcacattccattctaaaggatttacttcctgtaggttccattagcgttgactgagttgtgatgcacttggggtgagctgcccttctacctgccctgttggggcactgtgaggcctcctgattgtcagatcagcgatcacagtgggtcggtgctgctggtctgcacaatggtagtctttggcttcctcatgtttctgccacctg

SEQ ID NO: 35507 - DNA, 601 bp, Human
agaaatctaaaggataattttataaatactaaattttgtatctacttgcgattatacatcacttgaatatgtgtgggtataaaacccaacatgttaattgacttaaaaccattttctgaaatgtggggtataatttgagcataaagctatgtaggtacatgcaaaagtgttttgactcatttcttggagttttgcactctgctctggggaagacattctcacaggatccaccgtgattctggcggagcttctgggatgctggctctgtaatgacccacagagctgatgagcagagccatgrcccagccggacaccgtaacgtgtctaattgcagcataagtgtaaaattcaggggcaattatttacactcttaaaatgaattataccacagataaacttggtcgcctttttatggtcatcacagtggccctgacgtcctggccatgtgtcacaaaggtgtttgttttaaccacccacaagccttggggcccttgagagcccagtgcggctgctgagctacagagccacactctgcggctgcttgtgtggttcgagtgtgaagtccagggacgctgagggtttataggtttttatctaagaa

SEQ ID NO: 35508 - DNA, 601 bp, Human
acagagctgatgagcagagccatggcccagccggacaccgtaacgtgtctaattgcagcataagtgtaaaattcaggggcaattatttacactcttaaaatgaattataccacagataaacttggtcgcctttttatggtcatcacagtggccctgacgtcctggccatgtgtcacaaaggtgtttgttttaaccacccacaagccttggggcccttgagagcccagtgcggctgctgagctacagagccacactctgcggctgcttgtgtggttcgagtgtgaagtccagggacgctgarggtttataggtttttatctaagaagactcttggccacagtcaatctccagaggttgttggggtaaatgcacgggatgccaagatgcaaccaggtcagtattgcaagtctgagaaaaggggttctcgttagcgcacttctgctgctgacagtaacgggtgatgctgacatagaagcagcctgggacctggacagcaggcaaggaaggaactgccagccgtcccacggcctctcaggccaccagttgggccagccttgggctgtgacccctgagttcagcgtgtgagtagggggttcaccac

SEQ ID NO: 35509 - DNA, 601 bp, Human
aatgaagacttttcccatttacataattcatttatatgctaaataccttggttttcaagaagcaaatgataaaaccaagagcagatcttgccatgatgtcccgtgtatgctgctgtcattcccacgttgcctgatccccgcctggggcaggagcaagcgtcagggctggcagagctgtgtgctgggcctcagcagggccctggcatgcgtgcccttgtggctcctctcaagtccagctgtgtgcatggaggaaacaggtcacgttaagtctctatattcttgaagtacctgaatgattggragagccatggcgaggatcttccaggtcagcccccgtcgtgtgtgatgttccttgggctctgcggatgctcggtgctttcatcggtgtccacacctctttattccgctcctcctttgcttgtctaatcctattttgccagtaagttttttattcttgaggctttgttggccctgtgttgtatgatgattgtttttaggagttaagtaatagaacatttcctcttggatttatccatccccgatagacacattcagggtgaaagaacaacttcgcacaccggcctcttctttgcattttggc

SEQ ID NO: 35510 - DNA, 601 bp, Human
gagcagatcttgccatgatgtcccgtgtatgctgctgtcattcccacgttgcctgatccccgcctggggcaggagcaagcgtcagggctggcagagctgtgtgctgggcctcagcagggccctggcatgcgtgcccttgtggctcctctcaagtccagctgtgtgcatggaggaaacaggtcacgttaagtctctatattcttgaagtacctgaatgattgggagagccatggcgaggatcttccaggtcagcccccgtcgtgtgtgatgttccttgggctctgcggatgctcggtgcttycatcggtgtccacacctctttattccgctcctcctttgcttgtctaatcctattttgccagtaagttttttattcttgaggctttgttggccctgtgttgtatgatgattgtttttaggagttaagtaatagaacatttcctcttggatttatccatccccgatagacacattcagggtgaaagaacaacttcgcacaccggcctcttctttgcattttggctttgctttcccagtctcctcctgctgtttttcttgctctgagactttcctgaagccggcgtgtgttccctctcagtct

SEQ ID NO: 35511 - DNA, 601 bp, Human
agtctgcttggccgcgactttgcagtgcagggaatgtgctttgggtgtagcccaagcacaggctgctgcatgctgggatcgacaggctgctgagggcgagagcgccaggtcctggcacgtgtgacttgcttggttctttctagaaggtcacagctgggggaagaacatgacagggaccttcttacttctgtttttttggagacagaatctcactccatcacccaggctggagtgcagtggtgtgatctcagctcactgcaacctccgcctcccgggttcaagcaattcttgtgcctcagcytcttgagtagctggaattacaggtgtgtgccaccacacccagccaatttttgtatttttagtagagacggggtttcaccatgttggtcaggctggtctcaagctcctgacctcaagtgacatgcctgcctcggcctcccaaagtggtggaattacaggtgcaagccattggcacctggctagggaccttcttatttctatggataagtggaacaagttagaagtgaggttctgctgaatttgtgtggtttgatcctggtacatggttcttgcctttagtcattcacggaatgggaagaat

SEQ ID NO: 35512 - DNA, 601 bp, Human
acacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggtygggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggagga

SEQ ID NO: 35513 - DNA, 601 bp, Human
acctggctgtttatgtagtttctcaggtgcacttttatacttcccttcgtttgcatgtgttacttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtcygtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatg

SEQ ID NO: 35514 - DNA, 601 bp, Human
gtcaagtgctgacaacacaataatctttgttgttatatttaaaagggcaaacaattccatgtcatgcattttacatattatgcatttattgccaataggaattccatgtttaataagatggtaaacctagaccttgaacaaaatcaaatgtagcagtctttcttacctattctcatataaaattagaaaatcattgtagatctttttagtagttaggctacaagtatctgtattgtctacatttaacattttttaatgggtgtatatattattttttagggacttcattgatggaaatgtwgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaaggtttgtcttcttgtggtttggggtgtgagctcagtgtgggtgagtcagcttactgtccacctgaaggattagaaagagaatgtgtgtgataagaggacagttgtccaagtcagacagccaggttccagg

SEQ ID NO: 35515 - DNA, 601 bp, Human
atatgtgaacaactgattttgataaagatacaaaggcatctttttcagtagagaaaagatggtcttttagaaaaatgttggctgaaacaattggatatacaaaaccaaaaaaagaatctcaattcatacctcactatgtataatatataaatatgaatttaaaatgaggccaggcacgttggctcatgccagtaatcccagcattttgggaggccgaggcaggaggatcacttgagcccaggagtttgagaccagcctaggcaacatagaaagaacctgtctctgccaaaaaaaaaaaaaaataataaaaatagccaggttgggaagctgaggtgggagaattgtttgagccagggagattgaggctgcagtgagccataatgataccattgcactccagccagggtgacagagtgagaccctgtttcaaaaaaatatatatatatatatacatatttattttatatttatatataggaccataaacatatatgtaaaacctaaatataaaacttctagaagaaaacataaaacatagcagaaaacttttgtgaccttggagtgggcaaaaattcttggtatgacaccaaaagcatgatcc

SEQ ID NO: 35516 - DNA, 601 bp, Human
acgccaatcggaagatctagccattccactcctaggtattatatttattcaagagaaatgaaagcatatttctacacagtatatatgctaatgttcatgacagccttatttgtaatagccaaaaactagaaatgacccaaattgtctatcacctggtaaatagataaacaaattgtggtatatccacactgtagaatactactcagcaataagaagggaatgaagtattgatatacacaacatggatgaatctcaaagtaactacgttgagtgaaagaagccagaccaaaagcaagtccamactgtatgactccctttatgtactacaatacatgctcatgcatgtctgctatatggacagatcctactgtacacacaattgttttctactctctcgattgtcacagctccatttttatcagatttttggaattctgaatgttatccatgtttttaatccatgatttttataaaacttcaatttagtgagtcagtttttgaaaaaagtctccacttagaaagctgataataagattctgaaaatgagttgagtcttaaattttgtgaagatttataatcatttatactttccataactgta

SEQ ID NO: 35517 - DNA, 601 bp, Human
ttcatgacagccttatttgtaatagccaaaaactagaaatgacccaaattgtctatcacctggtaaatagataaacaaattgtggtatatccacactgtagaatactactcagcaataagaagggaatgaagtattgatatacacaacatggatgaatctcaaagtaactacgttgagtgaaagaagccagaccaaaagcaagtccacactgtatgactccctttatgtactacaatacatgctcatgcatgtctgctatatggacagatcctactgtacacacaattgttttctactctytcgattgtcacagctccatttttatcagatttttggaattctgaatgttatccatgtttttaatccatgatttttataaaacttcaatttagtgagtcagtttttgaaaaaagtctccacttagaaagctgataataagattctgaaaatgagttgagtcttaaattttgtgaagatttataatcatttatactttccataactgtatgttgtgaaaggataacactgttcctcagtcatctcctgtgtgtgcttgtatatttgacagtctgacttactctctgtggtagggttttagca

SEQ ID NO: 35518 - DNA, 601 bp, Human
tggctcatgtgagcctatttttcccctggcagaaagctgctgagaaatatccccaatgggactatgtgtcccttaactgccctgtgtagccatgggtggcatttataccaactgtgtgactctcttacagacctttaacgatcatagaacatcagtcctgtaaagatacttaacagccacgtgccatttgctgcttgaatcccctcctcacatgctggccagatagcttcccaagccctcttgatcacctctgtaatggaattgtccctgtgggctgtcttctactttcttttgacctggmatctgtctcatgtccatgcaggttctctgggacactatttgttgtttaatgactaatcaagattattctttattaagatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaa

SEQ ID NO: 35519 - DNA, 601 bp, Human
ctctagacggttgttttttaagatggcatcttgctttgtctcccatgctagattgagtggcgcaatctcagctcactgcagcctctgcttcctgggttcaagcgattctcatgcctcagcctcctgagtagctgggactacaggtgtgcgccaccacgcccgactaatttttgtatttttagtagagatggggtttcaccaggttgaccaggctagtcctgaactcctgacctcaggtgatccacctgcctcagcctcccaaggtgctgggattacaggcatgagctaccgtgcctggctyatagagagtttatttttatttttattttcaagacagagttttgctctgtcgcccagtctggagtgcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgc

SEQ ID NO: 35520 - DNA, 601 bp, Human
taccccttgagcaagaaaagatggtccgggggaaacctttgatatcacataatgtagccaggcagagagtattaaaccagttcatgcctggactggtagagtctctaatccttgatatctctggtgtcctttagagcatctgggccatccctgaactctagtcgggctgctgtagccactcatttggccctgctatacttagtcttttgggtgaccccacgtggccattctagtttcatctgtgcttccaatcccctgatgccccacatatacccaccatttaattcaagaaaaaataacyaaaaaaaaattatttaaagaccacaagcccttagtgattttgcctttgcaaatttggtaaggcaattagcagtaggtataaatttcatatttcactaagctctatatggggtagagccacatagagtagtctcaggcatcaaatgcagttggtaacactttaagaaacctctaggctgggtgcggtgctgcattcctgtaatcccagcactttaggaggccaagataggtggatcgcttgagctcaggagttcaagaccagcctgggaaacatgccgagaccccgtctctactaaaaata

SEQ ID NO: 35521 - DNA, 601 bp, Human
aggacatagcaaaggacaacagcaggacttgcgggctaatctatctttaccacagagcagtatattttaatggtggagccacaaggagctttcaaggacagttgcctctttaatgtgcccaaggtgggcaagtgacttacctagttcacacagctaattagcagcagggccattagcagcagggccatctgaatatgattatcttaacaccatctgtggtggacccagtcaggtaaaggccaaaatcatcatgggccttagggcagggttcgaggaggagtgtgagaggcactgggcattgaatagggaagctttggggatgagacagcccagagtagtgagagaagagtagagtgcacaagggcttaaaagccagcttcaattaccagctcaaggtggcagccagagttatttagttgctttaaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttga

SEQ ID NO: 35522 - DNA, 601 bp, Human
gcttaaaagccagcttcaattaccagctcaaggtggcagccagagttatttagttgctttaaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagwcagttactgacactgatgccatccctgctcacaggatagatgttacagattttttttttaaactagaacttttaattggaggatcttgaattttagcagttttaagaataaccgtttaattttttctctcagaattttgtacactggttcatcttaaaacatttttccaaagaggtaactcaaatatgtcatttacctataagccatcatgccatcacttagttaagactgtttttactgtttcaagaatttgatttatccttccttttgtcttactgtaggaaaagaatgcctcagcca

SEQ ID NO: 35523 - DNA, 601 bp, Human
taaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagattttttttttaaactagaacttttaattggaggatcttgaattttagcagttttaagaataaccgtttaattttttctctcagaattttgtacactggttcatcttaaaacatttttccaaagaggtaactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactg

SEQ ID NO: 35524 - DNA, 601 bp, Human
taaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagattttttttttaaactagaacttttaattggaggatcttgaattttagcagttttaagaataaccgtttaattttttctctcagaattttgtacaytggttcatcttaaaacatttttccaaagaggtaactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcc

SEQ ID NO: 35525 - DNA, 601 bp, Human
cgcccgctgagtccgcaaaatataggatggcctcgggttttagatgaacccaaagctaagatttcttccctctctggaattagcaagcagcccgccctgcccaactcccctggaagcgcgcgtgctcgccaggcctcgggacgcctgcgcgggcgcccttgcactggcaccagggctccggggtaggggcgcaccgatctgcccaagcctctgcaggcactggaggaaggcgagccctccacccgctcaacaggccccagtgccggcctttccttccagtctcaactccacccgggggccygggggctccacagttaaaaactccacgccacggagatcgcaggtaagctgctggctcaacgaggtgtgctaaatgggattaaagatcctggaccgtggccaggcgcggcggctcaagcctgtaatcccagcgatcagggaggccgccgcgggaggattgcttgagcccaggagtttgagaccagcttgggcaacatagcgagacaccgtctctacaaaaaaataacaaatagtggggcgtgatggcgcgcgcctgtagtctcagctacttgggcggtcgagatgggaggatcgatcgagt

SEQ ID NO: 35526 - DNA, 601 bp, Human
aaaattagccaggtgtggtggccggcgcctgtacgcagcaggctgacacgggaagaaggcttgagctcaggagttggaggctgcagtgagctatgatcgtgccactgcactccagtctgggcaacagagcaagaccacgaaaaagaaaagtcatacaagagctctattcctaaaagtcaaagaaaacgcctgcaactttttatcactgcagcaccaaactaatcaggaggaaaaggaagtcatctggtttcctactgggtttgccaagccctccgcccgtgatctcatctactattcaccscaagcctccaagattgtctagatggaaattaaggcacgggagctagatgactctcaatgcagcacaattaataacgggtggaagcaggatgtgaacacggatctggccccagtccaagcgccttctccatcgcatgcaatcagttacagttataaaatcgatggagggcagattctctctaagcctgacgctaagtcccgaagcagggggccagggccttcggaggggaactgggcttccacggagcagagaagagagtgaccatccatcccacgctcccatgcccgctttggcgccact

SEQ ID NO: 35527 - DNA, 601 bp, Human
aatatttgcatttacaaatgatataagaaaacttcatggatgatcaaataatctaaaactgggttgtggtgatggttaatgcaactctaaaaatttgctaaaaaccactaaattgtacatttacaatcttacagtatgtaaattaaacctaataaagctcaacaaacttttaaaaacacatttagtctttccacctaaagtcaaacacaactgttatttctattagcagtaactaatttctcactggtttcctgccacacgtccccctcttcaccttcatttccagtcatgatcacgccaygctcccagagtcaaacaccgatcttttttggctcctcttgtcccctccaggtgcccactctgcccggccatcgcatctgcctcaactgccacagctctcatacatgttccttctttcccatctcccctgcagagggccgagctcactccagccagaccagctagaatgaccacctcatcagtcatcctgtgtagacgcgatgtgccacaactccacctcctaatccatcctcacccactgtcaggtgaatctttctaaaattctgctcttatcctatcacttttattgaaaaacccttag

SEQ ID NO: 35528 - DNA, 601 bp, Human
taacccagttaaaaaattggaaatatttgcatttacaaatgatataagaaaacttcatggatgatcaaataatctaaaactgggttgtggtgatggttaatgcaactctaaaaatttgctaaaaaccactaaattgtacatttacaatcttacagtatgtaaattaaacctaataaagctcaacaaacttttaaaaacacatttagtctttccacctaaagtcaaacacaactgttatttctattagcagtaactaatttctcactggtttcctgccacacgtccccctcttcaccttcayttccagtcatgatcacgccatgctcccagagtcaaacaccgatcttttttggctcctcttgtcccctccaggtgcccactctgcccggccatcgcatctgcctcaactgccacagctctcatacatgttccttctttcccatctcccctgcagagggccgagctcactccagccagaccagctagaatgaccacctcatcagtcatcctgtgtagacgcgatgtgccacaactccacctcctaatccatcctcacccactgtcaggtgaatctttctaaaattctgctcttatcctatca

SEQ ID NO: 35529 - DNA, 601 bp, Human
gtcatcaatatcacggcaagaccctctaccagcaaaaaattgtaacttgctgaaggctcagatgatcattagcatttttagcaataatgaattttctaattaaagtttgtacattttttagacataatgctattgtacatacaacagactacagtatagtgtaaacataatttgtatatgcactgggaaaccaaaaacattcatgtgactcatgtattattgcagtatttgctttactgcagtggtctggaagcaaacaggcaacatctctcaggtgcgcctgcacttactcgtgacaatyccagccagagcgaaaacaaactgactttcatccgaatccagctcctggacatcaccgtctaacgacttcacaaaactctccattgtttgaccagtgatgctgaaaaacttcaaagctttatcctgaaagtttgaaaatcagagtgtcatatctttttacagacactagtgtgaaaacattttaaaagtgcaggatacagaagattctagttttaattgtagaatattgtaaaatctattccctcattaaaagttcccattaaaagaacagagaaagcagcttgaggcatgcaggagcaac

SEQ ID NO: 35530 - DNA, 601 bp, Human
ttttccaccaaccaagagtagcatggtaatatgcagaaatctaacttcctaatatcaagtttagattttagacagcaagggtcgtaatacaactcttctgattttctttattcaaaaataaaagaggcacaaaaaatatagaactaaaatgcccaatgtcatccgaaatagcaggttcaccaaaaggttataaaagtaaacttgcattttggggggattaattacaattactagagagagaatgaattgcttttcaaagaaatgtatctcaagaaaatgctgactaatggggtagatggtyattcaatttccctgttttataggtgaacctacaggtcatggtctgctgagcagcaagaagctgccctaagcaagccctcttccagccagcacagacatggaccacttttccagaaggacaggttctttcatggcctctcctttggcaagcttaaccaaccacctacaagcactctcacttccaagacaaagttatgtgggatacatatcaattcatgtccatctctagtcaatcacattttgccaactctaacacatggtacatggtgatggttttggagtatcaaatgagggatctggg

SEQ ID NO: 35531 - DNA, 601 bp, Human
cacccatgcacaaaaagggagctggaactatcatttcatttatggaatctcaactaactgcatgtgttctaatctattatacaagttgtttttacagcatttgttataagaaaaataggacttctaagtttatagccaaagggcccagaacagtttaaggaagagttttttttccaccaaccaagagtagcatggtaatatgcagaaatctaacttcctaatatcaagtttagattttagacagcaagggtcgtaatacaactcttctgattttctttattcaaaaataaaagaggcacamaaaatatagaactaaaatgcccaatgtcatccgaaatagcaggttcaccaaaaggttataaaagtaaacttgcattttggggggattaattacaattactagagagagaatgaattgcttttcaaagaaatgtatctcaagaaaatgctgactaatggggtagatggttattcaatttccctgttttataggtgaacctacaggtcatggtctgctgagcagcaagaagctgccctaagcaagccctcttccagccagcacagacatggaccacttttccagaaggacaggttctttcat

SEQ ID NO: 35532 - DNA, 601 bp, Human
gttacttaatgaaattctgtttttcttaattcacaaaaatcagaaatatgtcaagtgattagaataaaaacttttttatgttttctggaagaaaaggaaaatgaaggtaggagtaaacatatttgaatatatttatgccagaaaaatgaaaataatttttactataacacatttttattaaaacatgttctttaatgaagcttgctaatttctttgaaatattctgttttgttagaaagcattcaatatttttatttagaaaatccaaaaaacacaatcaaatataaagaacaatttgcartttaagtggatttcaaatgttaaaacactaagattccacaagaaatgcattataataaacataaaatttagaacttataagaatgcagtggactatatctaaaaacaacagctacaagaaatggtaatgaactagaagtgactgctgtttcattatttgatattaaataacaagaattctttagtgatgaagtatttgattcattccatacccattctcaagctaaatatcaaacttgtaccaccaacagctacttagcaatctgcaattgttttattatgattacaattaagaaatatt

SEQ ID NO: 35533 - DNA, 601 bp, Human
tgtcttaacaccatctgctatttttccagatgaccaaaacctttataaagtcagatgaggtttgttttatgcttcaggggaccctctttgaagagtgagttattttgttagatgacttaagctcactctattccataaagtgcatttgtgtttatcagaaatatttgatcttgagagtggccctccatcctgtggaccctttcaagatcaaagaatcactaaatctgggggctagaaaccattccaagaggttatctagtgcagacctttgtaatcgctgcctcgcagaggagagagcacytaagccatccttaacagattacctgtcaagtttctaaagttttccagaaaaggagccaacacaatcttccattgcagctttctttttgcgatctcctaaggcaacgagtaaaatgccacacttctttctgtgccttcctgcacactggtttcagttgctacttggagctatccttcagtctctacccatgacaatacctgtgtggtgccttgtcaagaatccacctgccttttccctcttactcttgaggagcaaagccacctcacctcccaagctggctaaaagctctcagcatgcccc

SEQ ID NO: 35534 - DNA, 601 bp, Human
accacttcctccctaatttccttatgtgaagtactgttttcttggtcaataagccccataatttacaaaatatacagatcctattcagttgaaagaaacatgcatatgtgttcaccaaacaaaatattttctcaatattctatttcttattgtatataaacaaaaataaactaagcaaaaaataaaactctcctaatactttaagaatttgtttttttaattttgtatgtcttgcaaattaaaagatgattaatttatacattatatgtctaagaagtaggagaattaatgagattagcamaatactggataaatattattcataaaaaatgtattaaatacataaaacataataattatttagaaatttctcagtcctttttataattttgaaagcttcctggtattacacaactgatggatggggttatagcatgtgttgcttcttaataatagctcttcataataagatcatgagatatctatacgtagagtatttttaaatcatcattctttttattctaaacatttttaaaatgttaaatattttaaactagttactatgtttaaaataaattctacaaatgcttaactacattat

SEQ ID NO: 35535 - DNA, 601 bp, Human
tttcatttggttaaaaaaaagaaacgttctatattttctatcttgactcttaaagcttatccaataaattcctcacagtactttttctatgtgaagttgggagataaatagttttgtctagtaaatatataaaacagatcactgaagaatttaaagaactttgtgtatctcagttggttattttttattacagatttttggtaatcaatcatatttatcctcctataaatcatatttaaaccaggtaaactttatgagaaattatatgtaaacctcaaaattattgatgggctctttttaraaaacagcaacagcaaccaaactcagctaccacccaccgttcccctgagtaaagcaaaggaaataaaatcattccaatccacatcttattctactcacagatattttctaagttattcacactgaaatgagactattcttccaatgcttataccagaatcagtgcttacccgtgagagaaacaaatctgttggaagacttggttactgaatattggaagaaggggaatttcaggcattttcccgtccccctgtcacagatgcctgactggcagttgcaggtctctctgcaatccatcccg

SEQ ID NO: 35536 - DNA, 601 bp, Human
gtaaaattagaaaacaagcacctttgccaaatagtttatattttattaacttgaaatgcaaaagaccaaaagcaaaaactaaataaaatggacttgaattgttatttatagttgtggtgggaaaaagtatatcatttgttgatactagccatctctgtgactatatgttgggcttattatttatttattttttataattttaaatacagtttttaattgacaaataataattgtatacatttagggtacaatatgatactttgatatatatctccactgtggaatgatgaactcaaactargtagcatatccatcacctcatatacttattttttgtgatgggaacatttaaaatttattattttaccaattttgaaatatataagaattattaactacaatcgccattctgtgcaatggaggcctaagctttagtgatgtatgttgctttaaatgagctactttcagtttaatggaactctcctgtactggccagctattcaacaaaataaacaaatatgtacatagcaccatctcataggttgtgtattcctcacattctaacacctgtataagaaatacacacggactaacaagcagc

SEQ ID NO: 35537 - DNA, 601 bp, Human
gcagacgaatgtgtgtaagtccatgaaacattccagatcttactcccccaagaccctcgtacacaaaaacttacttgtgaattcccaacttgggaagctcactgccaaaaaaaagaacaccaagtggaacactgtggacaggaagcacatttgacaagagtgctgtagccagcaggtggaaagttggagaagacaagctcgtgctctgggggtcctagtgctggtgaagcttgcagccatttagcctgctctcaaaggctgggcccaaacaggtttgtgcagaggtgatgtgaagcctgtrtcaggagtgaagcccaagccttctcctgtaaactccagtgcatgaacctggaagtctcatgtagtctcaaagacacatgtagactacaaagaaccctaggcagcctccccaagaggtccttagggttttctgctctccatcctgaacctgactaaggtttaccaagatcacactaaaaatcatcttttgctggttgcacctttagctaatgaaaggaaataccctaggtcagaaaagagagaaactgactgcttttttcaaatatttctgataagaatctcaatgcctaactttgatgtg

SEQ ID NO: 35538 - DNA, 601 bp, Human
ttggtcttcaaaaattacatgtccttatgctataatctagaaagttcctaaaatgttggctgtgtgttgaacaatcacgaaaatagagccttctctcagaaatcacagccgggatcagcgtggatttaaccatttcctcattacgggagacccggcagcattctctttcacaacttcttctctcacaatattgccatctccagatgccatgtcatgctctgaaagtagacggaatacaaatcatgtccaaacatctatagctcaaagacaacacagttttgctttatttttgttttacatrgaatttacaatgaaatctttaatcaatttaagattccatgctaactgtattcactgctctatatcagtgagcacctctatatacaatagcaccccttgaattacttatctttgtatacctatcgtcacctgacattatcttctacatgtatttgtctttttttcctgtgtattatttcactccaccactagaattccagtttcacaaaggtagggactttattttgctcactgctatatctccagcacttaggacagtgcttgccacatagtaggcacttaataaatacttatggaatag

SEQ ID NO: 35539 - DNA, 601 bp, Human
gttactcaaatttccataagcttcaaacatcttacttccttcaggggttttctggttgttttattttgacttttcccaaagccaaaaaaaaaaaaaaaagcacaattaaattctagagaagctacctaccaaggaagggctaaatattttatttcccactcccaccccctccccatcttctcctgctcttaagtcttcattccatatcccaacattaatgtacatcaaagtcaaagaactaatttgactcactgcggtcttcagctttgcctagctccctctttggttgacctgtctccaygtaagattacctaaattgcatttttagttcttcagtgttactatacacacacatttaacaaatctacatgcattcgaatatttaacaaacacatacaagtgttcagtcatatggatgttatggattgtaagtatcctactttttgttttctggatccaccatgcatcacatttggtcttcaaaaattacatgtccttatgctataatctagaaagttcctaaaatgttggctgtgtgttgaacaatcacgaaaatagagccttctctcagaaatcacagccgggatcagcgtggatttaa

SEQ ID NO: 35540 - DNA, 601 bp, Human
tcttaaataagttcttcacttcaaataaaatacttctgagatatttcctaagaacatctagtacaacagtcctgtttgtgctaagattctttcaaatatactcctaattccacttatcaaccaagtttaaaagaaaaaaatatgaaaataaactatattttaaagttgacatgttttctgctgaaaattgattcttcttttacaaacctcctaaaaacttattttctaccttaaattgaaaattcacctaagtcacagcacttatgtttaaataaggaccctctgttgctcattttttgayatttttgaaatccagagtgactctgtttttcttatgcttattaaggttattattactataattatggataataaatttatcatgcctcagatgtttgaaaaccttatagagtcatagttttattctaaccattttcaacaaataatactagatttctttcctcaagaggatgataaatatgggtagggaagatgacttgcactaacacatttatttataaaaatatataaatatttaccttcatacacacacaaaccaccagtgggtaaaatacttcttagatttatctctgaggtggca

SEQ ID NO: 35541 - DNA, 601 bp, Human
ggaggagcggcagggggcggggaggcagctgcccatatggtgaaccctggtcctgctcatgcagctggatggtccctgcagccagaggcagagggagatcccagccagatctgaccaggcccagccccgcccacataggggaggccccagcctcgtccctccctgggggtgtacctccaagtacctcttgtcagctgcagtgcccctcggccctaagagtgcttggcccagcagaggtgccttcaccttcttgcttcccaagcagtggcctggccggaactccaggcctcccccgcccccsaccctcgctgccagccccatgtctccgcccaggatctgggcggagcgtaccgcccaccactgcggcttctaggccagcttagttggggcttctaggccagccctgtgggcagctccctctgagggcggcagagcagggttgtgaaccccatgccccattacccgtaggcgacctggcagtcacccttccgctccaaccctcatttcctcgtctctgaaacaggcgcctcagggttgctgcagtagacccaggcaccacctgcctgctggagccgcccgagctccccgcgcccagaaggag

SEQ ID NO: 35542 - DNA, 601 bp, Human
atgtacagctaccgcatgtgcacccagaggaccagccatcacatgctgcctagtaacctcttcctctctttccacccacttatgaataattgtggaagactccctgaaagggggtttctccaacaatcatcaatgctgcctcacactcaggagcagccccccgcctggaatcctctctctcccagggtgcatccgcacctaactttcaaaatgttctttttcttttgcaataaattgctctatgttgcagctcttttgctgtgtgtctcatgtttaaattctgttttgttgttgttgttgttgtttgtttgtttgtttgttttgagaaagagtcccactctgtcttccaggctggagtgcagtggcatgatcttggctcactgcaacctctgcctcctgggttcaagcgattctcccacctcagcctctcgagtagctgggattataggtgcatgccaccatgcctggctaatttttgtatctttagtagagacagggtttcaccatgttggccaggctggtctcgaactcctgacctcaggtgatccgcctgcctcggcctcccaaagtgctgggattacaggcatgagccactgtgccc

SEQ ID NO: 35543 - DNA, 601 bp, Human
tgacccaccccgactccctcctccttcaggaaaccctcccagatctgcccagccagaaaaatccaataacaatgagaatgcaagagggagccctccttctcaggagagaaggcgctgatgaagacggatgtctccttgggtgcaggcgaggcaggacaggcagtcaaaggagtcaccatgtcctggggacgcagcaaccgtggtgactgcaatccacacaatcagcctccacgtttgcactgtaactgagctcgtgttaactgagctcgttcaagcaaagctgtctgcagtagggcctttyccctggagagggcatgtgcacattgattttacctgtcctcaaactgaccctttgctcattctaatagtaaaaaaacacacccctcggtggagattttaagatgctaatgaggccgggctctgtggctcatgcctgtaatcccagcacttggggaggccgaggcaggcggatcacctgaggtcaggagtttgagaccagcctgaccaacatggagaaaccccatctctactaaaaatacaacattagccgggggtggtggtgcatgcctgtaatcccagctactctggaggctgagacagg

SEQ ID NO: 35544 - DNA, 601 bp, Human
ggcccctcccaaacccagacaagaggggttgccccctcatcagccccaaagctcggtgggactaaggcggaagctgatgaaggatgtggtgtcccggctctgctcccttggggccacctgggattgcagagtaggggctcagaagccgggttaacaggccttcctcccctctgctccttcccagctgacccaccccgactccctcctccttcaggaaaccctcccagatctgcccagccagaaaaatccaataacaatgagaatgcaagagggagccctccttctcaggagagaaggcgcygatgaagacggatgtctccttgggtgcaggcgaggcaggacaggcagtcaaaggagtcaccatgtcctggggacgcagcaaccgtggtgactgcaatccacacaatcagcctccacgtttgcactgtaactgagctcgtgttaactgagctcgttcaagcaaagctgtctgcagtagggcctttcccctggagagggcatgtgcacattgattttacctgtcctcaaactgaccctttgctcattctaatagtaaaaaaacacacccctcggtggagattttaagatgctaatgaggccg

SEQ ID NO: 35545 - DNA, 601 bp, Human
cattcattcattcactcattcattcattcattcattctgtgtgtatgtattaagggcctggtatgcagcaggctctgtcagtgcccgggggcaaccttggtgaggataggtctctgccagcccacagaaaagacagggagcgccaagctctgggtagaagtgggggtcggggccacaaggggaggtagagaagagggggtgacgtggctggcagagatccaaagtgagacctgaggaaagtgggctgccccgtgaggccgggcagggaggatggggaggggactgaggacagaggaccaayagctggaaaggaggggctccggtctcagggacactcacccccagatcacagacagcgagaggctggggctgggcgggggccgtcccgccagccttgagagccctttcggagctcaagatgctcctgaggggccaagcagccctgctgccccacaggtctgtgctggggcagaccccaggtcctgcggggtggggatgggacctgggaggcaggagtgcccagagaaggcggtggtagtggcacagcagggcagggagggggttgtgttgagggatggagacacttgcgctcccagacaga

SEQ ID NO: 35546 - DNA, 601 bp, Human
attcattcattcattcactcattcattcattcactcattcattcattcactcattcattcattcactcattcattcactcattcattcattcactcattcattcattcattcactcattcattcattcattcattctgtgtgtatgtattaagggcctggtatgcagcaggctctgtcagtgcccgggggcaaccttggtgaggataggtctctgccagcccacagaaaagacagggagcgccaagctctgggtagaagtgggggtcggggccacaaggggaggtagagaagagggggtgrcgtggctggcagagatccaaagtgagacctgaggaaagtgggctgccccgtgaggccgggcagggaggatggggaggggactgaggacagaggaccaacagctggaaaggaggggctccggtctcagggacactcacccccagatcacagacagcgagaggctggggctgggcgggggccgtcccgccagccttgagagccctttcggagctcaagatgctcctgaggggccaagcagccctgctgccccacaggtctgtgctggggcagaccccaggtcctgcggggtggggatgggac

SEQ ID NO: 35547 - DNA, 601 bp, Human
tcactcattcattcattcattcactcattcattcattcactcattcattcattcactcattcattcattcactcattcattcactcattcattcattcactcattcattcattcattcactcattcattcattcattcattctgtgtgtatgtattaagggcctggtatgcagcaggctctgtcagtgcccgggggcaaccttggtgaggataggtctctgccagcccacagaaaagacagggagcgccaagctctgggtagaagtgggggtcggggccacaaggggaggtagagaagagkgggtgacgtggctggcagagatccaaagtgagacctgaggaaagtgggctgccccgtgaggccgggcagggaggatggggaggggactgaggacagaggaccaacagctggaaaggaggggctccggtctcagggacactcacccccagatcacagacagcgagaggctggggctgggcgggggccgtcccgccagccttgagagccctttcggagctcaagatgctcctgaggggccaagcagccctgctgccccacaggtctgtgctggggcagaccccaggtcctgcggggtgggga

SEQ ID NO: 35548 - DNA, 601 bp, Human
gagggtgggcagcagccacacgtagggctcggctcagtgaggccatgggggctccaggcctcagcaaaacagggagctggggagagaatcagagctgggtggggtgcagaggggacacgctgggggctgtgctgagtacccagggaaataagggccctatggtgttacctcccagggccttcctcttgccacttccccatggcattcattcattcactcattcattcattcattcactcattcattcattcactcattcattcattcactcattcattcattcactcattcattcactcaytcattcattcactcattcattcattcattcactcattcattcattcattcattctgtgtgtatgtattaagggcctggtatgcagcaggctctgtcagtgcccgggggcaaccttggtgaggataggtctctgccagcccacagaaaagacagggagcgccaagctctgggtagaagtgggggtcggggccacaaggggaggtagagaagagggggtgacgtggctggcagagatccaaagtgagacctgaggaaagtgggctgccccgtgaggccgggcagggaggatggggaggggac

SEQ ID NO: 35549 - DNA, 601 bp, Human
tggcgagggtgggcagcagccacacgtagggctcggctcagtgaggccatgggggctccaggcctcagcaaaacagggagctggggagagaatcagagctgggtggggtgcagaggggacacgctgggggctgtgctgagtacccagggaaataagggccctatggtgttacctcccagggccttcctcttgccacttccccatggcattcattcattcactcattcattcattcattcactcattcattcattcactcattcattcattcactcattcattcattcactcattcattcaytcattcattcattcactcattcattcattcattcactcattcattcattcattcattctgtgtgtatgtattaagggcctggtatgcagcaggctctgtcagtgcccgggggcaaccttggtgaggataggtctctgccagcccacagaaaagacagggagcgccaagctctgggtagaagtgggggtcggggccacaaggggaggtagagaagagggggtgacgtggctggcagagatccaaagtgagacctgaggaaagtgggctgccccgtgaggccgggcagggaggatggggagg

SEQ ID NO: 35550 - DNA, 601 bp, Human
gccccgggtagggctctggcgagggtgggcagcagccacacgtagggctcggctcagtgaggccatgggggctccaggcctcagcaaaacagggagctggggagagaatcagagctgggtggggtgcagaggggacacgctgggggctgtgctgagtacccagggaaataagggccctatggtgttacctcccagggccttcctcttgccacttccccatggcattcattcattcactcattcattcattcattcactcattcattcattcactcattcattcattcactcattcattcaytcactcattcattcactcattcattcattcactcattcattcattcattcactcattcattcattcattcattctgtgtgtatgtattaagggcctggtatgcagcaggctctgtcagtgcccgggggcaaccttggtgaggataggtctctgccagcccacagaaaagacagggagcgccaagctctgggtagaagtgggggtcggggccacaaggggaggtagagaagagggggtgacgtggctggcagagatccaaagtgagacctgaggaaagtgggctgccccgtgaggccgggc

SEQ ID NO: 35551 - DNA, 601 bp, Human
ggatgccctccagcagctgaatgtgagaggtggcaggccaggggtgtggctggcgaaacgtcagggaagaggctatgacagcccagctagggggccagtgagaaggcaagagcaagagttggagcagtggcttgtgggagccggctcgcatcagctctcaggagcccagggataaacctcttcccaactccacagtcagtgacctcacactggtggcttttgctattggccagggtgggagtgttcacaccacaggaactggccaacactgcaggtcaggagatccagtttgccaggacayccatggctgaaatggtgaaggcagaaggttggctgtcctgggacatgcacaccataggtgcttaatatatgccccctggttagttaggagaatgagaactgtagaagcctctggtgctcatggaggacacaggtctgcttcaccctcaatggtccccgtccgtccttctccactccctggaatgccctcagtcctggtggctctgtccaggaaaggggcttctgccctctggacagctgcctggagtttccagctctggccccagcttcactctccaggccacacaagcagcatctgctc

SEQ ID NO: 35552 - DNA, 601 bp, Human
tggacgcgatgaagaggcccccattctggatccagcccgtgtgtagtcccgtctcctcctccagctcccggctcaccacccgccgagtgtgggccagaagctccacctccacgtcactgggccgcagctgccacagcaggcctgcccgggagggtgggtgccatcactccccagggagtggactgcacctccttcccccagacgaatatcaggggataccctgatattcaaccatgggtgtctttctctgcaaggtctttctctgcaggacctggggggcctggagaggttgttgagcagraaataactggaccaagatgaatgtgagggaggtcccgcccttgggcagctcagagagtgacatagcaaaggcccccatttttggagcacctactgtgtgccaagccccgtgctaagcctgtcatgccctatgaggagggcgtgattctcttatagatcaagttcaagtggcaccaacagttctgtggccaagatcacagagcaggtgagtggagggggcgccgagacaccaacccactactgaatgaagcttaaatctgcactctccccaacaaaggatgccctccagcagctgaatgtg

SEQ ID NO: 35553 - DNA, 601 bp, Human
ccctggcgagggtggtacaggtgccagcggggtccatggtaccgtcgtgcggcacatacagggtcccgtagaggtcgtccacattcatcagcgggtacagagtcttggtctctgccgggctcagcacatgggattccacaccatacgccttgcccagctagggggacccaggggaggttaactgagtccgtggggagcagacccctgggccactcccctccccaactgggcatccaccgcaaaccccagcctcactttctcccagaagccttagccggtccccacgcccccggagcctgtyccttgaatccgcttcagcataagagttaaggagcagggcactgaggcaggctccggggccaggccgcctgtgccaatccgaccctcgccagctgtgtgaccaacctggggcaaagtcgcttcaggctcactcaggtgaagtgggggtgagaatagtgtatgtcattgacaaagaacttagaccagtgcctggcacaaagtgtctattatataagataaataaccccacaggtctaatactttgggcctgagaggtttcccagtcagaccagctgtcaagagaggccaagatcctgtttca

SEQ ID NO: 35554 - DNA, 601 bp, Human
tcaaacaaacaaacaaaaaaattgttctacaatgatgtgcggagttgagacaaacacagatacaaattataagaagggcttttgatacgatttgcttgtgcagcagaggaatgggtgcacccacggcacgacctgatgtctgtgaacagaacgaaggcatagcctccccttggcaggagtggaccagaaggctcagagaggtcctcactggcccaaagtcacacagcagtcagagaatggctcttgttctcttcccttctgctctcagggttctaaggcaggaggagtgggctgggaacargggacccagagccaggcggccatcagtacctgtgctcctcgggcagaagctgccctggcgagggtggtacaggtgccagcggggtccatggtaccgtcgtgcggcacatacagggtcccgtagaggtcgtccacattcatcagcgggtacagagtcttggtctctgccgggctcagcacatgggattccacaccatacgccttgcccagctagggggacccaggggaggttaactgagtccgtggggagcagacccctgggccactcccctccccaactgggcatccaccgcaaacccca

SEQ ID NO: 35555 - DNA, 601 bp, Human
cggatgaccacagcgccagaaaactagacccacccatgccttgacttggagaacttgaaagttgggcaagttctttcacttgacttgtggggggaaccctcttttcataacgtgaaaaagtagctgacttttttttttttaaaaaaaagcaagatatttgattaacagaaagatgtttgcagtctactgcttggtaaaaaaaaaaaatcacaaaataacaacagcttggttctattttgcatacatatatattttcatagaaaaatatttggagtaaaacatactaaaatgtcaatactagtactgctgggtgatcttgacttcttttttgcttatttgtcttcttaaaattgttctacaggccgggggtggtggtttacgcctgtaatcccaggactttgggaggccgaggccggtggatcacgaggtcaggagatcaagaccatcctggctaacacagtgaaaccctgtctctactaaaaatacaaaaaattagacgggagtggtggcgggtgcctgtagtcccagctactcaggaggctgaggcaggagaatggcatgaacccgggaggcagagcttgcagtgagcagagatcatgcc

SEQ ID NO: 35556 - DNA, 601 bp, Human
cagttctcaatgacctggaattgagaggaactgcttctaaaatcccacgggactccccgggggtgcttcccaccccactccaaccaacccctcctcccagaggggagctggggacactatttctgccagcagcaggtcccctgcgacactgtcagggaaaccggatgaccacagcgccagaaaactagacccacccatgccttgacttggagaacttgaaagttgggcaagttctttcacttgacttgtggggggaaccctcttttcataacgtgaaaaagtagctgactttttttttttwaaaaaaaagcaagatatttgattaacagaaagatgtttgcagtctactgcttggtaaaaaaaaaaaatcacaaaataacaacagcttggttctattttgcatacatatatattttcatagaaaaatatttggagtaaaacatactaaaatgtcaatactattactgctgggtgatcttgacttcttttttgcttatttgtcttcttaaaattgttctacaggccgggggtggtggtttacgcctgtaatcccaggactttgggaggccgaggccggtggatcacgaggtcaggagatcaa

SEQ ID NO: 35557 - DNA, 601 bp, Human
gcagttctcaatgacctggaattgagaggaactgcttctaaaatcccacgggactccccgggggtgcttcccaccccactccaaccaacccctcctcccagaggggagctggggacactatttctgccagcagcaggtcccctgcgacactgtcagggaaaccggatgaccacagcgccagaaaactagacccacccatgccttgacttggagaacttgaaagttgggcaagttctttcacttgacttgtggggggaaccctcttttcataacgtgaaaaagtagctgacttttttttttwtaaaaaaaagcaagatatttgattaacagaaagatgtttgcagtctactgcttggtaaaaaaaaaaaatcacaaaataacaacagcttggttctattttgcatacatatatattttcatagaaaaatatttggagtaaaacatactaaaatgtcaatactattactgctgggtgatcttgacttcttttttgcttatttgtcttcttaaaattgttctacaggccgggggtggtggtttacgcctgtaatcccaggactttgggaggccgaggccggtggatcacgaggtcaggagatca

SEQ ID NO: 35558 - DNA, 601 bp, Human
cctgagcagacagaaatgggctgcacaggtgccatgcgcccaggagagggccccctggcttgttctgtggcccatccaagggtcagaccacagcaggtgggcaggtcagggccagcggcctggctccttcctcagattcacaccaactgcctagctgcagcctctggaagggacaacttccagacacctgcacatggccaggtgtcagaggaacatgaggggctttgtgcgaagccccagatctccacttttctcctaccaggtctcagagctgctggggctgatggcccttttcctgtgcctccggtaccagaggcacgctgggatctggactggctttgtaagtaacaccccctagcttcgcttgaatcttgacatacacaggagggggcagctgcagggacctaggccaactctgccttgcttcttccctggaaaggcacctcaaaggcaggccttgggaggaattagggatggaggatggagccacagtcctgggctcggtggacattctgtggccaccctccctgacgccccaggacacagctctgcccgccctcccagaacccactgagacctgagcgtgacccctggcggccac

SEQ ID NO: 35559 - DNA, 601 bp, Human
cagcacagcctgaggcagtagggatggttatgacccattttgcaggaaagggaaccagagcggtgacagacttggccagcctgggtaatggaggagtcagtgtttaaacccagcacccaggctcttacccacagctctgcccacggatggagcagccgctccttgccactgcaaaagtacgccagagcacgactgtgaaaccccctaacagcgcccgagccacctgctttaatgatagctcagagagggaagagatgagccctagccacaaaggaagctgtgggcagagctctctaggacmcaggcctgggacagatcctcagaaaagggaggtccttggggccacacagccctccagccacccaagaagaaagatgaaccacacgtgagacctgagccctcacctgccagctggagcccccaggccccaatgtgtgtggctgtgtctgatcagggtggacagcgtcctgctgcacgaggctgccacgcccagggagcttcctgagcagacagaaatgggctgcacaggtgccatgcgcccaggagagggccccctggcttgttctgtggcccatccaagggtcagaccacagcaggtggg

SEQ ID NO: 35560 - DNA, 601 bp, Human
agcggagtgcccagttcagcatcagcgtccagtggagccctggcctttctctccaggcagcagcctcctgctctggctgtccccagtctggccctggtgccactgactccctgcctcctgacctcagcccatgccttccatctgcctctttcttccatctgatccctgcctgattgctcctgccctccgtgttctcttcctccgaagcgccagctggtgacgacttcacaaccctctgtccttgtccttgtcatcacacagctaccacctcatgagcacctgctgtatgccgggcaccackcccagctgcatcactctgtccttcctgcagcacagcctgaggcagtagggatggttatgacccattttgcaggaaagggaaccagagcggtgacagacttggccagcctgggtaatggaggagtcagtgtttaaacccagcacccaggctcttacccacagctctgcccacggatggagcagccgctccttgccactgcaaaagtacgccagagcacgactgtgaaaccccctaacagcgcccgagccacctgctttaatgatagctcagagagggaagagatgagccctagccacaaag

SEQ ID NO: 35561 - DNA, 601 bp, Human
cccaggactttaggagtctgaggcaggaggatcgcttgagcagtttgagaccagcctgggcagcatagcaaaaccccatctctataaaaatacaaaaattagccaggagtggtggcacatgcctgtagtcccagctactcgggaggtggaggtgggaggatcgcttgagcccaggaggtcaaggctgcagtgagctatgatcatgccactgcactccagcctgggaaacagagtgagaccctgtctcaaataataataataataataataataataataataataataataataataatartagtagtagtagtagtagtagttatatccttacctctgctagcactactactctaaaaacaaagccagccccagagttccatagagcaggacagtggggacacctggtggccagggaagcccctgatgtttgtcccagcaggatccatgtctggacttacctgccccttgcacagatcctgctgcctctgagcacccagcggagtgcccagttcagcatcagcgtccagtggagccctggcctttctctccaggcagcagcctcctgctctggctgtccccagtctggccctggtgccac

SEQ ID NO: 35562 - DNA, 601 bp, Human
tgtaatcccaggactttaggagtctgaggcaggaggatcgcttgagcagtttgagaccagcctgggcagcatagcaaaaccccatctctataaaaatacaaaaattagccaggagtggtggcacatgcctgtagtcccagctactcgggaggtggaggtgggaggatcgcttgagcccaggaggtcaaggctgcagtgagctatgatcatgccactgcactccagcctgggaaacagagtgagaccctgtctcaaataataataataataataataataataataataataataataataataatagtagtagtagtagtagtagtagttatatccttacctctgctagcactactactctaaaaacaaagccagccccagagttccatagagcaggacagtggggacacctggtggccagggaagcccctgatgtttgtcccagcaggatccatgtctggacttacctgccccttgcacagatcctgctgcctctgagcacccagcggagtgcccagttcagcatcagcgtccagtggagccctggcctttctctccaggcagcagcctcctgctctggctgtccccagtctggccctgg

SEQ ID NO: 35563 - DNA, 601 bp, Human
cctgtaatcccaggactttaggagtctgaggcaggaggatcgcttgagcagtttgagaccagcctgggcagcatagcaaaaccccatctctataaaaatacaaaaattagccaggagtggtggcacatgcctgtagtcccagctactcgggaggtggaggtgggaggatcgcttgagcccaggaggtcaaggctgcagtgagctatgatcatgccactgcactccagcctgggaaacagagtgagaccctgtctcaaataataataataataataataataataataataataataataataataatagtagtagtagtagtagtagtagttatatccttacctctgctagcactactactctaaaaacaaagccagccccagagttccatagagcaggacagtggggacacctggtggccagggaagcccctgatgtttgtcccagcaggatccatgtctggacttacctgccccttgcacagatcctgctgcctctgagcacccagcggagtgcccagttcagcatcagcgtccagtggagccctggcctttctctccaggcagcagcctcctgctctggctgtccccagtctggccct

SEQ ID NO: 35564 - DNA, 601 bp, Human
cacctgtaatcccaggactttaggagtctgaggcaggaggatcgcttgagcagtttgagaccagcctgggcagcatagcaaaaccccatctctataaaaatacaaaaattagccaggagtggtggcacatgcctgtagtcccagctactcgggaggtggaggtgggaggatcgcttgagcccaggaggtcaaggctgcagtgagctatgatcatgccactgcactccagcctgggaaacagagtgagaccctgtctcaaataataataataataataataataataataataataataataataataatagtagtagtagtagtagtagtagttatatccttacctctgctagcactactactctaaaaacaaagccagccccagagttccatagagcaggacagtggggacacctggtggccagggaagcccctgatgtttgtcccagcaggatccatgtctggacttacctgccccttgcacagatcctgctgcctctgagcacccagcggagtgcccagttcagcatcagcgtccagtggagccctggcctttctctccaggcagcagcctcctgctctggctgtccccagtctggcc

SEQ ID NO: 35565 - DNA, 601 bp, Human
gcactgtttaaaaataatcacagccgggcaaggtggctcacacctgtaatcccaggactttaggagtctgaggcaggaggatcgcttgagcagtttgagaccagcctgggcagcatagcaaaaccccatctctataaaaatacaaaaattagccaggagtggtggcacatgcctgtagtcccagctactcgggaggtggaggtgggaggatcgcttgagcccaggaggtcaaggctgcagtgagctatgatcatgccactgcactccagcctgggaaacagagtgagaccctgtctcaaataataataataataataataataataataataataataataataataatagtagtagtagtagtagtagtagttatatccttacctctgctagcactactactctaaaaacaaagccagccccagagttccatagagcaggacagtggggacacctggtggccagggaagcccctgatgtttgtcccagcaggatccatgtctggacttacctgccccttgcacagatcctgctgcctctgagcacccagcggagtgcccagttcagcatcagcgtccagtggagccctggcctttctctc

SEQ ID NO: 35566 - DNA, 601 bp, Human
gtctcaaaaaaaacaaaacaaacaaacaaacaaacaaaaaagcagtgtttacatcatcataatattgcagagaggaaccactgatttaaccaataaacaagccaaaccaaacaagaccgtttagaaagcaagcaggcatggcgtgtggactcctctgtacccgaggaacagccttctctcaatccctctgtcacctgccccagaactggagatgagcacagggagatacgacccctgtcctgtctctgggagcaggaaaggggatgtgcagagaccagaagggacattctggcagatgctycctccctctccgccaggatcccaggagtcctgttcattggaatgagaatatctgcaccaggggatcgttgtcaggtggcacatagaagttcctagtaactgagcactgtttaaaaataatcacagccgggcaaggtggctcacacctgtaatcccaggactttaggagtctgaggcaggaggatcgcttgagcagtttgagaccagcctgggcagcatagcaaaaccccatctctataaaaatacaaaaattagccaggagtggtggcacatgcctgtagtcccagctactcgggaggtg

SEQ ID NO: 35567 - DNA, 601 bp, Human
ctaagcatggtggctcacgcctgtaatcctagcactttggaagtccgagatgggtggattgcctgagctcaggagttcgagaccagccttggcaacatggtgaaactccgtctctactaaaatacaaaaaaaaatcagccgggtgtggtgacgggcacatttaatcccagctacatgggaggctgaggcacgagaattgcttgaacccgggaggcggaggttgcagtgagctgacactgtgccactgtactccagtgtgggcaacaaagtgaaactctgtctcaaaaaaaacaaaacaaacaaacaaacaaacaaaaaagcagtgtttacatcatcataatattgcagagaggaaccactgatttaaccaataaacaagccaaaccaaacaagaccgtttagaaagcaagcaggcatggcgtgtggactcctctgtacccgaggaacagccttctctcaatccctctgtcacctgccccagaactggagatgagcacagggagatacgacccctgtcctgtctctgggagcaggaaaggggatgtgcagagaccagaagggacattctggcagatgctccctccctctccgccaggatccc

SEQ ID NO: 35568 - DNA, 601 bp, Human
cagcactattcaaaataaccagaaatgagaaacaccaaatgtccaccagtgggtgaacggataaagtgcattgtatccatacaatggagtattattcagctgcaaaaaagaatgaaatactgatacatgtactacacggacaaaaccgtaaaaagaagccagacatcatgtgattccatttatactaaacgtccagaataggaaactccatcgaggcagaaatcagatttgggattgcctaagtctggggacagggtgggaaatggggagtgattgataacgggtatgggtcttggggcaygaagataatgttacacacacacacataacagttacaaaagaaactgagcagctgggacaaaaactgttaataactccaagaaacacaaaaagttggacactacttgctcaggtattaacaatgtttacataatcagctaagcatggtggctcacgcctgtaatcctagcactttggaagtccgagatgggtggattgcctgagctcaggagttcgagaccagccttggcaacatggtgaaactccgtctctactaaaatacaaaaaaaaatcagccgggtgtggtgacgggcacatttaa

SEQ ID NO: 35569 - DNA, 601 bp, Human
tgttcacagcagcactattcaaaataaccagaaatgagaaacaccaaatgtccaccagtgggtgaacggataaagtgcattgtatccatacaatggagtattattcagctgcaaaaaagaatgaaatactgatacatgtactacacggacaaaaccgtaaaaagaagccagacatcatgtgattccatttatactaaacgtccagaataggaaactccatcgaggcagaaatcagatttgggattgcctaagtctggggacagggtgggaaatggggagtgattgataacgggtatgggtyttggggcacgaagataatgttacacacacacacataacagttacaaaagaaactgagcagctgggacaaaaactgttaataactccaagaaacacaaaaagttggacactacttgctcaggtattaacaatgtttacataatcagctaagcatggtggctcacgcctgtaatcctagcactttggaagtccgagatgggtggattgcctgagctcaggagttcgagaccagccttggcaacatggtgaaactccgtctctactaaaatacaaaaaaaaatcagccgggtgtggtgacggg

SEQ ID NO: 35570 - DNA, 601 bp, Human
ggtgagctaagatcacgccactgcactccagcctggcgacatagcgagactccatctcaaaaaaaaaaaaaaaaaaaaaaaaaaaaaaattttttttcacttacgttaaaacagttctaagacagaagcagagccattgcattctgggctcctttaccatttgggaatgagactgctgaagagcaagataaggaagggtacaatgatcctctaaatctgagccttatactctcaattttcggttgttcttttaaatgttatataacagtttcaaaatgtttgtgagacaaggtagggcataaagaatcaacattattcatactcaagagaaaaatatcactcacccattggccaattgtcatatacatgctttgcaatgtcagaagcagaatcgttaggagaaaacaggaactcttttgtttttccgcttaccaaaatgaggcgcaaatttatctgaaagaagacaatgattcttttaacataaatctaaaaattttttaagtaaaaaagaagactcaaaggcttttcatttcaatcacatcctaaattattaccaatgccatattgtggtttttatttaaattctataaaacttttttaa

SEQ ID NO: 35571 - DNA, 601 bp, Human
caaggtcaagagatcgagaccatcctggccgacatggtgaaaccctgtttctaccaaaaatacaaaaattagctgggtgtggtggcacgtgcctgaagtcccagctactcgggaggctgaggtaggggaatcacttgagcccgggaggcagaggttgcggtgagctaagatcacgccactgcactccagcctggcgacatagcgagactccatctcaaaaaaaaaaaaaaaaaaaaaaaaaaaaaaattttttttcacttacgttaaaacagttctaagacagaagcagagccattgcatyctgggctcctttaccatttgggaatgagactgctgaagagcaagataaggaagggtacaatgatcctctaaatctgagccttatactctcaattttcggttgttcttttaaatgttatataacagtttcaaaatgtttgtgagacaaggtagggcataaagaatcaacattattcatactcaagagaaaaatatcactcacccattggccaattgtcatatacatgctttgcaatgtcagaagcagaatcgttaggagaaaacaggaactcttttgtttttccgcttaccaaaatgaggc

SEQ ID NO: 35572 - DNA, 601 bp, Human
gctaatgagatcagaacaggggttcacttaacaagtaaatgatgcattctacctatgagaaaactgagtaacaatttgttatactgtataaataaaggttttatggtgactctacagacaacctggtcatcaaacactatgtaggaacataggcatgacaaactcaacagtattcatgctgtaagcagtgagctggctttggcaaaaatacatcatctagcacattaatgttgttaacttgaacattattggtttcagagttatatttgcattttctgaatcaatcttttttagttttatkattgtgtatatgagttaagaagaataaagagttttaactgggtttaagtttctacattttaaaatacgcattataataaaaataatttaagtcagcaactagagatctacaagaattatcttcctctagaaaagctccgtatattatttaaggttgagaaacactaatctaattgactcattttgtacatatactatgttctttgtcaaaataagtcttgtcctttaaaagttcaaattgctactgctaataaaattaagtgaaatcagctgaaaaaaatcatatcactatgatacatga

SEQ ID NO: 35573 - DNA, 601 bp, Human
atctaagtaagtaattatgaaagtaaaagtatttcttttaccttaagttacaatactgcccaaataaatttcagagtgattaccctttttctgccttgtgttatgttttctataatatccatatatcaaaagctattacttactatgaccgctccccccaaaaaaaatctcataaaggtaatctttttgtatcacacttagaacaacatcattcttgggtatttaaaaatgcttttcatactgatagttatctattcctgcctggctataaagaatagccaatattcttagatcccaaatwtctttagcttttctgaaattctttcttagctataacctttatagcttcagtatctccctgacttagaaactagccgcttggttactaatgtgaagaaagatccagtagttgaaagtatttgtataaatcagtatttcttaaatttaggcctatgaatccaccaagacatgtccttagggtctaaaagtcctcttcaagaagttttaaattgtatttttttttttaatgaaaatctggaaaatctgtattttcattttaatgaaatctggaggagattgtctagatgatttaaatagtgac

SEQ ID NO: 35574 - DNA, 601 bp, Human
ctagaagaaagatcaaataagtctctaacactatagtatgaattgctttgaattcatcaattccaaaattattgtttaatagaatatttctggtcaagatggaagtgctccatagatacaaaggtaaatgacagtaattgtttaattcacaggaaacaaagactgatattctaaaaatacttgaattttttttttgagatgcagaaacctgaagccccatgtttcattatcttatacagagtgtcatgatttccacgtacttcactggtgtaatatgctatctcccttcccctctccaggkatctaaaatttagagaaatcttagaatatagcttaaatgaagaatttcaggtgttattaacatatcctaagtataacaagatttttttgaacctttgacccaataatagctatgtgtctgactattccacctgttagtaatatttccactaaatagcagaagggtatgctaaggaaaactaattccttcaacaagtatgttgcacgaagtattttctgctattaatatttgccacacatttgttattaacatcaataagtatttaatttgctgatctttagtacattatgtgatacaata

SEQ ID NO: 35575 - DNA, 601 bp, Human
tatttgaaaactatcataaatttttcctagtttgtgtgtccagtcttaagtttaaaatactacatctgaattatatattatttggaaatataataacgttacatttaaaaaatagtaggtatagaatcctacctatactgggatagagtttatttcacaaggtagtaaatacttactacagtcctaaaactaaatttaacagaatatacaatgtgaaggagtaggcataccagaaataggcagaattcatagtttgaatttatcattttttttagcaaattcaaagacattaacatttaamacaagcgaatcatgctaccatgagacagacattaaatcccattacaaaggtggctgttacctcctaatgtgacatttccatgtagaaatcgtccttgataaataagtcgtagaatatttggactgctgacctgctcttcttcccagtctgaaaagaatccagtgtactggttaggtatattccaacatataattaaggtactactatattgttttaaaaattcagatccaaatcagttagagtacaaagaaggcccttggagcttcctactactattagaaacagtcactattcatacat

SEQ ID NO: 35576 - DNA, 601 bp, Human
agcccttattgcccaggatttttaccagtgcattttatctgtttgtcctatgtaatactagagcaacctgaagggagagcttctgtcttattcaatcctgtattcccaagtgcttagcacagtgttggcccataagaatttaataaatacatgctgaatgaatgaatgcaaatattctacctttaaggaaaaatagattaaatattaggtttagaggaaaaactcagactatattcagtgaaatatatatttagatagaccatttcatttgcctatacgtttccaattatctgaatatatktgaaatacctattttcaaaactaccatcaaatcctgttgatggtagaaaatataccccataagggggcaatattgagctacatttctccaatcatatataaagaacaataatagctaacaattaaggtgtttactatgtgccaagcaccatttatgcacgtaagcactttgaatatataaagtaatttacccttcttaacctatgaggtaggcactactgtaattccattttactgatgaggaaactggaacacaggttggttaagtcacttgcccaaggtttacacagccagtaagtag

SEQ ID NO: 35577 - DNA, 601 bp, Human
tttttagaccagttataatactaccagtgaaactcagtgtgagattatagcctgaaatgttttactcacttgacattgtcataaaatcatttgcattcatctactttagcccttattgcccaggatttttaccagtgcattttatctgtttgtcctatgtaatactagagcaacctgaagggagagcttctgtcttattcaatcctgtattcccaagtgcttagcacagtgttggcccataagaatttaataaatacatgctgaatgaatgaatgcaaatattctacctttaaggaaaaayagattaaatattaggtttagaggaaaaactcagactatattcagtgaaatatatatttagatagaccatttcatttgcctatacgtttccaattatctgaatatatttgaaatacctattttcaaaactaccatcaaatcctgttgatggtagaaaatataccccataagggggcaatattgagctacatttctccaatcatatataaagaacaataatagctaacaattaaggtgtttactatgtgccaagcaccatttatgcacgtaagcactttgaatatataaagtaatttaccct

SEQ ID NO: 35578 - DNA, 601 bp, Human
caagaatggcagagaatgcccaggcttcctactttgtctgcataatggctgaattccacccatggctgtatacccactacttcgtggtcatccactgcttgaccactacctataacaagatctcactaactttccctggcagtctattctttctttaggtagctcaacatgttcacatattctttcctatattgaagagaaaactgtctttgattttcagttactgatcctaagtctaattcacagggctatacagagcaagttctagggccacacaaagccttcttccacacaggccackcaaatatttaaagatggttgtatttccctgtgtgctatcttctttattattcacattgaagaacacagggaggctaaaaagaaaaactgagacccaaaagacaaatagttgaatgttgttatccaaacttgctcaaacatccagctacaattattaacgcggaggtccaggccatgcttctacactagagatagtttattgtttttgaaaagaaggacagcaacacagaattacaataataattacataagtcaatctgttcattattctaaaacagatttcaaaaaaatactggtaaaa

SEQ ID NO: 35579 - DNA, 601 bp, Human
accagaatctaaaatgcgttttcttcctttcactgtggatgcttctgctctctcctatgacacagtacaatatccagaatagaggttttcaacctttagcgtacataaaaatcacccaggaattcaattcactagtaaaattaggagatgggggttggggagagagggcatgcagaaatctgcattttaaaataagtatcctagatgagtctcatgcccactatttcagagccacatttttggaaatgctaatctgggccatactgaatgccaaagctttagctgatcatcttcttcaccytccgattaacaaggctgctgtcacacctttcctttaatgaaatgaaactctatatggctataaaggttctattttaaaaaggggggattcagggctatgttttaagacatttgataaccaaacatttcaacctgaaacttaagcagaaaatttcaagaatggcagagaatgcccaggcttcctactttgtctgcataatggctgaattccacccatggctgtatacccactacttcgtggtcatccactgcttgaccactacctataacaagatctcactaactttccctggcagtctat

SEQ ID NO: 35580 - DNA, 601 bp, Human
tcatacccgtcttcttgactctaataagacagacctggattacaaattttcatctctgctacttccaactgtgtaactctcagcaagttacttaccctctaagcttctgtttcctcaactaaactggagatactaattccattacctgccctttgtagctgtgtccattaaatcaaacaatccaagcaaagtgctttgcacagaacttggtacaaagaaagcattcagtatatactaccatcatcattttgagatagcaaggaaaatgaatctgagaaaaaaggtaggtaaactgagatayatatgtaaaaaatgtcaagacaggcctggaaagctcctgagaggcttaccatttgaagttacaaatgtaatgcgtgggagctattatttttcttctccatctgaattttaactagaaatagtaggtattgatgttaataacatttaaaaatgtgaaagaagaggaataccagaatctaaaatgcgttttcttcctttcactgtggatgcttctgctctctcctatgacacagtacaatatccagaatagaggttttcaacctttagcgtacataaaaatcacccaggaattcaattcact

SEQ ID NO: 35581 - DNA, 601 bp, Human
ttatttggtctacacttttaacctctgatgttcaaatgaagcacgatggcccataaatacataatgaaaaaagggaggcttttagaataacttcctaggcctgacttaaatcaaaatgtaagtaagactttatgttattaaaattttcactaaatagttgggaaagcctgatcaacatttcaaaccttgaactgaacttaaaatgtacacataccaagctgtatatcattctcatacccgtcttcttgactctaataagacagacctggattacaaattttcatctctgctacttccaacygtgtaactctcagcaagttacttaccctctaagcttctgtttcctcaactaaactggagatactaattccattacctgccctttgtagctgtgtccattaaatcaaacaatccaagcaaagtgctttgcacagaacttggtacaaagaaagcattcagtatatactaccatcatcattttgagatagcaaggaaaatgaatctgagaaaaaaggtaggtaaactgagatacatatgtaaaaaatgtcaagacaggcctggaaagctcctgagaggcttaccatttgaagttacaaatgta

SEQ ID NO: 35582 - DNA, 601 bp, Human
ttttagcatatcaatctttaaattattggtatgaaataaaagaaaaagtggcattcttgtgtatgccataaaaatcagcttttgactttaatacaattgcaagcactaatatcaaacgcaaactatataaagaaacaaaattagtactatggagtttttttttaattttaagaattcatctgaactctaaggagtaagcatgacactggatgtggttacaaattaatgataattatggaaaatttcaatttgctgatattcaaatacataaaattgatcaatgaggttttctaatatttcygcacaataatgaaagccgatgagtgactgaaactaccctcccacattaaggctaggagacgcactctcaccccttcttgtgctgtctaaacaaacactcagttactgtaggactcaagagtgcatgtcttaaaggaaaaaaaattagtttcatcagccctctactgagtgctttaaacaggcacattttgttttttcatttgttgcagtgaaaatagtcacactcagtttagtattctgtgccagtgcagccaccacggctgactttggtagaattcacccaacattttagtttcttttc

SEQ ID NO: 35583 - DNA, 601 bp, Human
tactcatccttttggtaaatctcttgattgcattgggcaaatcaagcactttataagtccacaggacaaccagtaatatttataaccagttatacataaatatttatataatatatgtgtgtgttttatatatatataattattaataatatattacacatacaataattttgtgttgttacttcaccccagggaattagcaatggcattaccagctctacttaacagggaaaagaatcttgtagattttctttacacatgcactgtacattgtaacccagagctaacttacagatgcccraaataaagctggcaaaggactttgggcctttccccttatcccagcatgtgcagcaactttaagctcagagtaaagctgattagaaacccaacaccatctgtctgtcctatgctttaatatttagcaaaatgtttctgtgtttcctcatatgactatgaatttgtaggttacacatggatccctaatactgtgcaagtaattgtattgataaataagctgagttaccatttctttattgcatttcaaccagtcccctcagtgtgacaaatggctcttcaacaggaccgctgtccctcgttg

SEQ ID NO: 35584 - DNA, 601 bp, Human
tttttcatggtccatttcatccatagaagagaaaaaaattttaattggggaaacaactggaagagttagtcttcaataccatgaattctatatagccttcacttccggtttggaattcaggctgaaatgatcttcactactactggttttggggacctatgaaagcttatacctacactactacttacattacaccttgttgctcaggtttcagccatacagctaaggtaaatgatgccatcagctttggagaaggaggagaagaaaagcagctcttgtgatttccaaaaataaaacttgyagaattgctatgggcgttaggatgcagatcattcttgtctggtgtgatgcagctactgaggcctgctgagaaaagggcagtgtaggtagggtgtgaagatctgtatgggcaatcctgaatacaaaaccgctgggtacagaactgaatactttcagcagcagcagagctgtgacaaaaagtgcttcggtctgggagtccacatactgcttgggttggcacgatggaaactttcttgaaagctcccacgttctccagccttgggaaaagacctcgtgactcagtcaaggatattgaagcaaa

SEQ ID NO: 35585 - DNA, 601 bp, Human
tttaaatatttttcttctttagttgtcatttatacacacctgaaatctaaaagatactgctgcagattttgtgagtagatgccatttaaaagagagaaaggaagacaaatccttgtgtttaaccaaatgttaaatattttttattttactcacctgcacactaagatgaatccatttcttcacaagaattctccccagtgtcattacttttattggaggttgcaaaccatttactgtgcgataataaaacatggtctctttctcagatattgtaagtttgaacacaatctgcccatctacygtcttttctataacacaccttaggaagcaaccggaaaagagagaaaaggtcagcatccaaccaaaaagacatgctaaggtattgtgcagttacagtggtgttaaaatgacctcaaactttgctcaaaatggtgtactatgaataagtgcctgaatgtcattatattcaatgaaagctttattccaatgaagaagcccctttatttcaataaaaaatagaattcttatttacaatatattccccagagcctcagcacccttcattagagattcatgatggaaactaaagtggttgaatcat

SEQ ID NO: 35586 - DNA, 601 bp, Human
atccatgggaaagaagtacgaaagcaagtatcattttatctgcttctgttttaagtgaaggactgaggccaaggccatttgtcaatggtttcctgtgactcatcagtacagatcctgacatcctgtaatgcttcattggcttcagatcatatggcggctgccaacagtcaaagaatgccaattccaggtagatatatttaatttttccattaggggcaatatacttgttctagaccagaattagtcattctatttataggcattcttccacatagcaccttcccagacatttcaggtaggycaaaattagtaatcaaggtcttaccagagaaaccaggcttttcctctcagaccccagtggagcagtgaaggagtcaggcagcttttccattcattaaatcacatgaagtcataccttctttaaatctcatcaattcttttcaactgataccaagttttgaatgggaccaaaagctaccagtatagaatccagtataaaatctttcactcccaaggaaaaactttattcccaaagaattactacaacattgcccttcagcattttagacaaaggtgatctaaaatatagtaaggcttttgg

SEQ ID NO: 35587 - DNA, 601 bp, Human
ttttcaccttgtagtgggttgaattgtgttcccaaatagatatgtccaagtactactgtccaaacctgtaaatgtgactttatttgtaaatagggtctttgcagtataattaaggatgtcaatatgagatcatcctgggtctaatagggtgggccttatataagagaaagaaaagggataattgatgctcacagagaaacaaggaaggacaccatgtgaaaatggaggcagagattgaagttgtggtgccacaagccaagtaacaccaagggccaccaggagctgcaaatggcaaggaggsatcctcctctggaatctttaagggaatgtagccctgccaacatgttgatttcatatttctgatctccagaactgttagggaatatatttctgttgttttaagacatgaagtttgtgggcatttgttgcaataaccacaggaaattaatgtacaccttatcgtttctcattacctgatactgtccattttccaaatcaactgaaatagtcactccttgattaagctgtgtaatgtttgtaaacacatttgaaacccatgaagtaccaacatcattatcattgacaaaagagagaggatggg

SEQ ID NO: 35588 - DNA, 601 bp, Human
gctctctggcaaggagagataaagaaaaaatgtggatataaagatgaataaataacaatgagaatagtgtcaagaagacaaacactatcaaacaataagtggctaattgtatacgtgtgtgtgtgtatgtgtataattttagttaggttcatagatggttgaactaactagaatatcattcgctaggaaagcatacagaaaataggactatttaatttatgttaattcttgttttgcttcctatcaagaagaatgactatcattttgaaagcatgataccaatatttaaaggaaagaagtkaatcacccaaaagggaaatttactataagaaaaggtctaactactttattttcattcaatcctcttgcattttggaaattacatcctaggattcccaccctgacagcccaccaaaaataaaaatcacagatgatattactaaattattgctagtggcccctagaagatataatgagggttataatcctgcagttcccaaactgtgtagggggtggggtaccatgagaaattttaattttaaatgaaaatatttcttgacatctgttggatacagagacaaatactagtcagaggtagttc

SEQ ID NO: 35589 - DNA, 601 bp, Human
agggtgaccctaattcacaacttcagaaataatcagtggtactgtcatcttcaaaatcattttcaatatttttataactcctctctttctctgtcacaaaagtttaagtttcaggacacctggatcatgctgatatttggaagaaaataaacattctagtagcaggttttcaggatactttgccaacatggcagatgtagacagatgttcatttccctttgcaatctgcatcatgaagttcagagtttccattaactttaaagaagacttggaatactgaagagacatgtagagccaagasaaaggggtggacataagaaactaaattccagttatatgaattaggtgcaaaatgaaacccagtataatgcatacaaaataaaactctatgcgatgcaggagttttaaagtcaattaaaatgttaaaacaaggcatcctcctaaccattttaaggaaggttatggaatttcagtgtttcgacagagctttaaacagttctccaactaattaagcatggttaaagtagaatttggaaaactgtgtattaaatgaagagaacaaaatagaaacttgaattggaattgctgttccgaggtttct

SEQ ID NO: 35590 - DNA, 601 bp, Human
tctatacatatttgatctattgttccaggaaagaatatagtagtcccctcttatccacaggagatacattccaagatctccagtggattcctaaaacaacaaatagtattaaactatatatatatacacacacatacatatatgtatatatatacacatatacacatatatatacatacatatatatgtgtgtatatatactgttctttttcctatacatacatatctatgataaagtttaatttatgttaggcagagtaagagattaacaacaataactgaaaataaaatagaacaattrtaacaatataccccaataatagttatgtgaatatggtctttctctctctctcaaaacatcttattgtactgtagactcacctatttttggaacattgttgaccatgagtaacaaactgcagaaaacaaaaccatggataaggggaaactaccgcattaagaatattaagagccttataaaaacagttgcctgtcatcttctcttctgttttctcatcctgtctctatatcttatatttcttcatttattcctctcagagctaactgaatcatcttaccacttgttacattgatcccttga

SEQ ID NO: 35591 - DNA, 601 bp, Human
tagatatgttgtcctccttccttatcatcatgccaactgcttacaagcacacttgtgaattatagattttgatgtccacgattctgtcattatgtacaatctagtatctaaactatttattttggaaagataaataaaaacaaagacaaatttgtggaattggtgacagttatctctttcattgaacataaattaggctgtatatggagcaagatgagacatgtgtccaatccacttcaggagtggaaaccaaatgctatttttgacaaacattcccagaagactataactatagttaagccattttcgccccatgaattaataactaaagcatttacttttgccccctagaacttgctgcaagtactttatgaccttgagttgtttatgtaacaaatccatatatatgaaaattttccttggtctatggaagtttctaattcttgcttttcaaaatgtactttcacagtactttgactttaatttgaggaaacatttgcattcagaggttttaaaagtagaatttaaaacattgatctttacctgattctcccgttctttctgagacccaggcagaagacacacttccagccatattcac

SEQ ID NO: 35592 - DNA, 601 bp, Human
gacagtaactatgagtacaaaactaattttcttagggctactgatacatagtcatataaaataatcttccataaatataaatacagataaatgtaaagttcagtaacatttggagtagttttctagagactttctctttaggggtaaaataaaattcatttggaatatttgcctaggtgttgactttaaaatttcgtaagttacatgagttgttctaaaaagcagtgagattggaatgtagaatacagtgtttcaataacattcagaaataaaggtgtttttaaagattctaaaactctasgaataatttaaatttaaaactttaaaaccatttccttgcaattacattttgaaataagaaaaacatcaaataccaagtaattctttatttttctaattttaaaatcattattgatataatgaagatacaaacttttctgtgaaatgtgatttaaaattttctaagtaaaataaaccttgaactgagttaaacttatgaatattgctgtaatattcatcccttttagaataatcctggtagatttcaatgtaaatttttagaaaatggtattgtttttaggataaagtacatgaagctatt

SEQ ID NO: 35593 - DNA, 601 bp, Human
gtcaccatagttttttattttttgaaacggagtctccctctgttgcccaggctggagtgcagtggcgcgatctccctcactgcaatctctgcctccctgggttcaagtgattctcctgtctcagcctccagagtggctgggactacaggtgtgcaccatcaccatgcctggctactttttgcattttaatagagatggggtttctccatgttgcccgggctggtctcaaactcctgacctcaagtgatctgcctgcctcggcctcccaaaatgctgggattacaggcctgagccactgtgyccggtcaatagtttgtattttaatctcaaagctgtatcctaggaaaacctccattctgcctaccatcccggactctggctctggagatgagtggtatgcccttttcttaaggtaaagcctctaattccccatctacctactgagatcagatgtggtaatctctaaaagactgaatttggcctgaccatgggccaacagcagttctggacactctttggggcaatcctccattgtcttctgtataagtcaatccctttccagaactgcacaggggactccacgggacttggaagggtttca

SEQ ID NO: 35594 - DNA, 601 bp, Human
tagctaagccatttaagagagcagggtctattttcttcattgccagaggatcactcactccagtaatcatgccctccagaatttatcacactggaatgctgttccttacaatcatcatttttcttcttcaacactaccctttctatggcctcatccacaagcagaacatgtaaactgtccacatagaaaatgaaattatttgtgtgccacccactaggaaaatgagtaacttcatcttcagtgtgttccatggaaacactttcccactaggaaaagattgagaagctacactctagaccartagttctcaaatgttttagactcagaaccctttaacactctgaaaatttccttaacttccttacttctactgggtgacattgctctagacaggctggcaaactatggtgagatttgtttttacagggtccattgatacaagaatggcttttatattctaagagttgtaaagaaaaacccatatatatatgtgtgtgtgttttgtgcgcacacgcacacaacagacaatttgattagcctactctggttttagaccatcagctctaatgaatttagagccttaggtaaactaaaggatacg

SEQ ID NO: 35595 - DNA, 601 bp, Human
aatgccaactcccatttcctggattcaatctcagattacttcctttcccctgtccagaaatcaaaacccatctcctcacatcttaaccttatgtctctagccagttcccagcaactgcctagagacactgtaacgcctggtcagccatcatcatcacttcacctgttccaggtccacatcatctgccagcttcatgttcttggtatggatctgaagaatctctaagcgtcctgtagcatcaggaattccaatatctacctccctgtcaaagcgacctgtgggacagtacacaaacagtaaacagggctcatctctagtccagaggtaagagacaggcctagggtgaccaaccatctcagccagcacaggattgtcctaatgccagcactaaaaaagtctcaagctctgggaaacctttcagtctcaggaaaaccagggtggttggtcactctagacaggacgtagggtaaaggaaaaagacccctggacccaatcactgtgaagggcttcaagaggattaggtgacttagatgaaggagagaagtaggacctaagcaaggacggggtcaaaagtatctggagtccttaccaaatcgccgta

SEQ ID NO: 35596 - DNA, 601 bp, Human
aaatgccaactcccatttcctggattcaatctcagattacttcctttcccctgtccagaaatcaaaacccatctcctcacatcttaaccttatgtctctagccagttcccagcaactgcctagagacactgtaacgcctggtcagccatcatcatcacttcacctgttccaggtccacatcatctgccagcttcatgttcttggtatggatctgaagaatctctaagcgtcctgtagcatcaggaattccaatatctacctccctgtcaaagcgacctgtgggacagtacacaaacagtacacagggctcatctctagtccagaggtaagagacaggcctagggtgaccaaccatctcagccagcacaggattgtcctaatgccagcactaaaaaagtctcaagctctgggaaacctttcagtctcaggaaaaccagggtggttggtcactctagacaggacgtagggtaaaggaaaaagacccctggacccaatcactgtgaagggcttcaagaggattaggtgacttagatgaaggagagaagtaggacctaagcaaggacggggtcaaaagtatctggagtccttaccaaatcgccgt

SEQ ID NO: 35597 - DNA, 601 bp, Human
aaaatgccaactcccatttcctggattcaatctcagattacttcctttcccctgtccagaaatcaaaacccatctcctcacatcttaaccttatgtctctagccagttcccagcaactgcctagagacactgtaacgcctggtcagccatcatcatcacttcacctgttccaggtccacatcatctgccagcttcatgttcttggtatggatctgaagaatctctaagcgtcctgtagcatcaggaattccaatatctacctccctgtcaaagcgacctgtgggacagtacacaaacagtcaacagggctcatctctagtccagaggtaagagacaggcctagggtgaccaaccatctcagccagcacaggattgtcctaatgccagcactaaaaaagtctcaagctctgggaaacctttcagtctcaggaaaaccagggtggttggtcactctagacaggacgtagggtaaaggaaaaagacccctggacccaatcactgtgaagggcttcaagaggattaggtgacttagatgaaggagagaagtaggacctaagcaaggacggggtcaaaagtatctggagtccttaccaaatcgccg

SEQ ID NO: 35598 - DNA, 601 bp, Human
gaaaaatgccaactcccatttcctggattcaatctcagattacttcctttcccctgtccagaaatcaaaacccatctcctcacatcttaaccttatgtctctagccagttcccagcaactgcctagagacactgtaacgcctggtcagccatcatcatcacttcacctgttccaggtccacatcatctgccagcttcatgttcttggtatggatctgaagaatctctaagcgtcctgtagcatcaggaattccaatatctacctccctgtcaaagcgacctgtgggacagtacacaaacagtaaacagggctcatctctagtccagaggtaagagacaggcctagggtgaccaaccatctcagccagcacaggattgtcctaatgccagcactaaaaaagtctcaagctctgggaaacctttcagtctcaggaaaaccagggtggttggtcactctagacaggacgtagggtaaaggaaaaagacccctggacccaatcactgtgaagggcttcaagaggattaggtgacttagatgaaggagagaagtaggacctaagcaaggacggggtcaaaagtatctggagtccttaccaaatcgc

SEQ ID NO: 35599 - DNA, 601 bp, Human
ccttagtgcctcaaacctaagaacagtaggttcctaagtcgtgctctcacaactcttgcagcaaatgtgttgacaccctgagatcacccagatcaattacaatgtactgagacagtgactcaccctggaccaagttgccctacctggaccagctcctgtagctcacgtttgacatcctctaggcccccgatgtcttcccaggttacctgtggcacctctaccacggtttcccgcagtgctgatgggttactctggctcaaggcccactagaaaaggagggaaaactggggatgagacttaycaagggaggggtcaaagcacgtatgtgtgtacctgaggcacgggtgtggtccttacccggaagtcatccatagtaactgctagagagttcatgacctcggcatcaatggtctcatcctctaggtcaatgagatccatcttcttgcggatggcttgcagagcagcctctgagcacagggctgctaagtcagcacccacatgcccgtgagtctcattggctacctgcagagaaagatctacttactatgctgcctcaaagacccagctgctgcaggaggctcagagacaatagaatccttcc

SEQ ID NO: 35600 - DNA, 601 bp, Human
gaagttggcctggcattcattagcaatggctttggccaacaaagttttcccacagccaggaggtccatagaacagaactcccttggaaggtgtcatgccaaacttcaggaatttgtctgggtgctccacaggatactaggaggaaaaggaaagagggttcaaggctacctccacattttgaaagaaacctaactaaacagaagcatcccctccattatttcatggtgtacccaatggtatcagatccaggttctctagaagaagactccttagtgcctcaaacctaagaacagtaggttcytaagtcgtgctctcacaactcttgcagcaaatgtgttgacaccctgagatcacccagatcaattacaatgtactgagacagtgactcaccctggaccaagttgccctacctggaccagctcctgtagctcacgtttgacatcctctaggcccccgatgtcttcccaggttacctgtggcacctctaccacggtttcccgcagtgctgatgggttactctggctcaaggcccactagaaaaggagggaaaactggggatgagacttaccaagggaggggtcaaagcacgtatgtgtgtacc

SEQ ID NO: 35601 - DNA, 601 bp, Human
gcctatagtcccagctactcaggaggctgaagtaggagaattgcttaagcccaggtttcaaggttacagtgagccatgactgtaccactgccctccaacctgggcaacagagccagaccctgtctcaagagagagagagagaaaaaaaaaataacactaggtctctcagacctcagaaagaaaatcaagtgacttactgtgcagttgagcagccagcactaagaatatttcaaccctcttaaagaaaaacagcctctattccttgccctcaggcaaatcaatacatagttcagcctattgyagctcaccttgtcaaagatttctctgacattggcctcagactccccaaaccacatggtgagcagctcaggacccttgatggagatgaagttggcctggcattcattagcaatggctttggccaacaaagttttcccacagccaggaggtccatagaacagaactcccttggaaggtgtcatgccaaacttcaggaatttgtctgggtgctccacaggatactaggaggaaaaggaaagagggttcaaggctacctccacattttgaaagaaacctaactaaacagaagcatcccctccat

SEQ ID NO: 35602 - DNA, 601 bp, Human
acgcctgtaatcccagcactttgggaggccgaggtgggcacatcacaaggtcaggagatcgagaccatcctggctaacgtggtgaaaccacgtttctactaaaaaaaaaatacaaaaaactagccggacatggtggcatgtgcctgtagtcccagctactcgggaggctgaggcaggagaatcgcttgaacctgggaggcagaagttgcagtgagccaagatcgtgccactgcactccagtctgggcaacagagtgagacttcgtctcaaaaaaaaaacaaaaaacaaaaaacaaaaaaaaccttgctgtgtttgctgcactctcatactttgatttccctcatggagcttggttcagactgagaatggagcctgaccatctcttctcggccttattccaaattgaatggattcacctcagcattctttatctttgatgccctattaaaattcttctcagttagatgatctttccaacagcttctactctcaactccagggcatggtggtggctgctgcctggctctccatgattggcacatctggggaaaggatgcagactcaccatggctgatgggtttgtctgcctctctcgttctcg

SEQ ID NO: 35603 - DNA, 601 bp, Human
tcatctcagctcaaaaccttgctctgtggttcacgcctgtaatcccagcactttgggaggccgaggtgggcacatcacaaggtcaggagatcgagaccatcctggctaacgtggtgaaaccacgtttctactaaaaaaaaaatacaaaaaactagccggacatggtggcatgtgcctgtagtcccagctactcgggaggctgaggcaggagaatcgcttgaacctgggaggcagaagttgcagtgagccaagatcgtgccactgcactccagtctgggcaacagagtgagacttcgtctcmaaaaaaaaacaaaaaacaaaaaacaaaaaaaaccttgctgtgtttgctgcactctcatactttgatttccctcatggagcttggttcagactgagaatggagcctgaccatctcttctcggccttattccaaattgaatggattcacctcagcattctttatctttgatgccctattaaaattcttctcagttagatgatctttccaacagcttctactctcaactccagggcatggtggtggctgctgcctggctctccatgattggcacatctggggaaaggatgcagactcaccatg

SEQ ID NO: 35604 - DNA, 601 bp, Human
tcttacctttatggaacttacaaacacatgaatttgccttttcattttgggaggtctgtggaccctatcccttccccaaccatcagggataagtatatgagtctcatctcagctcaaaaccttgctctgtggttcacgcctgtaatcccagcactttgggaggccgaggtgggcacatcacaaggtcaggagatcgagaccatcctggctaacgtggtgaaaccacgtttctactaaaaaaaaaatacaaaaaactagccggacatggtggcatgtgcctgtagtcccagctactcgggargctgaggcaggagaatcgcttgaacctgggaggcagaagttgcagtgagccaagatcgtgccactgcactccagtctgggcaacagagtgagacttcgtctcaaaaaaaaaacaaaaaacaaaaaacaaaaaaaaccttgctgtgtttgctgcactctcatactttgatttccctcatggagcttggttcagactgagaatggagcctgaccatctcttctcggccttattccaaattgaatggattcacctcagcattctttatctttgatgccctattaaaattcttctcagttagat

SEQ ID NO: 35605 - DNA, 601 bp, Human
aattaattaagggtaacacaagacatagtggaaaacaagtgagatgacagagatcttacctttatggaacttacaaacacatgaatttgccttttcattttgggaggtctgtggaccctatcccttccccaaccatcagggataagtatatgagtctcatctcagctcaaaaccttgctctgtggttcacgcctgtaatcccagcactttgggaggccgaggtgggcacatcacaaggtcaggagatcgagaccatcctggctaacgtggtgaaaccacgtttctactaaaaaaaaaatasaaaaaactagccggacatggtggcatgtgcctgtagtcccagctactcgggaggctgaggcaggagaatcgcttgaacctgggaggcagaagttgcagtgagccaagatcgtgccactgcactccagtctgggcaacagagtgagacttcgtctcaaaaaaaaaacaaaaaacaaaaaacaaaaaaaaccttgctgtgtttgctgcactctcatactttgatttccctcatggagcttggttcagactgagaatggagcctgaccatctcttctcggccttattccaaattgaatggatt

SEQ ID NO: 35606 - DNA, 601 bp, Human
tcccatgtttggaacttaatgaattaattaagggtaacacaagacatagtggaaaacaagtgagatgacagagatcttacctttatggaacttacaaacacatgaatttgccttttcattttgggaggtctgtggaccctatcccttccccaaccatcagggataagtatatgagtctcatctcagctcaaaaccttgctctgtggttcacgcctgtaatcccagcactttgggaggccgaggtgggcacatcacaaggtcaggagatcgagaccatcctggctaacgtggtgaaaccacrtttctactaaaaaaaaaatacaaaaaactagccggacatggtggcatgtgcctgtagtcccagctactcgggaggctgaggcaggagaatcgcttgaacctgggaggcagaagttgcagtgagccaagatcgtgccactgcactccagtctgggcaacagagtgagacttcgtctcaaaaaaaaaacaaaaaacaaaaaacaaaaaaaaccttgctgtgtttgctgcactctcatactttgatttccctcatggagcttggttcagactgagaatggagcctgaccatctcttctcggcc

SEQ ID NO: 35607 - DNA, 601 bp, Human
catggcttcttcaaagtgatctcgacggatctcaggcactggatcatcctcttctacctcctatagttggtaaacacagatcactagggctagttaaagcccagcctggatttcatcccaggcctcccattactgcagtttattggtctccttgcccttccaatccaacctgaggtaagatgctaggccatgcttcctaaaattgagtcactgctctgcttaaaaacttgtcaatgcactctggaaaagggaaaactgtagggacagaaatcacatcagtgatggggcttaaggaggggaratgttgactgaagtggctaaggaaactttttgagatagtagaaattttaagtctcaactgtggtagtagttatagaacttacacacacttgtcataaagcatggaaatggtatatagaaagagtgaattttattgtatttatatcataccttaataaaccttaatactttaaaaggaaatgccaatggctttcagtgcttaccacatttggattacatcctacctagcggtctcacttccagtgacatatatactcttaaatctacccagggtttcccaatgattgcaatcctactacta

SEQ ID NO: 35608 - DNA, 601 bp, Human
aataaatcaacctactctctatataaacatccagcaactgtggcccctacccacctacccaggttggatagggggaagggagggctcgggcagcattgagtcaagtgcagatgctttactgtggcaggtggcagtagtgccttggttcacaccccacacaggtcccctgcactgccccaaactacaacagaaatggcataggcccaaggcccaattccctgttggtaattcactctccgcctaccaaatgaaaatcgcttttattttatcgcttttgttttgtatttttgcaacagaaacmccctgtccagagtcagactgtagctgaactgttcagactggagaatggagcaggctgtgggcgcacccctggtccctctcctgggcaagcgcccccacccccagggaacaaggtccaggcaggccagctcactgcacgctggccaccaccacttagccatacaggtcatcatcattgtcttctgtgtatacactgccacctgtgccgcctccactgccctgactggggccagctccaccctggttccctgaagggaatctgtgtacaagagcaaagccaaaaaagagggttaggacaggg

SEQ ID NO: 35609 - DNA, 601 bp, Human
tcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcaracaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcaggggcacgcatccccttggagagactgtcatggaagagggtggagccgccgcccgaagcgccgaggaggctgagc

SEQ ID NO: 35610 - DNA, 601 bp, Human
ggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagytcggagaaggaggagagggagagggagtgggaggaagaaatggaacccactgcagccaggacacgtgtcccttgaactgaagacagcaggggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaa

SEQ ID NO: 35611 - DNA, 601 bp, Human
gcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtggraggaagaaatggaacccactgcagccaggacacgtgtcccttgaactgaagacagcaggggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcac

SEQ ID NO: 35612 - DNA, 601 bp, Human
atggtcacaccctgcaagtgacctggtagcaggcagagttatgtcaggagactgtcgtttggggaagcaaggattggagtggaggctgcgcttgccccccagggctggctgaccctgggcagaagcaccatctcctccccaccgcttccccaaaatgtgggagatcaaagcgctctttgaaggaatttactgtatttccaaatgcaatagaacaaaacacaccattatgggaaagatcacagctctgatggactttacacttattttttttattttttgtttttaattttttaaaaaaatktttattattatactttaagttctggggtacatgtgcagaacatggaggtttgtacataggtatacatttgccatggtggtttgctgcatccatcaacccatcatctaccttaggtattcctcctaatgctatccttcccctagccccccgccccctgacaggcctcggtgtgatgttcccctccttgtgtccaaaaatgtggaacgcttcatgaatttgtatgtgtcacccttgtgcaggggccatactaatcttctctgtattgttccaattttagtatatgtgctgctgaagcgagca

SEQ ID NO: 35613 - DNA, 601 bp, Human
ggagaggcacaccactattgttttaatttgcttttacctgattcctggtaggttgagcatctcttcacatttatctcagctgcttgggtttcctctggggcctctgagaaccctcatccaggagggtctcggtcacaccagggttggtgtcacctcccttcagggtgccaggcacccctcttcagaggtgctgatttcctcatctggcatccaggcacatttctgcggccgccctcccaggacatgacacagctcattaggtttcagctttttatcttcccttttatgagactacactgtrgtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatcccagctttgtggctgccgtcatcaccatcaccttcaatccgctctactggaatgtggtaagtgatgtgcctgacactgtccagacgggagtatcccactgcttggtgagccccaca

SEQ ID NO: 35614 - DNA, 601 bp, Human
ctcactggggagccacaacccctgggctagcgggagggccgctactggtggtacctcatccctcaccacgcgggagccttgtgtctgagcactcaggggttagctctcaaagccacctgccacagcaagccaccctacccctcccagccgtttagactctggccagcagaggagccccagtgacctcaggaatgggggtatgtgaatggggggcaagggacaatgcctgggtggtccccaggtcacatcccagcctctgccacgtagccaaggctgttttaggagtctcctccaggaagcrtccagtcagaaggtggatgctggctcgggagccctcaggggtcaggcctgaccatctctccaggttaggtttgaatcagcgtcagaaagcttctttgaggccgggcgtggtggctcacacctgtaatcctagcactttgggaggccgaggcgggtggatcacctgaggttaggagttcgagaccaccctggccaacatgatgaaactccgtctctactaaaaatacaaaaattagccgggcatggtggtgcatgcgcctgtaatcccagctactcgggaggctgaggcaggagaattgct

SEQ ID NO: 35615 - DNA, 601 bp, Human
gggcaagggacaatgcctgggtggtccccaggtcacatcccagcctctgccacgtagccaaggctgttttaggagtctcctccaggaagcgtccagtcagaaggtggatgctggctcgggagccctcaggggtcaggcctgaccatctctccaggttaggtttgaatcagcgtcagaaagcttctttgaggccgggcgtggtggctcacacctgtaatcctagcactttgggaggccgaggcgggtggatcacctgaggttaggagttcgagaccaccctggccaacatgatgaaactccrtctctactaaaaatacaaaaattagccgggcatggtggtgcatgcgcctgtaatcccagctactcgggaggctgaggcaggagaattgcttgaacccaggaggcggaggttgcagtgagccgaggttgcaccagtgcactccagcctggggcaacagagcgagactccgtctcacatttttttttttttaaaaagaaagcttctttgcccatctctggacttgggacaggcaccttcctgctgtcaaatgaaaaggtcagagaagaagaactggaactagatgatgaggcacagcccact

SEQ ID NO: 35616 - DNA, 601 bp, Human
tttaggagtctcctccaggaagcgtccagtcagaaggtggatgctggctcgggagccctcaggggtcaggcctgaccatctctccaggttaggtttgaatcagcgtcagaaagcttctttgaggccgggcgtggtggctcacacctgtaatcctagcactttgggaggccgaggcgggtggatcacctgaggttaggagttcgagaccaccctggccaacatgatgaaactccgtctctactaaaaatacaaaaattagccgggcatggtggtgcatgcgcctgtaatcccagctactcgrgaggctgaggcaggagaattgcttgaacccaggaggcggaggttgcagtgagccgaggttgcaccagtgcactccagcctggggcaacagagcgagactccgtctcacatttttttttttttaaaaagaaagcttctttgcccatctctggacttgggacaggcaccttcctgctgtcaaatgaaaaggtcagagaagaagaactggaactagatgatgaggcacagcccactgcacttgggagcgaatttctctgcccagacaccaggctagacaaggcccacctgcgtggaatgtgat

SEQ ID NO: 35617 - DNA, 601 bp, Human
tcccacagtaccctgagaatcattgcgcacggcagctcatggactaaacatggaccacgtggttctccaaaaaatgagaaactagctgcaccagagaatccccatttttgacttgtcgagacagaccagaagttgtgtgtgtgcctggccacaccccacgtggagcgctcactggggccgaggcacagctgccccctttggatggggcgcgtgtagcctggctctccccattgcccgtggccccatctccgtcggaccagcctggcttgcaggcactgggtgcacacaggaaggggcctgygaatgctccatgccagcacgtgcggagccggggcaggccttgctggtggtcaggcccctcacacactcaccgagggtggcctaggccttccccctccgtggccaggcacccttgctgccttctcgtcattgtcatggccttggccacaggaatgtgggtgagcagcgtggtcagggtcctactgaggtcagccttccgcactggacccctggctcctggcctttgcttcttggccctttgggccagggctgcctgctttctctaggcctgggtggctatcccacggtcttggtcctcaga

SEQ ID NO: 35618 - DNA, 601 bp, Human
ggcagctcatggactaaacatggaccacgtggttctccaaaaaatgagaaactagctgcaccagagaatccccatttttgacttgtcgagacagaccagaagttgtgtgtgtgcctggccacaccccacgtggagcgctcactggggccgaggcacagctgccccctttggatggggcgcgtgtagcctggctctccccattgcccgtggccccatctccgtcggaccagcctggcttgcaggcactgggtgcacacaggaaggggcctgtgaatgctccatgccagcacgtgcggagccrgggcaggccttgctggtggtcaggcccctcacacactcaccgagggtggcctaggccttccccctccgtggccaggcacccttgctgccttctcgtcattgtcatggccttggccacaggaatgtgggtgagcagcgtggtcagggtcctactgaggtcagccttccgcactggacccctggctcctggcctttgcttcttggccctttgggccagggctgcctgctttctctaggcctgggtggctatcccacggtcttggtcctcagaggggtgggtcccctggcacctgccctgggt

SEQ ID NO: 35619 - DNA, 601 bp, Human
ttgagtcctccccatcacctccctgctggtccagcagcacagcctgtgatctgcctgaccctggaggtctgcccccgtcatccaccccttttcaaggcagagagtagagggccctggaaggggtcatccttcctcctccaggccccagccgagtgctgtgtgtacctaggagaccagggggacaggcccacccacagcccagttccagccgtagacagcagcaaagcactgtctggtttgttcttggatcccggggcctgggagtcctcctggggtagctggaggaagtcagcttcttacmgatggtggctcccagctttccctcctctcatatcagcgttggcctcacctggcatctgcccagccagcagggccatgacttttggttgaactggccacccctggattttggggaggagagaaaggatgtcctgggctgcttttctcctctcaccttttgtgttcagaggcagaggtgtgccctggtcctcactctctcccccactgttcttcccctccaggcccctgcctgcaccctatcctgccatgtccctggtgacccatccttcccgcccacacctgccagtgtgaggcacacagg

SEQ ID NO: 35620 - DNA, 601 bp, Human
tgtacctaggagaccagggggacaggcccacccacagcccagttccagccgtagacagcagcaaagcactgtctggtttgttcttggatcccggggcctgggagtcctcctggggtagctggaggaagtcagcttcttaccgatggtggctcccagctttccctcctctcatatcagcgttggcctcacctggcatctgcccagccagcagggccatgacttttggttgaactggccacccctggattttggggaggagagaaaggatgtcctgggctgcttttctcctctcaccttttgygttcagaggcagaggtgtgccctggtcctcactctctcccccactgttcttcccctccaggcccctgcctgcaccctatcctgccatgtccctggtgacccatccttcccgcccacacctgccagtgtgaggcacacaggtggcaggtgctggagccggaccgggctgttgggccaggctctgacaggaccctcgggaccagctcctgcataccccacacccccacaccctttcccatgcatgcctcgcttcagtggctgtctagaggtgggtattcttttttgtgcagtaaaatagaca

SEQ ID NO: 35621 - DNA, 601 bp, Human
ttggtgagaacgccagggaggagctcagcccagttcctctgccgactctgagcaaatgacccacagagcattgtgccaggagccagcccaggctgtcatctcagagaaaggaaaggaaaggccccaggactggggccgtaggcggaggagcagctgggggactgagggtcaggtctggggcaaatctggggcctctcccacccgctccctggccccggatctgcccttcatcaggaatctgcttccaagcagatctgatttgcctactgagccatgcccccagggaagctgggccctgaaygagctgggcttttgggccacaccagagggaggaagttccctttcatctgctgcctgcttgtgtgatgcagatgaattctggcagaggaaccctgagcatggggtatggacccaggcctggctcgggtctccgcaggagggggtaagagcgacagagtctccgtccagagtgaccctccagcgtctcgggcctggcctctgcgcccaccccctattgcagcacctggatgggtctccctggttctgcattttccacagcaggcagagtgcattccaaaccctgccgggccgaggcctgcac

SEQ ID NO: 35622 - DNA, 601 bp, Human
cctgctgggagatgccgtctacagactgggtgtgaaaggcgctgccctgcgtgaggtagcagatctccatgtctcttctgtgttgtgattattgtgagcatgggaagtgcacatttggtcacacatgtccgtgctcccacacacagcctttcctgtgagtgtgcctctcatctagcacccagggcccccttcccaccagcgcccgctcccctgtgatgaggcctgggtacatcagcacatgcctagcccctgtgccctccctgcaccagcccctcagttctccggagccaactggagaacytgagcctctagacccactgctgtcatagtcacccccttttggtcacgccactgccttttctttttttcttttttcttttgatactaagtctcgctctattgcccaggctggagtgcagtggtgtgcaaactccgcctcctgggttcaagcgattcttgtgccccagcctctcaagtagctgggattccaggtgcccaccaccacacccagctaatttttgtattttgggtagagacagggtttcaccatgttggccaggctggtcttgaactcctgacctcaggtgacccgcccacctcg

SEQ ID NO: 35623 - DNA, 601 bp, Human
acagtgttccactgcttttgtttaacacttgaaaaccactggcctagaatttacaggttctccacaagacctgaggatcccaaaggagtgaatcgtaaacagtgaatgtcaagcgcaagatgttgcctcctggctcccaccttcagcagttgggaccgtagcagcgggggttggagacagcagaagctagaaggggggctgtgggtctggctgggacccaccctacccccaccccacgtccaggccaggcagtccccagggacacgtcctacctgccttctagcctggtccctctgcctgmtaaggcccagactatgtgcccccaggctcaccggccatggagcacccccactggggccacaggatgagcccaaactcaaaacaatcccccccacccaggtcgtccctgcaggcttagggttcccaacacacctggctcccccctctcctctgtgtgcacaaacacatgcatgtatgcactcacacactgttccctcgcctagaaccctcccacttatgccccttgtcagtccttccaaacccaacgtcaagtgttccctcctgcacgaatccctccctaaccccccaaccttcggtgcct

SEQ ID NO: 35624 - DNA, 601 bp, Human
gtccctgcaggcttagggttcccaacacacctggctcccccctctcctctgtgtgcacaaacacatgcatgtatgcactcacacactgttccctcgcctagaaccctcccacttatgccccttgtcagtccttccaaacccaacgtcaagtgttccctcctgcacgaatccctccctaaccccccaaccttcggtgcctccccagtggcttagtgtccccagcagtgtcttgtgccctggagtgagagtcacccttgggctcggggcagccaggccagggctctgggggacgcataagccrcctccagaggacatcagccatgcagcgtgctgagagatggcatcaatggtccaggagctcattagagatgagccattatctggccagacgctgacacagcggggacccccacaggcctcccacggcccatctgtctctcacctgccagggccccggagatgggccttccaggtgtctgagctccccggcatgtaggaccccagcaggctgtgtggcagtgagcccgatgccaggggacagatggcagaggtggtggcctggctgtgagggacaggtgggcctcctgcttcgtgttgtgca

SEQ ID NO: 35625 - DNA, 601 bp, Human
cacctggctcccccctctcctctgtgtgcacaaacacatgcatgtatgcactcacacactgttccctcgcctagaaccctcccacttatgccccttgtcagtccttccaaacccaacgtcaagtgttccctcctgcacgaatccctccctaaccccccaaccttcggtgcctccccagtggcttagtgtccccagcagtgtcttgtgccctggagtgagagtcacccttgggctcggggcagccaggccagggctctgggggacgcataagccacctccagaggacatcagccatgcagcrtgctgagagatggcatcaatggtccaggagctcattagagatgagccattatctggccagacgctgacacagcggggacccccacaggcctcccacggcccatctgtctctcacctgccagggccccggagatgggccttccaggtgtctgagctccccggcatgtaggaccccagcaggctgtgtggcagtgagcccgatgccaggggacagatggcagaggtggtggcctggctgtgagggacaggtgggcctcctgcttcgtgttgtgcaatcagggactcctgtccccctcggcgc

SEQ ID NO: 35626 - DNA, 601 bp, Human
ggagacgggagcactttgccccagaatctcctcctgtgcgggaatgaacagccctagccactgggactcttccgcctggggctgcgttcccagctctgggctggcggctggagacccggaaagagtgagcaggccccaccctgagggaacccagccaggccagacaggcagacaatgatgataaatggatcaggaccgagaacatggggaccctggtcctggcacaaaagccagactcaggaaggggcagtgctgcctgggctcggtcggcccaagtggcccagcgtcggccggagggccwgggtcacggcaggaagggccagcctgggcaggtgggccgtggccctgagagaccctggctccagccaggcctgacctgcctctgtcctttcaggcacgccagccccacgggcctgctcctgacggtgctggtggccctcacctacataatggctctcctatacgaagagtgagtaggggctgcggcgggtgggggcgtggctgcccgactggccctgtctctccctctagaacctttccttgtggccagggcaggctcaggacaggctgccgtcagccaggcccactccagggctcccag

SEQ ID NO: 35627 - DNA, 601 bp, Human
cccagccaggccagacaggcagacaatgatgataaatggatcaggaccgagaacatggggaccctggtcctggcacaaaagccagactcaggaaggggcagtgctgcctgggctcggtcggcccaagtggcccagcgtcggccggagggcctgggtcacggcaggaagggccagcctgggcaggtgggccgtggccctgagagaccctggctccagccaggcctgacctgcctctgtcctttcaggcacgccagccccacgggcctgctcctgacggtgctggtggccctcacctacatartggctctcctatacgaagagtgagtaggggctgcggcgggtgggggcgtggctgcccgactggccctgtctctccctctagaacctttccttgtggccagggcaggctcaggacaggctgccgtcagccaggcccactccagggctcccaggtcagagtggccatggtagcttacaatgcggcctgcaggacccagcaggcagccggcccctctcccctcccctctcccgcctgcgctctgaaggctccaagtcagtgttgccccagtggctctgggggatgaaggggatcccggtccca

SEQ ID NO: 35628 - DNA, 601 bp, Human
tcctttttctgggttggaatcagtcctctatctttacttctataccttcatgttttcatgccattccttcgtaatgcaaatagctcaaaggcgattataactatactcacagacacctgcctggctattgatgacggattcttccaagtgtatggaactttataaatttgagtaggacttatggtgtgaggtcactatttacatccctaggttttctggactctggttctcaggtataccatgctccataaactagaagaacaatctaaaagttaaaaataaactgctgtgtgtcaactcmaaataaaatcctaagcccatcacggactgaacagagcccctcttggcctaggggaccccagaaaaatcctaaaactgagctcctggccatgacaagatgggaggtctgacatgccctgttatattcgttgtgttttcaggtttagagacagcaacttaccagcattaaagttaaaatagagatcataagaatgacacaacagattctttgtgcaataagataccaaattataaacaagacctaaggccatgccaggcaagggttaagttacacactcctacatttaaagaataaaagtta

SEQ ID NO: 35629 - DNA, 601 bp, Human
gctgaaatagcaatggccttttggatacacacactgtgtatgagggtccagctgggggaggccctctgggtagggtttaagagcaactgtccattccagtgcattctcctcggggtttagttgtcttcttcccatgtcatgcagttgtttcatctatgctgcctagttctatttttttgtctctgctctctcaagaatctgtttcttctttaggaggaaataagaaagggcacttagtgtttagttgtgaacgcagactcttgaaggtgagaaaaaagaagatttgacttcaagaatacawgaggaatgagcaaatgacagtaaggagccggaggcagccaggctgacctgtgtcatgagctgtcctactcactatggtgtattcaatcaggcataaagctgtgattctcctagggctcagaggaggcagccatgctcttgtcttagcagaggtcaaagtacaagaactgatcagagcagagggtttttctatttattacaaaagttgttacacaaatacagctgaccagaaggtctaaaaacagcccagactcttccaaccctcatgcatctgtagatagaaggagagctgtggtcttgc

SEQ ID NO: 35630 - DNA, 601 bp, Human
tagcagggtgtggtggcatgtgccggtagtcccagctactcggagggctgaggcagaattgcttgaacccaggaggcacaggttgcagtgagctgagattgcaccactgcactccagcctgggagagagagtgagactttgtctcaaaaaataaaaataaaaaatttaaagaatgcacatagagcattcagcatcttcaacctgggtaaatgtcaactaccatgggcttctagcctgaggagtggcttcatctctaccaggtctggcctcctgtgcctacagccagtggcaggaagtcctrggtgcaggaggtggtgctgctagtggggtgccaggcagagcaaggccgggcagggaagcctgcaggacagatgtacctctttcagcttcttggcccagggcttctgtgccttccgaaagccgtcctcagcttccttggtctccttgaagccgcccatcatctgcttgtgaaaggcttccttctgccagttcttgatcttctcgaagtcatcgttcatcagtgaggccttcacctcgaggtgcagctcgctcaccctctctgcctcggacatgaaggccatccaggccttctccacggtcc

SEQ ID NO: 35631 - DNA, 601 bp, Human
ggaaaagttacatgccagagtcaattagagggcattaagtgtaggggaggacaactgagacggagcatggggtgggtggagaaagccactgagatgacatggaacacgcacatggagcacgcacatggaacacgcacatggaggggttatgggcatcccaggaagaccatgccaggccgcaggatcggcaaatacaaagaaagttccaaggaggaacccagcatgagagagaggaccatactagggggcagggccatcagccacatttcctctggttttaatggtttttacacacacacayacacacacacacacacacacacacactcttaacagatccttccttatttgagccaaagccacaaatttcattctagagggaaggaggagtttattagcaaaggcctcatgagacacagacagtttcattatgaatggggccagggacaaaacagaagagaaaggagatgtgacaaaagctaagacacagagaaaaggagacacagagaaaaccatccggaaggacagaggcatgttctggatgattctgaggcggaggaaggcagcgcaaggccagagaacatctgggtgttgggggtgg

SEQ ID NO: 35632 - DNA, 601 bp, Human
gttcgaggcaccaggaacacagcaagaaacacaaggtctttgtgaagctttcatttgagttgcaggaggcagatacagtataggaaaagttacatgccagagtcaattagagggcattaagtgtaggggaggacaactgagacggagcatggggtgggtggagaaagccactgagatgacatggaacacgcacatggagcacgcacatggaacacgcacatggaggggttatgggcatcccaggaagaccatgccaggccgcaggatcggcaaatacaaagaaagttccaaggaggaaccyagcatgagagagaggaccatactagggggcagggccatcagccacatttcctctggttttaatggtttttacacacacacacacacacacacacacacacacacacactcttaacagatccttccttatttgagccaaagccacaaatttcattctagagggaaggaggagtttattagcaaaggcctcatgagacacagacagtttcattatgaatggggccagggacaaaacagaagagaaaggagatgtgacaaaagctaagacacagagaaaaggagacacagagaaaaccatccg

SEQ ID NO: 35633 - DNA, 601 bp, Human
tcctgtgaacttttaaatcacaagacgatgacgctgtctggttttaagtcctgtgactccaggaccttccaggcagaatcacttatctacacctgcggagcatgtaatagtttacacaatgatttctcattaacccatggggcagaaaatctccgcttcacaacagaaatggaagggcacccatgatgccacagtgcctggtcacggtctctccttggccaaagaccacccttctgccacccctggctccacagcctctgcctcactttcggggcctgtcactgtggagactgcagggccyctccatcctccctcccacctggctcccccagacaagcgctcccagcctgcagtccctcccccaggtctctgcccccagcccctctccctacacaagcagagcaatccttctaaaccatctcaccctcctcacctcctccctgatcccacccaggctcaggccttcctgagtggctcctggtcagcagcatcctaagctccttactcagcctggctgtccaggccactggtgatttggtcctcataaccctccataccagctcacaccacacccattcacacccaccactggccacaacca

SEQ ID NO: 35634 - DNA, 601 bp, Human
gtctccctttctctcacacaggcacgcccccgcccaacatggagaagccccatctttcctctaggcacctttttgggcacctgattccctgggattctggcaaaggcccgagagttctcccggaccttgtgcttcttgagcccaggtgcctcccactcagtagttggttccaggctcctcacctgatcccaccgtggaggcacctgggctgcttcaaaagcccagattcctggctccagcaatgggagtgagaggggtttcccagaggattctgacacttggtctgagtgacgcactctcrtgtagatgacgtgttccccttgctacaccgacggcatagcagtgaggaacagtggagaaagggcatatgtatgggcttgaggtcagaagttcctgctctcacctgctggatggcacgtgacttaacctctctgatcttggtttcctcattcacaaaacagggatgccaccacctaactgacaggggccaggaaaggctggtgggtagtgaaaccagcttaggcctcttgcctcccctctgcccatgtcctcttcctggagtgcagcctctctctacctcattccgtctctctctgcaaat

SEQ ID NO: 35635 - DNA, 601 bp, Human
catctctgtctccctttctctcacacaggcacgcccccgcccaacatggagaagccccatctttcctctaggcacctttttgggcacctgattccctgggattctggcaaaggcccgagagttctcccggaccttgtgcttcttgagcccaggtgcctcccactcagtagttggttccaggctcctcacctgatcccaccgtggaggcacctgggctgcttcaaaagcccagattcctggctccagcaatgggagtgagaggggtttcccagaggattctgacacttggtctgagtgacgmactctcgtgtagatgacgtgttccccttgctacaccgacggcatagcagtgaggaacagtggagaaagggcatatgtatgggcttgaggtcagaagttcctgctctcacctgctggatggcacgtgacttaacctctctgatcttggtttcctcattcacaaaacagggatgccaccacctaactgacaggggccaggaaaggctggtgggtagtgaaaccagcttaggcctcttgcctcccctctgcccatgtcctcttcctggagtgcagcctctctctacctcattccgtctctctc

SEQ ID NO: 35636 - DNA, 601 bp, Human
tcactctgtcacccaggctggagtgcagtggtgtgaccacagcttgcagcagccttgaactcctgggctcaagcaatcctcccgcctcagcctccaaagtagctgggactacaggcacgtgctaccacacccaactaagtttttaaattttttgtagagatgaggtctcactatgtttcccaggctgtgtgctggattttggaaactgcgtcaagaagggtggtggggagggactggcctcctctccagagctctaggcacacaaggacctctcatatcctgcagtcactggccagaccamagaggcagggagggtcccaggagggaacccactacaaactgtcccagtcatcctgccaggcgcttatgtccaacctcgagccctgggcctgttctgcaaaagcctgagttgatgttctgggtggctgtcaaacatgaaaggcctcttcctctccatctctgtctccctttctctcacacaggcacgcccccgcccaacatggagaagccccatctttcctctaggcacctttttgggcacctgattccctgggattctggcaaaggcccgagagttctcccggaccttgtgcttcttgag

SEQ ID NO: 35637 - DNA, 601 bp, Human
gggactgagtctaccctgcccatgcggctcccctcccagatgctctcctctgactcacgtggctcagagccctgggagactctgcttcaggctccaaagcaactcctcttcttgaagccttccccagcctcgtgagaccaggttccaccccgccctctagggccctgactcctgcccctttctcctctcctggtatccgggtccttgctctgcttctcagcctcctaagatggctgggcttgggtcctctgtgccaggaaaaggccacccctgccagggctggggcatgcccagcagagaragagctccacagcgctgtggctattcccctattccccacagccatccacactgcccgtgcccactacctggcagccctgcatgggagcctagctcagaagcccaagacacatagctgtgggttcagcgcccagcatctggaggatactgctgaagtgacacagagcagccccatctcaggagccttcaagacacaatagcctcccgggagctctcagggtactcagtggcaacaagatgctccacctctgggctgcccctgccctcagcctgtgccgaccctgctagccccaagtcctgc

SEQ ID NO: 35638 - DNA, 601 bp, Human
acactggtacacacttccccgcaccccctcatctcagcatgcagggccaccagtttggtggccaggtggttttgttagttggtgggatcatggtcgtgttgtccccctggggtgggtgagagatagcagggctggggccacctatttattgcaattctttctactatgggggtagtcacgggctccactcaggtctaagctttgctgtccctaacaacatgtgcagggccttctgaggaaggatggagcgcttcccgagacactgcaggcctatcgggcaccctctctgcccccagctggsactgagtctaccctgcccatgcggctcccctcccagatgctctcctctgactcacgtggctcagagccctgggagactctgcttcaggctccaaagcaactcctcttcttgaagccttccccagcctcgtgagaccaggttccaccccgccctctagggccctgactcctgcccctttctcctctcctggtatccgggtccttgctctgcttctcagcctcctaagatggctgggcttgggtcctctgtgccaggaaaaggccacccctgccagggctggggcatgcccagcagagaaag

SEQ ID NO: 35639 - DNA, 601 bp, Human
tgacttcaatgacgtgtgtgttttagctcaaaggaaacttacccagccacattggacaggtctaggtgcttctgaacctccagcagaacctcccggaagaagcgaaggcgtttctcctcgaactgctggcactgctcaaacacctgctccatgttctccatgtactggggtgtgccctggtcgagttccttcagggacttctcatacttctctttggtctaaaggaaaatccaggcacaagacagaggttcatttccatttagcccttggctcaccctgcccctggagtgtctcaggcctycccagattccaaatgcaaagaaaaaacaggagctctggattctgacagacttcaagttcaagtcccagttcctccactcctgcaaggtgaatcacactcctgccatctgccctgtctctcagctggagcaaggcccagacaggtagatgccggcaaagggcagtctccccagaactcagtgtgtatggtcttgagcgtgccacacgcccatgtcctcttctccctgtggggaagggctgtgcctggctaccctcaagcctcagatctggcccacagcaaaggtggggctggggctgaatc

SEQ ID NO: 35640 - DNA, 601 bp, Human
gtgaaggcatcacagaaccaaagatgaggaaagcacagaagaaacagcacagcttccatatcacaattcagaaccaagtctcagagggtatgtgctgtcctgggggctgagagccactaagcagtcacctgatcacaaagggcctcaaagaaagactgtcccaggcacgaccagcccagaaatgccagattcacctccagtggatcttacatatgccagctgcggccaggtgcggtggctcacgcctgtaatcccagcactttggaaggccgaggtgggcggatcacaaggtcaagagatygagaccatcctggacaacatggtgaaaccccatctctactaaaaatacagaaattagctgggtgtggtggcgcatgcctgtaatcccagctactcgggaggctgaggcaggagaactgcttgaaaccagaaggtggaggaggttgcagtgaactgagatcacgccactgcactccagcctggggacaaagcaagactccgtctcaaaaaaaaaaaaagaaaagaaaagatatgccagctgccttggtcctagctgtggccccagaatgggcaatctccattcccacccagacctgtacat

SEQ ID NO: 35641 - DNA, 601 bp, Human
ctatcataaaaatggaatggtggcagagcagcagcggtgcagtaactgttgcttttgatgattgttacacagagggagacaaacggaatgtgtctcctattaacagcaagccttgacccgtgacgcatccctacacggttctgctagatggatgacagtaatccacgtccttgacttagctgggacctctgccctggtgaaggcatcacagaaccaaagatgaggaaagcacagaagaaacagcacagcttccatatcacaattcagaaccaagtctcagagggtatgtgctgtcctgggrgctgagagccactaagcagtcacctgatcacaaagggcctcaaagaaagactgtcccaggcacgaccagcccagaaatgccagattcacctccagtggatcttacatatgccagctgcggccaggtgcggtggctcacgcctgtaatcccagcactttggaaggccgaggtgggcggatcacaaggtcaagagatcgagaccatcctggacaacatggtgaaaccccatctctactaaaaatacagaaattagctgggtgtggtggcgcatgcctgtaatcccagctactcgggaggctg

SEQ ID NO: 35642 - DNA, 601 bp, Human
taggagacatgctggagtccaaaccccagtgcctcggaatgtggccttatttggaaataaggtctttatagaggtaatcaagctaaaatgaggtcactagcaggggccctaatccatatgactggtgcctgtattaaaagggggaaatccagacacagagacagacaagcatccacacgatgggagtcactccacatgcagaagagcctgacacaggccagcctcaccctgctcctgccagcagagcagcctcgggcaagtcatttaatctcacccagcctcagcttcctcatcaataagrtggggtcagtgccacccactttacaagactatcataaaaatggaatggtggcagagcagcagcggtgcagtaactgttgcttttgatgattgttacacagagggagacaaacggaatgtgtctcctattaacagcaagccttgacccgtgacgcatccctacacggttctgctagatggatgacagtaatccacgtccttgacttagctgggacctctgccctggtgaaggcatcacagaaccaaagatgaggaaagcacagaagaaacagcacagcttccatatcacaattcagaacca

SEQ ID NO: 35643 - DNA, 601 bp, Human
acagggtgggtcagggacctgaggtcctgtgtgcctacggctcctgagactgactaggaaggaagggaatgccagtggccaaaaagtgacagtcaaacattcccaactagagaggacataaccgcgacttcaggagaggttcagaaggccttcggtaatgcctgcagccccccaggactctatgccagaacttggtctgtactatagctatgcctaaaggctgcctgataaacagggcaaacactaacatagagtctagaatgagaaagacatcatctagcaactctgtgggcccaggtcytcttccaggctgatgagctcatgggcacaccctcctcttacctcaaactgcggccagttcatggccatgcccggcccgtgattggctcggaaccacctcaggtcctccactgcatcagctgctctgatgctctgctccaggtcatggtaaatggctttgtagctaaatcagagagaaacgtggctcttttagaaggcaggggccagctaccctttgtcccagcccagtgccagccacagcaggtcccgtggtctctgccctctgtgagttggtttcacagacagagccagaacactcctc

SEQ ID NO: 35644 - DNA, 601 bp, Human
ctaagggacccaggcgaatttcacaggtggtttcctgtgccactccgggagcagcaaatcctcgctgtgtctgaaaccccagctgtgcacaaaacacgtcagccaagacttcctggtgtgtggctccagaggagaggctgggctttgtgctgtcccctctagggccgcttccagtcaggacggctctggccctccatgctctctcagtgcctctgtggaaggggcacagctgctctactgcctcctactgggagcaagtcctggggctggcgcaggggagtgctcggcagcagggcccacrctgtcatttggaaaaaccttcctgttaagggccataaaagaagtgcaggagtaaggactgacaaaactgcaggctatgaggcgcccaggaggtttctgagtggtgggcctgggtcaatagccctgcgtggacaaagtcaccatgttccctaacagcccccgacaggagatgggtgctcttgtcattcccattccacacgtgggaaaactgagtcacaaaaagggcgaatagtttgctcagcttcccacaggtggtcagaggtgagcagaatctgaatgcagcccgggctctggccgctgc

SEQ ID NO: 35645 - DNA, 601 bp, Human
cctagcgggggcagcacacccacccatgcgggccacagacaccctgcatggcgtatggcactctatgaggtagccgaacgcagacacttacttcatccttgtggcatgaaaaataaaaacaaagaattgcattagagaaaggcatggtcccgtaacagctgcaaatgtgcgcagaatgaatgcacaggggctggttcccagcccatggacccacagagagaaggaccccctaggctctggctgggacaccctccaggagacagactgtcaaatagtcctccccactgtgcccctctttgggtataatgggcacctctaagggacccaggcgaatttcacaggtggtttcctgtgccactccgggagcagcaaatcctcgctgtgtctgaaaccccagctgtgcacaaaacacgtcagccaagacttcctggtgtgtggctccagaggagaggctgggctttgtgctgtcccctctagggccgcttccagtcaggacggctctggccctccatgctctctcagtgcctctgtggaaggggcacagctgctctactgcctcctactgggagcaagtcctggggctggcgcaggggagtgctcg

SEQ ID NO: 35646 - DNA, 601 bp, Human
ccatgtggaaaggcaggtgcaaataaaaccaggtgcaaataaagccactgcaaataaaaccagggctaggtggctacccgctgacagaaggggcaggcaagcagactctcagtctccaaagcgcagggccctccccagtgttttgctgccctgggacttttcctctgtgatctgagcacatgctggggctaacgaagcaaagcagagtacgctcctcctggaagcctcacgagttctcgggtggcgaactggcttcaccaaccgcactgaaaatggactagggcaaaaccatgaatggagmctgtgtcttgattttctagaagagtctgtgcatgcccgcaggtgtttaatgagctctccttccccccatctccaccagttaccagacaactctgattaaaacttggtgtggctgagtccacggctctgctcacacgtacttacagaacttttgggttggaagccaactcagaagcatcctgtctaacctgtccatttgtcagattaggaaactgaggcccagaaaggcaatgtgatttgcccacgcagtgtgggtggcagacttgggcccgaccccaaatctgggtcaccttttcatcta

SEQ ID NO: 35647 - DNA, 601 bp, Human
ccctaaattgtccctgggccacagggtcaagacagttggcttcggagacctgagcaagcctgccatgtggaaaggcaggtgcaaataaaaccaggtgcaaataaagccactgcaaataaaaccagggctaggtggctacccgctgacagaaggggcaggcaagcagactctcagtctccaaagcgcagggccctccccagtgttttgctgccctgggacttttcctctgtgatctgagcacatgctggggctaacgaagcaaagcagagtacgctcctcctggaagcctcacgagttctcsggtggcgaactggcttcaccaaccgcactgaaaatggactagggcaaaaccatgaatggagactgtgtcttgattttctagaagagtctgtgcatgcccgcaggtgtttaatgagctctccttccccccatctccaccagttaccagacaactctgattaaaacttggtgtggctgagtccacggctctgctcacacgtacttacagaacttttgggttggaagccaactcagaagcatcctgtctaacctgtccatttgtcagattaggaaactgaggcccagaaaggcaatgtgattt

SEQ ID NO: 35648 - DNA, 601 bp, Human
ggaacctcccaggtgtccaggccggggctgccctggaccatgcagattgcccagggcccccaccatggaacggcctcttttggatggaggtggcgcccactcacctgctgggcttactcggcagagactggtcgcctgtctggttgatgcccgtcagggtgacgccgtcagtggccttcttcttctctctccggctgagggttcgattcaggtctgcggaccactcctaggcaacaggtgccgagggagagaaaccaaaggttcactacttgctggaagccacgtctgtcctcagttcctrcccagcgagcctgcagttggctctgtgcatctgatgtgtagactcagggccccagctctccctggtttcccagaagacctcaggctccccatgccccacttatgaacccaaacgacctgagcccctcctcactgttcaaagcaggggctcatcaggggatctggaggcttgcacctctacaaccacccccaggccatgctgcccacctcccagaggaccagcgggggtggcgaggaccagggcaaggtccggggcctcctgttcctgaccccacccaccaaggttctcagtcccagcccc

SEQ ID NO: 35649 - DNA, 601 bp, Human
gatgcctggcagtcctctcctgtccctccctcgactggcgcctgcacacaatacagagtgagcatgaacctcggcaggacctcagctgcctgagggaaccagggtggcacctccaccagtgtccgggcagggcggtgctatccctggggacatgaatgccagccctgtcatcagctcctccccactcaggtctgaagctcagggccaagcctccctctctggatctgtcagcagctctggcaccaggcaggaagacgaccttccctggagatgcccctgggccacggcccacagagctcargagcccaggaacctcccaggtgtccaggctgggccacggcccacagagctcaggagcccaggaacctcccaggtgtccaggccggggctgccctggaccatgcagattgcccagggcccccaccatggaacggcctcttttggatggaggtggcgcccactcacctgctgggcttactcggcagagactggtcgcctgtctggttgatgcccgtcagggtgacgccgtcagtggccttcttcttctctctccggctgagggttcgattcaggtctgcggaccactcctaggcaacaggtg

SEQ ID NO: 35650 - DNA, 601 bp, Human
cacacactttccagaaggttctaatgaccacagtgccacccttatatctctcattttcagccaatgactaagtcagaaataaccaatgctcctagtgaagaggtaatttggaaaggagatgcctggcagtcctctcctgtccctccctcgactggcgcctgcacacaatacagagtgagcatgaacctcggcaggacctcagctgcctgagggaaccagggtggcacctccaccagtgtccgggcagggcggtgctatccctggggacatgaatgccagccctgtcatcagctcctccccrctcaggtctgaagctcagggccaagcctccctctctggatctgtcagcagctctggcaccaggcaggaagacgaccttccctggagatgcccctgggccacggcccacagagctcaggagcccaggaacctcccaggtgtccaggctgggccacggcccacagagctcaggagcccaggaacctcccaggtgtccaggccggggctgccctggaccatgcagattgcccagggcccccaccatggaacggcctcttttggatggaggtggcgcccactcacctgctgggcttactcggca

SEQ ID NO: 35651 - DNA, 601 bp, Human
agtgtcacatggaggcctgtgggcaggtcctataggaagacctcctctagcacacactttccagaaggttctaatgaccacagtgccacccttatatctctcattttcagccaatgactaagtcagaaataaccaatgctcctagtgaagaggtaatttggaaaggagatgcctggcagtcctctcctgtccctccctcgactggcgcctgcacacaatacagagtgagcatgaacctcggcaggacctcagctgcctgagggaaccagggtggcacctccaccagtgtccgggcagggcrgtgctatccctggggacatgaatgccagccctgtcatcagctcctccccactcaggtctgaagctcagggccaagcctccctctctggatctgtcagcagctctggcaccaggcaggaagacgaccttccctggagatgcccctgggccacggcccacagagctcaggagcccaggaacctcccaggtgtccaggctgggccacggcccacagagctcaggagcccaggaacctcccaggtgtccaggccggggctgccctggaccatgcagattgcccagggcccccaccatggaacgg

SEQ ID NO: 35652 - DNA, 601 bp, Human
cggccctcctccctccttggcacctttctctagcagactgttgtgagacggcactggtgggggcggctggattgtgcagcaaccctggccagcccagggcccccagggtctcctctgaggcagtgtttcttctttcccattcccacccccaagcatacaggtgctggcctgatccctgggacaggcacttactgccgagcccacctgcccagacagtgtgcaaagcagcggaatgacgacagccacacctgctggggagcctgggtgggggcttcagtgcctggggctgcaggaaggccawgggaacctgggctaagccttcttaggaagcccccgtatgaaatgactattactgagtgtcacatggaggcctgtgggcaggtcctataggaagacctcctctagcacacactttccagaaggttctaatgaccacagtgccacccttatatctctcattttcagccaatgactaagtcagaaataaccaatgctcctagtgaagaggtaatttggaaaggagatgcctggcagtcctctcctgtccctccctcgactggcgcctgcacacaatacagagtgagcatgaacctcggcagga

SEQ ID NO: 35653 - DNA, 601 bp, Human
ctgcctcatccacttcagcctggcaagtggtacttgacctaggcctgctggaggccaatatccaggccacatgtctgagctcaccggccctcctccctccttggcacctttctctagcagactgttgtgagacggcactggtgggggcggctggattgtgcagcaaccctggccagcccagggcccccagggtctcctctgaggcagtgtttcttctttcccattcccacccccaagcatacaggtgctggcctgatccctgggacaggcacttactgccgagcccacctgcccagacagygtgcaaagcagcggaatgacgacagccacacctgctggggagcctgggtgggggcttcagtgcctggggctgcaggaaggccatgggaacctgggctaagccttcttaggaagcccccgtatgaaatgactattactgagtgtcacatggaggcctgtgggcaggtcctataggaagacctcctctagcacacactttccagaaggttctaatgaccacagtgccacccttatatctctcattttcagccaatgactaagtcagaaataaccaatgctcctagtgaagaggtaatttgga

SEQ ID NO: 35654 - DNA, 601 bp, Human
aagattcctttggtgctccagagggaaaatccagtcgtgcaactgcctactgtttgccaggcccagtgtgggaaccagagagatctgggccaagctctgcctgagggctgggagccgggagctgagttacacactacgaagaccacaggcagaccatcaagcaatccaatcagacaggcaccaagggccctggcaccccaccaagtaactgatcctaggaccgggctaccctggccagcagcaccttctacttccaagaccagggcctcagggcacaggcccccaaagcactggatggackgctcagcctgagcacccaccaccccagaaccaaggaagggaggcgaggacatgcctccaatgccaccagggtgatcctgagtggccagtaactgcctcatccacttcagcctggcaagtggtacttgacctaggcctgctggaggccaatatccaggccacatgtctgagctcaccggccctcctccctccttggcacctttctctagcagactgttgtgagacggcactggtgggggcggctggattgtgcagcaaccctggccagcccagggcccccagggtctcctctgaggcagtg

SEQ ID NO: 35655 - DNA, 601 bp, Human
aggcggctggagatgcccacagcagaggccaacctggggcctcactctctagtccccagcacagactgcgcgttgtctgttttcctgtcatggtgctgctagggccttgaagggttaacagaggacagagaaaaagcaacttaagattgttagctgtgccctccccgaggaatgggggtgccagagagcctgtgccagagagcaggtagtgggccagggtgcggcacgccaggtgcccacttcctgcagagcttcgtgcattgccgagtgccgaggggtgagacccctggacagagagaggggaagagagacagagtgagcgcggtgggagcagaggaagcatttgttcaccaactttttggccttagtgtcgtccttctcactgacggtgctgcccgtgtcgtcctcatcctcgaaggggttgtagctggactgtgactgcgcagactgggcggggttgctcgggacattaagggtgctatggagagagagagctttcaggggatcccagctctgcaggggcccgtgagggtcctggcaactcctagctgcaggatctcaagagacaaatcagctcctcctgtgaccggaggggaccgtg

SEQ ID NO: 35656 - DNA, 601 bp, Human
catgccatccacactcatcctgagccatcaacaggctttccaggggcaggcggctggagatgcccacagcagaggccaacctggggcctcactctctagtccccagcacagactgcgcgttgtctgttttcctgtcatggtgctgctagggccttgaagggttaacagaggacagagaaaaagcaacttaagattgttagctgtgccctccccgaggaatgggggtgccagagagcctgtgccagagagcaggtagtgggccagggtgcggcacgccaggtgcccacttcctgcagagctycgtgcattgccgagtgccgaggggtgagacccctggacagagagagaggaagagagacagagtgagcgcggtgggagcagaggaagcatttgttcaccaactttttggccttagtgtcgtccttctcactgacggtgctgcccgtgtcgtcctcatcctcgaaggggttgtagctggactgtgactgcgcagactgggcggggttgctcgggacattaagggtgctatggagagagagagctttcaggggatcccagctctgcaggggcccgtgagggtcctggcaactcctagctgcag

SEQ ID NO: 35657 - DNA, 601 bp, Human
ctgcctcagcctcccaagcagctgggactataggtatgcaacaccacgcccagctaatctgctacttttgtttgtttatttatttgagacaggatctcgctctgttgcccaggttatttatttgtttgtttgtttgcgacagggtctcgctctgttgtccaggttggagtatagtggtacaatcatgattcattgcaacctcaatctactgggctcaggtgatcctcccacctcagcctcccagagagctgggactacaggcatgtgccactaaaattagcccagctaattttttttttttgacacaaagtcttgctctgtcacccagcctggggtacagtggtgtgaccttggctcactgcaacctccacctcccaggttcaagtgattctcctgccgcagcctcctgagtaactgtgattatagatgccccgccacacgcctggctcatttttgtatttttagtagagacagggtttcaccatgttggttaggctgggctcgaactcctgacctcaagtgatctgcctgccttggcctcccaaaggtgctgggattacaggcgtgagccaccatgcctggcctaattttttgtattttt

SEQ ID NO: 35658 - DNA, 601 bp, Human
tagagtacgtggtatgaacatggctcactgtatcctcttgggtttaagtgatcctctgcctcagcctcccaagcagctgggactataggtatgcaacaccacgcccagctaatctgctacttttgtttgtttatttatttgagacaggatctcgctctgttgcccaggttatttatttgtttgtttgtttgcgacagggtctcgctctgttgtccaggttggagtatagtggtacaatcatgattcattgcaacctcaatctactgggctcaggtgatcctcccacctcagcctcccagakagctgggactacaggcatgtgccactaaaattagcccagctaattttttttttttgacacaaagtcttgctctgtcacccagcctggggtacagtggtgtgaccttggctcactgcaacctccacctcccaggttcaagtgattctcctgccgcagcctcctgagtaactgtgattatagatgccccgccacacgcctggctcatttttgtatttttagtagagacagggtttcaccatgttggttaggctgggctcgaactcctgacctcaagtgatctgcctgccttggcctcccaaa

SEQ ID NO: 35659 - DNA, 601 bp, Human
aggcggctgccaccacgcccggctaattttttgtatttttagtagagacggggtttcacactcttagccaggatggtctcgatctcctgacctcgtgatctgtgtgcctcggcctcccaaagtgctgggattacaggcgtgagccaccatgcccagcctacttttttttttttttaagagatggggtcttgctctctcttctaggctagagtacgtggtatgaacatggctcactgtatcctcttgggtttaagtgatcctctgcctcagcctcccaagcagctgggactataggtatgcmacaccacgcccagctaatctgctacttttgtttgtttatttatttgagacaggatctcgctctgttgcccaggttatttatttgtttgtttgtttgcgacagggtctcgctctgttgtccaggttggagtatagtggtacaatcatgattcattgcaacctcaatctactgggctcaggtgatcctcccacctcagcctcccagagagctgggactacaggcatgtgccactaaaattagcccagctaattttttttttttgacacaaagtcttgctctgtcacccagcctggggtacag

SEQ ID NO: 35660 - DNA, 601 bp, Human
tttgaaaaagagttttgctctgtcgcccaggctggagtgcagtggcgcaatctcggctcactgcaagctccgcctcccgggttcaagcaattttcctgcgtcagcctcccgagtagctgggactacaggcggctgccaccacgcccggctaattttttgtatttttagtagagacggggtttcacactcttagccaggatggtctcgatctcctgacctcgtgatctgtgtgcctcggcctcccaaagtgctgggattacaggcgtgagccaccatgcccagcctacttttttttttttttaagagatggggtcttgctctctcttctaggctagagtacgtggtatgaacatggctcactgtatcctcttgggtttaagtgatcctctgcctcagcctcccaagcagctgggactataggtatgcaacaccacgcccagctaatctgctacttttgtttgtttatttatttgagacaggatctcgctctgttgcccaggttatttatttgtttgtttgtttgcgacagggtctcgctctgttgtccaggttggagtatagtggtacaatcatgattcattgcaacctcaatctactgggc

SEQ ID NO: 35661 - DNA, 601 bp, Human
tttttgaaaaagagttttgctctgtcgcccaggctggagtgcagtggcgcaatctcggctcactgcaagctccgcctcccgggttcaagcaattttcctgcgtcagcctcccgagtagctgggactacaggcggctgccaccacgcccggctaattttttgtatttttagtagagacggggtttcacactcttagccaggatggtctcgatctcctgacctcgtgatctgtgtgcctcggcctcccaaagtgctgggattacaggcgtgagccaccatgcccagcctactttttttttttyttaagagatggggtcttgctctctcttctaggctagagtacgtggtatgaacatggctcactgtatcctcttgggtttaagtgatcctctgcctcagcctcccaagcagctgggactataggtatgcaacaccacgcccagctaatctgctacttttgtttgtttatttatttgagacaggatctcgctctgttgcccaggttatttatttgtttgtttgtttgcgacagggtctcgctctgttgtccaggttggagtatagtggtacaatcatgattcattgcaacctcaatctactgg

SEQ ID NO: 35662 - DNA, 601 bp, Human
gtgctactctggggtctgggcaaagctgtggctctcctgagggcttctctggcagttggggacccctagagaaaggcttctctcatggccctgcggggctagcagctcccagactacatatgggggaacctggtggtcctggccaacagcttctccagatgcccttctgtgtgactagccagtgccctgcaattcacagccttggcccagcaaggtgaggagtccaggcactggcttggcagcacctcactatttctgagtcttggcattgggcatccgcttttttttttttttttgaaamagagttttgctctgtcgcccaggctggagtgcagtggcgcaatctcggctcactgcaagctccgcctcccgggttcaagcaattttcctgcgtcagcctcccgagtagctgggactacaggcggctgccaccacgcccggctaattttttgtatttttagtagagacggggtttcacactcttagccaggatggtctcgatctcctgacctcgtgatctgtgtgcctcggcctcccaaagtgctgggattacaggcgtgagccaccatgcccagcctacttttttttttttttaagagat

SEQ ID NO: 35663 - DNA, 601 bp, Human
aagtgctactctggggtctgggcaaagctgtggctctcctgagggcttctctggcagttggggacccctagagaaaggcttctctcatggccctgcggggctagcagctcccagactacatatgggggaacctggtggtcctggccaacagcttctccagatgcccttctgtgtgactagccagtgccctgcaattcacagccttggcccagcaaggtgaggagtccaggcactggcttggcagcacctcactatttctgagtcttggcattgggcatccgcttttttttttttttttgaraaagagttttgctctgtcgcccaggctggagtgcagtggcgcaatctcggctcactgcaagctccgcctcccgggttcaagcaattttcctgcgtcagcctcccgagtagctgggactacaggcggctgccaccacgcccggctaattttttgtatttttagtagagacggggtttcacactcttagccaggatggtctcgatctcctgacctcgtgatctgtgtgcctcggcctcccaaagtgctgggattacaggcgtgagccaccatgcccagcctacttttttttttttttaagag

SEQ ID NO: 35664 - DNA, 601 bp, Human
gccaagtgctactctggggtctgggcaaagctgtggctctcctgagggcttctctggcagttggggacccctagagaaaggcttctctcatggccctgcggggctagcagctcccagactacatatgggggaacctggtggtcctggccaacagcttctccagatgcccttctgtgtgactagccagtgccctgcaattcacagccttggcccagcaaggtgaggagtccaggcactggcttggcagcacctcactatttctgagtcttggcattgggcatccgcttttttttttttttttgaaaaagagttttgctctgtcgcccaggctggagtgcagtggcgcaatctcggctcactgcaagctccgcctcccgggttcaagcaattttcctgcgtcagcctcccgagtagctgggactacaggcggctgccaccacgcccggctaattttttgtatttttagtagagacggggtttcacactcttagccaggatggtctcgatctcctgacctcgtgatctgtgtgcctcggcctcccaaagtgctgggattacaggcgtgagccaccatgcccagcctacttttttttttttttaa

SEQ ID NO: 35665 - DNA, 601 bp, Human
tgtgcacacacacaagttgctgcctgagacaaggccccacctggcccaggggcatgccaagtgctactctggggtctgggcaaagctgtggctctcctgagggcttctctggcagttggggacccctagagaaaggcttctctcatggccctgcggggctagcagctcccagactacatatgggggaacctggtggtcctggccaacagcttctccagatgcccttctgtgtgactagccagtgccctgcaattcacagccttggcccagcaaggtgaggagtccaggcactggcttggcrgcacctcactatttctgagtcttggcattgggcatccgcttttttttttttttttgaaaaagagttttgctctgtcgcccaggctggagtgcagtggcgcaatctcggctcactgcaagctccgcctcccgggttcaagcaattttcctgcgtcagcctcccgagtagctgggactacaggcggctgccaccacgcccggctaattttttgtatttttagtagagacggggtttcacactcttagccaggatggtctcgatctcctgacctcgtgatctgtgtgcctcggcctcccaaag

SEQ ID NO: 35666 - DNA, 601 bp, Human
aaactgcaaatgcattaaaaaagattcctatagtgggtggggtggtagcacacatctgtggtcccagctacgtaggaggctgaggtgggaggactgcttgagcccaggagatcaaggctgcagctgctgtgagctatgatcgcaccactgtaacccagcttggctaacagagtgagaccgtgtctctattaaaaaaaaaaaaaaaaaagattatcattgaagaccattcaaagaagaaaaagacattgcacagaaagtcttcacaggcagagcacatgtaatcaggatccaggctgttttmtaaaactatggtttctgctcctagcaacacagatatgtgtgtgggttggtgtgtgcatggtaggtgtgggcaggtaggtgtgcacacacacaagttgctgcctgagacaaggccccacctggcccaggggcatgccaagtgctactctggggtctgggcaaagctgtggctctcctgagggcttctctggcagttggggacccctagagaaaggcttctctcatggccctgcggggctagcagctcccagactacatatgggggaacctggtggtcctggccaacagcttctccagatgc

SEQ ID NO: 35667 - DNA, 601 bp, Human
tggcctcgcaaagtgctgggattacaggtgtgagccatcgtgcccggacaagataacacttttcaaattgaagatgtgaaaagccattttggtaaactgcaaatgcattaaaaaagattcctatagtgggtggggtggtagcacacatctgtggtcccagctacgtaggaggctgaggtgggaggactgcttgagcccaggagatcaaggctgcagctgctgtgagctatgatcgcaccactgtaacccagcttggctaacagagtgagaccgtgtctctattaaaaaaaaaaaaaaaaaagattatcattgaagaccattcaaagaagaaaaagacattgcacagaaagtcttcacaggcagagcacatgtaatcaggatccaggctgttttataaaactatggtttctgctcctagcaacacagatatgtgtgtgggttggtgtgtgcatggtaggtgtgggcaggtaggtgtgcacacacacaagttgctgcctgagacaaggccccacctggcccaggggcatgccaagtgctactctggggtctgggcaaagctgtggctctcctgagggcttctctggcagttggggacccctag

SEQ ID NO: 35668 - DNA, 601 bp, Human
agctaggccattgggcacagcccccaggccctggcttccctgctgagtcaggggttggggtggtggtggtaaggcagcctttcccacaagtgtagcctaggggcaagggcacacttcagcctgtgtgggttgagttctggcccagcttccctcttggagtggtagatgctgcttctgggggagcttcacaaagagggcaagagagggaagaatctgggttgctgtgggtccactttggccctaggccactccagcttccttaggtgctaagatagcaattttctttcctttttttttttttgagacagagtgtcactccatcacccaggctggagtgcagtggtatgatctcagctcactgcaacctccacctcccaggttcaagtgattctcttggcctccccagtagctgggattacaggtgtgtgccaccatgcctgaataatttttttattttttaatagaggcagggtttcaccatgttggccaggctggtctcaaactcctgacctcaagtgatccttcggccttggcctcgcaaagtgctgggattacaggtgtgagccatcgtgcccggacaagataacacttttcaaattga

SEQ ID NO: 35669 - DNA, 601 bp, Human
cctggtctcaaggaggcagactagggtggtgagggggaggtggcactagggtagggccccaggtctggcatttgccaggttagggaagcagagcagctcagagcccaggggtgggcaggggcctgtgtgcttctggttggtaactcactgcagggaaggccagttgggcctgctggctcggacctcgtcaggagcaagcaattggtgggaaagaaatagtcccagtgctgttttgcctttattgctaagtttgaagttttgtaactctctttggcattttttggtccatttttcagaattrgatgcagttttccccctggtttagcatttccctgatgctttggattttgtatggcagcaatgctggtcaacatgcctgcggagctaatacctggggcttccagtgctccccggactgcctgggctcaaatcccacagccatcactcactggctgggagacctggaccaactgcgtccactccctgggcctgtggccctcatctgtggactgggggtactgtgaagattaagtgttaagacactaaagaaccctgggagggtgggacatgcgtaagcactggctcagcctcccactgtcgt

SEQ ID NO: 35670 - DNA, 601 bp, Human
ggccaggcattctgtggcgggcaggccgagggcctggtcatttctctactaaatgcatgcattttaagttgcctctttggtcatgggcctctgacagacctagagatgacagtctcacacagtaatttggaacaagctgctctcagctgccacagtggctcccactgagactgcggcatccagctccatagggctgtgccttcctcaccaccctggccaggtggcaggaatcgtccctcggttgtgcccctccctcacgttgggcctcttctgtcccctccccagggccccggccgccttkctcccagcagctgtctctggggtctctctgcctttgctaatccctctcctctgcaacttccaggctgcgaggggaagggaccatgtctgacagtcatacctgtcattttatccccagcacctggctgatgacttgtgcacggtgccatgtgtcaacccttcctgagaccctgagaaggagcccctggcgctgttctggaatctccctgtggctctaatgtattaacgtggttccatttatctttggttgttccaacctgaaggacctcctacttctggccaggccttgggtagaagagga

SEQ ID NO: 35671 - DNA, 601 bp, Human
acagagccgcattcacgagctttgagcccacagagggtggagggccaggcattctgtggcgggcaggccgagggcctggtcatttctctactaaatgcatgcattttaagttgcctctttggtcatgggcctctgacagacctagagatgacagtctcacacagtaatttggaacaagctgctctcagctgccacagtggctcccactgagactgcggcatccagctccatagggctgtgccttcctcaccaccctggccaggtggcaggaatcgtccctcggttgtgcccctccctcackttgggcctcttctgtcccctccccagggccccggccgccttgctcccagcagctgtctctggggtctctctgcctttgctaatccctctcctctgcaacttccaggctgcgaggggaagggaccatgtctgacagtcatacctgtcattttatccccagcacctggctgatgacttgtgcacggtgccatgtgtcaacccttcctgagaccctgagaaggagcccctggcgctgttctggaatctccctgtggctctaatgtattaacgtggttccatttatctttggttgttccaacct

SEQ ID NO: 35672 - DNA, 601 bp, Human
agtgtaacccaccattgactcggaaaggagagacaaagtcaagaacatagagatctatgataggccaacaggcacagtgggcggggaggggcggctatttctgttgttctgcgtcttcctgcgctcagatccctccagctgcactcggaaaggtgccgagtcccaggcgaaatgaccagctcatctgccttccaggaacaccatgaagccaagagcaatggaaccatcatctcttgcaggaaaaggagtggatgcccacgtggctggctgaggctcctgggcccgccgcctccgtccccccgctggcctgtccccgactcatcactggatcgcctccacataatttgccgggtataggccaacttgcccgttgtccaagcgtcccttgcaccagccctgctcatcctcgtcctccatcttggtcagctcatcccctgcaagacaaagagggagccgtctccatgagaggtatgacaccgacggtgggctacagagccgcattcacgagctttgagcccacagagggtggagggccaggcattctgtggcgggcaggccgagggcctggtcatttctctactaaatgcatgcattttaagtt

SEQ ID NO: 35673 - DNA, 601 bp, Human
aataatatatacagatagacactgagacatgacagtctaatctaaagcatctttacagatgcatttgcttgaaaagttagtcttctttttaactctgaatcagtgataaaattgttaatttgcaaaagagtacagttttaagcaagaatagagtgaaaataatttttaaatatggcgatttgggggagttctacctaaggttctatgtaaagcttccattcagatgcccaaaagcacaaagagcattcccaatagaaacccgaccataacccggtcccaccttcctggcataattcctttyctcaaacatctgccacctgaggctaagcctacacacggcgtggctgagtaacagggtaagggaatagggagatcgtttcctcaagactggtgcgcatcaatctgtgccataatttaagtagaaatgaacaggtgtataaaaaagtataactgtacacagcctttaaattaaaaacctcaaaatcttcactcaaaatgggatgtaagcttgttcatttaagttgcaggtgatggactcgtcagagagagtaatcagtggaacaagatcagtgtaacccaccattgactcggaaaggagaga

SEQ ID NO: 35674 - DNA, 601 bp, Human
ggcccccgcgtaactctggctgcagcacctgctcccgggcgactccgggcagcccgagacactcgtgctgcgggtaagacccagcttctgtttgtgcacaagtaacacgacgactgaaatctgcaactactgcaaagacgcgggcacttttacagtgttctgctacggagccaggacaaaggccggtcagaagccggaccagcagtcagctggtgacgacgagcctccctccagcaggcaccacgtcagagaggccccaggcccactgagcccgggaggagacccagccggccagccagaygtgtgcctgaatgccacagacttcaagcagtttacaaacgaaactcactgttaaaagctgttaaatctcattaaaacagtagacgagtgctttagattctctgaatatcaaataatatatacagatagacactgagacatgacagtctaatctaaagcatctttacagatgcatttgcttgaaaagttagtcttctttttaactctgaatcagtgataaaattgttaatttgcaaaagagtacagttttaagcaagaatagagtgaaaataatttttaaatatggcgatttgggggagtt

SEQ ID NO: 35675 - DNA, 601 bp, Human
gccagccgatgcccgcaccatgtggaagcccaggtcaaacagcagcaggtctcggggagaagggaaccccaaggggctcaggtgcctcaaatccccaacctccagtttggcaggggcagtgggccgtggccttttgggcaggggtcctgtgccctggatcttgcccagctccaaagctagtaagccccagggaggccacccccgccaagtgaagtgggcatgaagacagatgatggcgaagggacttccatatgcacgagatcaactgtttattgatttttttcctcaaatactacacatktaaaggaactgttaaactgaaaaagacttgacaatttttggtaaatccgtagcacagaaatgaggatttctgctggtaagttctcaggacagacacagacacaggtccactttccaagcaagacatctgctcactggaaacggagtgaatgcatagctggtgacggcggcgggcactgctgagtcacgtgaaacacaggttcccccacgttccccccacccccgccggcccgcgtggcccccgcgtaactctggctgcagcacctgctcccgggcgactccgggcagcccgagacactcg

SEQ ID NO: 35676 - DNA, 601 bp, Human; identical to SEQ ID NO: 20433

SEQ ID NO: 35677 - DNA, 601 bp, Human; identical to SEQ ID NO: 20434

SEQ ID NO: 35678 - DNA, 601 bp, Human; identical to SEQ ID NO: 20435

SEQ ID NO: 35679 - DNA, 601 bp, Human; identical to SEQ ID NO: 20436

SEQ ID NO: 35680 - DNA, 601 bp, Human; identical to SEQ ID NO: 20437

SEQ ID NO: 35681 - DNA, 601 bp, Human; identical to SEQ ID NO: 20438

SEQ ID NO: 35682 - DNA, 601 bp, Human; identical to SEQ ID NO: 20439

SEQ ID NO: 35683 - DNA, 601 bp, Human; identical to SEQ ID NO: 20440

SEQ ID NO: 35684 - DNA, 601 bp, Human; identical to SEQ ID NO: 20441

SEQ ID NO: 35685 - DNA, 601 bp, Human; identical to SEQ ID NO: 20442

SEQ ID NO: 35686 - DNA, 601 bp, Human; identical to SEQ ID NO: 20443

SEQ ID NO: 35687 - DNA, 601 bp, Human; identical to SEQ ID NO: 20444

SEQ ID NO: 35688 - DNA, 601 bp, Human; identical to SEQ ID NO: 20445

SEQ ID NO: 35689 - DNA, 601 bp, Human; identical to SEQ ID NO: 20446

SEQ ID NO: 35690 - DNA, 601 bp, Human; identical to SEQ ID NO: 20447

SEQ ID NO: 35691 - DNA, 601 bp, Human; identical to SEQ ID NO: 20448

SEQ ID NO: 35692 - DNA, 601 bp, Human; identical to SEQ ID NO: 20449

SEQ ID NO: 35693 - DNA, 601 bp, Human; identical to SEQ ID NO: 20450

SEQ ID NO: 35694 - DNA, 601 bp, Human; identical to SEQ ID NO: 20451

SEQ ID NO: 35695 - DNA, 601 bp, Human; identical to SEQ ID NO: 20452

SEQ ID NO: 35696 - DNA, 601 bp, Human; identical to SEQ ID NO: 20453

SEQ ID NO: 35697 - DNA, 601 bp, Human; identical to SEQ ID NO: 20454

SEQ ID NO: 35698 - DNA, 601 bp, Human; identical to SEQ ID NO: 20455

SEQ ID NO: 35699 - DNA, 601 bp, Human; identical to SEQ ID NO: 20456

SEQ ID NO: 35700 - DNA, 601 bp, Human; identical to SEQ ID NO: 20457

SEQ ID NO: 35701 - DNA, 601 bp, Human; identical to SEQ ID NO: 20458

SEQ ID NO: 35702 - DNA, 601 bp, Human; identical to SEQ ID NO: 20459

SEQ ID NO: 35703 - DNA, 601 bp, Human; identical to SEQ ID NO: 20460

SEQ ID NO: 35704 - DNA, 601 bp, Human; identical to SEQ ID NO: 20461

SEQ ID NO: 35705 - DNA, 601 bp, Human; identical to SEQ ID NO: 20462

SEQ ID NO: 35706 - DNA, 601 bp, Human; identical to SEQ ID NO: 20463

SEQ ID NO: 35707 - DNA, 601 bp, Human; identical to SEQ ID NO: 20464

SEQ ID NO: 35708 - DNA, 601 bp, Human; identical to SEQ ID NO: 20465

SEQ ID NO: 35709 - DNA, 601 bp, Human; identical to SEQ ID NO: 20466

SEQ ID NO: 35710 - DNA, 601 bp, Human; identical to SEQ ID NO: 20433

SEQ ID NO: 35711 - DNA, 601 bp, Human; identical to SEQ ID NO: 20434

SEQ ID NO: 35712 - DNA, 601 bp, Human; identical to SEQ ID NO: 20435

SEQ ID NO: 35713 - DNA, 601 bp, Human; identical to SEQ ID NO: 20436

SEQ ID NO: 35714 - DNA, 601 bp, Human; identical to SEQ ID NO: 20437

SEQ ID NO: 35715 - DNA, 601 bp, Human; identical to SEQ ID NO: 20438

SEQ ID NO: 35716 - DNA, 601 bp, Human; identical to SEQ ID NO: 20439

SEQ ID NO: 35717 - DNA, 601 bp, Human; identical to SEQ ID NO: 20440

SEQ ID NO: 35718 - DNA, 601 bp, Human; identical to SEQ ID NO: 20441

SEQ ID NO: 35719 - DNA, 601 bp, Human; identical to SEQ ID NO: 20442

SEQ ID NO: 35720 - DNA, 601 bp, Human; identical to SEQ ID NO: 20443

SEQ ID NO: 35721 - DNA, 601 bp, Human; identical to SEQ ID NO: 20444

SEQ ID NO: 35722 - DNA, 601 bp, Human; identical to SEQ ID NO: 20445

SEQ ID NO: 35723 - DNA, 601 bp, Human; identical to SEQ ID NO: 20446

SEQ ID NO: 35724 - DNA, 601 bp, Human; identical to SEQ ID NO: 20447

SEQ ID NO: 35725 - DNA, 601 bp, Human; identical to SEQ ID NO: 20448

SEQ ID NO: 35726 - DNA, 601 bp, Human; identical to SEQ ID NO: 20449

SEQ ID NO: 35727 - DNA, 601 bp, Human; identical to SEQ ID NO: 20450

SEQ ID NO: 35728 - DNA, 601 bp, Human; identical to SEQ ID NO: 20451

SEQ ID NO: 35729 - DNA, 601 bp, Human; identical to SEQ ID NO: 20452

SEQ ID NO: 35730 - DNA, 601 bp, Human; identical to SEQ ID NO: 20453

SEQ ID NO: 35731 - DNA, 601 bp, Human; identical to SEQ ID NO: 20454

SEQ ID NO: 35732 - DNA, 601 bp, Human; identical to SEQ ID NO: 20455

SEQ ID NO: 35733 - DNA, 601 bp, Human; identical to SEQ ID NO: 20456

SEQ ID NO: 35734 - DNA, 601 bp, Human; identical to SEQ ID NO: 20457

SEQ ID NO: 35735 - DNA, 601 bp, Human; identical to SEQ ID NO: 20458

SEQ ID NO: 35736 - DNA, 601 bp, Human; identical to SEQ ID NO: 20459

SEQ ID NO: 35737 - DNA, 601 bp, Human; identical to SEQ ID NO: 20460

SEQ ID NO: 35738 - DNA, 601 bp, Human; identical to SEQ ID NO: 20461

SEQ ID NO: 35739 - DNA, 601 bp, Human; identical to SEQ ID NO: 20462

SEQ ID NO: 35740 - DNA, 601 bp, Human; identical to SEQ ID NO: 20463

SEQ ID NO: 35741 - DNA, 601 bp, Human; identical to SEQ ID NO: 20464

SEQ ID NO: 35742 - DNA, 601 bp, Human; identical to SEQ ID NO: 20465

SEQ ID NO: 35743 - DNA, 601 bp, Human; identical to SEQ ID NO: 20466

SEQ ID NO: 35744 - DNA, 601 bp, Human; identical to SEQ ID NO: 20433

SEQ ID NO: 35745 - DNA, 601 bp, Human; identical to SEQ ID NO: 20434

SEQ ID NO: 35746 - DNA, 601 bp, Human; identical to SEQ ID NO: 20435

SEQ ID NO: 35747 - DNA, 601 bp, Human; identical to SEQ ID NO: 20436

SEQ ID NO: 35748 - DNA, 601 bp, Human; identical to SEQ ID NO: 20437

SEQ ID NO: 35749 - DNA, 601 bp, Human; identical to SEQ ID NO: 20438

SEQ ID NO: 35750 - DNA, 601 bp, Human; identical to SEQ ID NO: 20439

SEQ ID NO: 35751 - DNA, 601 bp, Human; identical to SEQ ID NO: 20440

SEQ ID NO: 35752 - DNA, 601 bp, Human; identical to SEQ ID NO: 20441

SEQ ID NO: 35753 - DNA, 601 bp, Human; identical to SEQ ID NO: 20442

SEQ ID NO: 35754 - DNA, 601 bp, Human; identical to SEQ ID NO: 20443

SEQ ID NO: 35755 - DNA, 601 bp, Human; identical to SEQ ID NO: 20444

SEQ ID NO: 35756 - DNA, 601 bp, Human; identical to SEQ ID NO: 20445

SEQ ID NO: 35757 - DNA, 601 bp, Human; identical to SEQ ID NO: 20446

SEQ ID NO: 35758 - DNA, 601 bp, Human; identical to SEQ ID NO: 20447

SEQ ID NO: 35759 - DNA, 601 bp, Human; identical to SEQ ID NO: 20448

SEQ ID NO: 35760 - DNA, 601 bp, Human; identical to SEQ ID NO: 20449

SEQ ID NO: 35761 - DNA, 601 bp, Human; identical to SEQ ID NO: 20450

SEQ ID NO: 35762 - DNA, 601 bp, Human; identical to SEQ ID NO: 20451

SEQ ID NO: 35763 - DNA, 601 bp, Human; identical to SEQ ID NO: 20452

SEQ ID NO: 35764 - DNA, 601 bp, Human; identical to SEQ ID NO: 20453

SEQ ID NO: 35765 - DNA, 601 bp, Human; identical to SEQ ID NO: 20454

SEQ ID NO: 35766 - DNA, 601 bp, Human; identical to SEQ ID NO: 20455

SEQ ID NO: 35767 - DNA, 601 bp, Human; identical to SEQ ID NO: 20456

SEQ ID NO: 35768 - DNA, 601 bp, Human; identical to SEQ ID NO: 20457

SEQ ID NO: 35769 - DNA, 601 bp, Human; identical to SEQ ID NO: 20458

SEQ ID NO: 35770 - DNA, 601 bp, Human; identical to SEQ ID NO: 20459

SEQ ID NO: 35771 - DNA, 601 bp, Human; identical to SEQ ID NO: 20460

SEQ ID NO: 35772 - DNA, 601 bp, Human; identical to SEQ ID NO: 20461

SEQ ID NO: 35773 - DNA, 601 bp, Human; identical to SEQ ID NO: 20462

SEQ ID NO: 35774 - DNA, 601 bp, Human; identical to SEQ ID NO: 20463

SEQ ID NO: 35775 - DNA, 601 bp, Human; identical to SEQ ID NO: 20464

SEQ ID NO: 35776 - DNA, 601 bp, Human; identical to SEQ ID NO: 20465

SEQ ID NO: 35777 - DNA, 601 bp, Human; identical to SEQ ID NO: 20466

SEQ ID NO: 35778 - DNA, 601 bp, Human
cctcagcctcctgagtagctggagcggcaccacgcccggctaatttttgtatttttagtagagacggagtttcaccacgttggtcaggctggtctggaactcctgacctcatgaccagccgacgtttttaaagacatagtgtccccctcaaggcatattccagttcctatcacgaggattcccccacggacactcagtgcccccttcctgatcctcagcgcttccctcgcgacctacaaactgcccccctccccagggttcacaacgccttacgcctctcaggttccgcccctaccccccstcaaagaatacccatctgtcagcttcggaaatccactctcccacgccagtaccccagagcatcacttgggccccctgtccctttcccgggactctactacctttacccagagcagagggtgaaggcctcctgagcgcaggggcccagttatctgagaaaccccacagcctgtcccccgtccaggaagtctcagcgagctcacgccgcgcagtcgcagttttaatttatctgtaattcccgcgcttttccgttgccacggaaaccaaggggctaccgctaagcagcagcctctcagaatac

SEQ ID NO: 35779 - DNA, 601 bp, Human
taagattttctgcatagcattaatgacattttgtacttcttcaacgcgaagagcagataaatccatttctttctgttccaatgaactttaacacattagaaaaacatatatatatatctttttaaaaggtttataaaatgacaacttcattttatcattttaaaataaagtaaatttaagatttggaaggttttagaataatacaaaccaaagaactaatgacaacgtcctttatttttaaagattctagaagttgctttttgtaattagacaacataaattctgaattttttcacatatygctgccaaccccttgggtcttttcctttctccaagaaagagaaagctacagaggagtgactgaccgggtaggtggtggtagccttagctttctccaatgtttctggttgttttctttttcttgcataaaaccaaaatcaacaacgaccaaaccaacaccaatcaaggcctccccgcccctaacctttcccagtgacctgctctcatctctggatcctcctcaagcacatccctgccggcagcatctgttactactgacgctcctctacttccctcttgcgctttctcaatggcgcaaatg

SEQ ID NO: 35780 - DNA, 601 bp, Human
ttccctagtatgtaaggtcaattctgttcatttgcataggagataatcataggaatcccaaattaatacactcttgtgctgacttaccagatgggacactctaagattttctgcatagcattaatgacattttgtacttcttcaacgcgaagagcagataaatccatttctttctgttccaatgaactttaacacattagaaaaacatatatatatatctttttaaaaggtttataaaatgacaacttcattttatcattttaaaataaagtaaatttaagatttggaaggttttagaatratacaaaccaaagaactaatgacaacgtcctttatttttaaagattctagaagttgctttttgtaattagacaacataaattctgaattttttcacatattgctgccaaccccttgggtcttttcctttctccaagaaagagaaagctacagaggagtgactgaccgggtaggtggtggtagccttagctttctccaatgtttctggttgttttctttttcttgcataaaaccaaaatcaacaacgaccaaaccaacaccaatcaaggcctccccgcccctaacctttcccagtgacctg

SEQ ID NO: 35781 - DNA, 601 bp, Human
tcaacgacaccgatcatccatgtttttttttttttttttttttttttgagatggagtttagctctgtcgctggagttcagtggtgccatattggctcacagcaacatctgcctcctggttcaagtgattctcctgcctcagcctcctgagtagctgggattacaggcacatgccactacgcccagctaatttttgtatttttagtggagagggggtttcaccatgttggccaggatggtctcgatctcctgacctcgtgatcctaccaccttggcctcccaaagtgctgggattacaggcrtaagccaccgccctcggcctcatccatgattttattttgccatttcaagtgatggagcttgttttagagctggaagaaaagccaaaatgccagttaatctaaactagattcctgccccagtgcagaaccaatcaagacagagtccctgtctttcccggaccacaggatttgtgttgaaaaggagaggagtgggagaggcagagtggatggagaacaaggaatcattttctatatttttaaagttcttcagttaagaaaatcagcaattacaatagcctaatcttactagacatgtctttt

SEQ ID NO: 35782 - DNA, 601 bp, Human
tgaaaaggtggtatttcaatcaagatttttagaccatggctgggtgcaatggctcaggcctgtaatcccagcaccttgagaggccaagggagggtagatcacttgaggtcaggagtttgagaccagcatggccaacatagcaaaaccctatctctacaacagaaaaatacaagaatggctggacgcagtggcttatgcctgtaatcctagcactttgggaggcccaggcgggtggatcacaaggtcaggagatcaagactatcctggctaacacggtgaaatcccgcctctactaaaaaaraaaaaaaaatacaaaaaattagccgggcgtggtagtgggtgcttgtagtcccagctattcaggaggctcaggcagaagaatggcatgaacccgggaggcagagtttgcagtgagctgagatcgcgccactgcactccagcctgggcaacagagcaagactccatctcaaaaaaagaaaaaaaaatacaaaaattagctgggcatggtggtgcacacctatcgtccctgctactctggaggctgaggtgggaggattgcttgagcctgacgaggttgaggctgcagtgagctgtgatagca

SEQ ID NO: 35783 - DNA, 601 bp, Human
actagagataaaaaatggatacattacatagaatgtcagctagtaatcagtgttatggagaagcagcaggaatagaagataaagtgtgtgctgggggtgtggtaattttaaataggggtgtctggaaatgaaaaggtggtatttcaatcaagatttttagaccatggctgggtgcaatggctcaggcctgtaatcccagcaccttgagaggccaagggagggtagatcacttgaggtcaggagtttgagaccagcatggccaacatagcaaaaccctatctctacaacagaaaaatacaaraatggctggacgcagtggcttatgcctgtaatcctagcactttgggaggcccaggcgggtggatcacaaggtcaggagatcaagactatcctggctaacacggtgaaatcccgcctctactaaaaaaaaaaaaaaaatacaaaaaattagccgggcgtggtagtgggtgcttgtagtcccagctattcaggaggctcaggcagaagaatggcatgaacccgggaggcagagtttgcagtgagctgagatcgcgccactgcactccagcctgggcaacagagcaagactccatctcaaaaa

SEQ ID NO: 35784 - DNA, 601 bp, Human
cgcctcctgaattcaagtgattctcctgcctcagcctcccgagtagctgggactaaaggcatgcaccaccatgccttggcctcccaaagtactgggattacaggagtgagccaccatgccagccatctttttaatttttaatgttaattaatttttgtagagacaggatctcactatgatgcccatgctggtcttgaatgcctggcatcaagcaatcttcctgcttcggcttcccaaagtgctgggattacaggtgtgagctactatacccggcctttagctttcttctgaatgtgaacctttttttttttttttggagatggagtctcactcactctgctgctcaggctggagtgcagtggtgtggtcttggctcactgcaacctctgcctctcggattgaagtgattcttgtgcctcagcattccaagtagctgggactacaggcgcgtgctgccacacccggctaatttttttgtatttttggtagggaaggggtttcaccatattgcccaggctggtcttgaagtcctgacctcaagtgatccatctgcctcgaccgggattacaggcgtgagccactacacttagctctaaatgtg

SEQ ID NO: 35785 - DNA, 601 bp, Human
aaatctttagctttattctggtctttttaattttctttttttttttcagacagagtctcgttctgtcgcccaggctggagtgcagtggcaccatctcagctctctgtaacctccgcctcctgaattcaagtgattctcctgcctcagcctcccgagtagctgggactaaaggcatgcaccaccatgccttggcctcccaaagtactgggattacaggagtgagccaccatgccagccatctttttaatttttaatgttaattaatttttgtagagacaggatctcactatgatgcccatgmtggtcttgaatgcctggcatcaagcaatcttcctgcttcggcttcccaaagtgctgggattacaggtgtgagctactatacccggcctttagctttcttctgaatgtgaacctttttttttttttttggagatggagtctcactcactctgctgctcaggctggagtgcagtggtgtggtcttggctcactgcaacctctgcctctcggattgaagtgattcttgtgcctcagcattccaagtagctgggactacaggcgcgtgctgccacacccggctaatttttttgtatttttggta

SEQ ID NO: 35786 - DNA, 601 bp, Human
gaaacacactatgcaacaattaggggaagagcattccaagaaagagggagcagagaaggcaaacccggagcaggaccatgcctgtgtatgcaggacatcagataggtcaaggtgttaaaatgtaataatccaggaggatattgtagggaaagactatcagagaggtagctggtaacttctggtaggaacctataggctattttaaatctttagctttattctggtctttttaattttctttttttttttcagacagagtctcgttctgtcgcccaggctggagtgcagtggcaccatctcrgctctctgtaacctccgcctcctgaattcaagtgattctcctgcctcagcctcccgagtagctgggactaaaggcatgcaccaccatgccttggcctcccaaagtactgggattacaggagtgagccaccatgccagccatctttttaatttttaatgttaattaatttttgtagagacaggatctcactatgatgcccatgctggtcttgaatgcctggcatcaagcaatcttcctgcttcggcttcccaaagtgctgggattacaggtgtgagctactatacccggcctttagctttc

SEQ ID NO: 35787 - DNA, 601 bp, Human
aggatagcttaataatgtaaagaaacacactatgcaacaattaggggaagagcattccaagaaagagggagcagagaaggcaaacccggagcaggaccatgcctgtgtatgcaggacatcagataggtcaaggtgttaaaatgtaataatccaggaggatattgtagggaaagactatcagagaggtagctggtaacttctggtaggaacctataggctattttaaatctttagctttattctggtctttttaattttctttttttttttcagacagagtctcgttctgtcgcccaggctrgagtgcagtggcaccatctcagctctctgtaacctccgcctcctgaattcaagtgattctcctgcctcagcctcccgagtagctgggactaaaggcatgcaccaccatgccttggcctcccaaagtactgggattacaggagtgagccaccatgccagccatctttttaatttttaatgttaattaatttttgtagagacaggatctcactatgatgcccatgctggtcttgaatgcctggcatcaagcaatcttcctgcttcggcttcccaaagtgctgggattacaggtgtgagctac

SEQ ID NO: 35788 - DNA, 601 bp, Human
attctagtgtggtagacagttgatacggaattaaagaatacatgggaataagtgcattaaagagaaaaattaagcagggtaaggggaaacaggtagttcaatatctatgtgggggtgagatgtacatggggggagtcaggaaaggtttcactgaggtgagactagaggatagcttaataatgtaaagaaacacactatgcaacaattaggggaagagcattccaagaaagagggagcagagaaggcaaacccggagcaggaccatgcctgtgtatgcaggacatcagataggtcaaggtgytaaaatgtaataatccaggaggatattgtagggaaagactatcagagaggtagctggtaacttctggtaggaacctataggctattttaaatctttagctttattctggtctttttaattttctttttttttttcagacagagtctcgttctgtcgcccaggctggagtgcagtggcaccatctcagctctctgtaacctccgcctcctgaattcaagtgattctcctgcctcagcctcccgagtagctgggactaaaggcatgcaccaccatgccttggcctcccaaagtactgggatt

SEQ ID NO: 35789 - DNA, 601 bp, Human
tagaaatgtagcagtttacaaaataaagcctgctctcatagagctcatattctagtgtggtagacagttgatacggaattaaagaatacatgggaataagtgcattaaagagaaaaattaagcagggtaaggggaaacaggtagttcaatatctatgtgggggtgagatgtacatggggggagtcaggaaaggtttcactgaggtgagactagaggatagcttaataatgtaaagaaacacactatgcaacaattaggggaagagcattccaagaaagagggagcagagaaggcaaaccckgagcaggaccatgcctgtgtatgcaggacatcagataggtcaaggtgttaaaatgtaataatccaggaggatattgtagggaaagactatcagagaggtagctggtaacttctggtaggaacctataggctattttaaatctttagctttattctggtctttttaattttctttttttttttcagacagagtctcgttctgtcgcccaggctggagtgcagtggcaccatctcagctctctgtaacctccgcctcctgaattcaagtgattctcctgcctcagcctcccgagtagctggg

SEQ ID NO: 35790 - DNA, 601 bp, Human
gtttgtacctggtaccaggttatgtaccaggtacataaatacttaaaaacaaattagttgacatttaaggtaagatgtgagccatagcttaacataaagaaaaggagaaagcccacttgttctactaaattacctactctactttttctgaaattcttttattaagaaacaaacattttcatttcaaaagacaagatcatcaaatacgtaaatataacttgaatcactgctataaatgaattttggcctaaatagaaactggtatcaggtcctttcctgtcttcacaatgattacaaagcrggcaaacactgacccttagaagggggaatgcataaggatatgcagaaatgaacagaaaggagaaactgggaaggctcaaacacaatgtgcttatttcaaaactgcttgcagtttgctttcactgatggacacaaaaaatacaaaacactgttcaaaatgatgttacatcctaatagataatatatgtcagtcgggtgtggtggctcacgcctgtaatcccagaactttgggaggccgaggcaggtggatcacaaggtcaggagttcgagaccagcctggccaatatggtgaaaccttatc

SEQ ID NO: 35791 - DNA, 601 bp, Human
caggttcaagtgatacccctgccgcagcctaccaagtagctgggactacaggtacgtgccaccatgccaggctagttttttgtgtgttttagtagagacagtgtttcgccattttggccaggatggtcttaatttcctgacctcgtgatccgcccacctcgacctcccaaagtgctggtattataggcgtgagccaccgcgcccgtcctctattttcttttatttgtacatttgctcgtattattatctctgcctataagcctataatttccttcttccacaagttctcaaagcaactatrttcataacttaatctctctttttttgttaagagacagggtcagccaggcgcggtggcttacacctgtaatcccaacactttttaaggccaaggtagctgaagtcaggagtttgagagcagcctggccaacatggtgaaaaccctgtctcgactaaaaatacaaaaattagctgggtgtggtggcagatgcctgtaatcccagctactcaagaggctgaggcaggagaatcgcttgaacccaggaggtggaggttgcagtgagccgagatcacaccactgcactccagcctgggcaataga

SEQ ID NO: 35792 - DNA, 601 bp, Human
gtggctcatgcctgtaatcctggcactgtgggaggccaaggcgagcagatcacctgaggtcaggagttttggaccagcctggccaacatagtgaaaccccgtctctactaaaaatacaaaaattagccaggtgtggtggcacatgcctgtagtcccagctactcgggaggctgaggcaggagatttgcttgaacccaggagatggaggtggcagtgagctgagatcatgccactgcactccagtctgggcaacacagtgagactccgtctcaaaacaaaacaaaaaaaaacagccgggcgyggtggctcacacttgtaatcccagaacttagggaggccaaggcgggcagatcacgaggtcaggagatcgagaccatcctggctaacacggtgaaaccctttctctactaaaaatacaaaaaaattagctgggcgtggtggcaggcgtctgtagtcccagctacttgggaggctgaggcaggagaatggtgtgaacccgggaggtggagcttgcagtgagccgagactgcaccaccgcactccagcctgggcgacagagcgagactccgtctcaaaacaaaacaaacaaaaacaaacaaac

SEQ ID NO: 35793 - DNA, 601 bp, Human
cggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgtcccagatcacacagt

SEQ ID NO: 35794 - DNA, 601 bp, Human
agcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgtcccagatcacaca

SEQ ID NO: 35795 - DNA, 601 bp, Human
aggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatatctacatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgtcccagatcac

SEQ ID NO: 35796 - DNA, 601 bp, Human
ggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatacctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgtcccaga

SEQ ID NO: 35797 - DNA, 601 bp, Human
aaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaattatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgtc

SEQ ID NO: 35798 - DNA, 601 bp, Human
aaaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccatctatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgt

SEQ ID NO: 35799 - DNA, 601 bp, Human
aaaaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaacccctactatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttg

SEQ ID NO: 35800 - DNA, 601 bp, Human
aaaaaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaacccaaactatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggctt

SEQ ID NO: 35801 - DNA, 601 bp, Human
aaaaaaaaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagagg

SEQ ID NO: 35802 - DNA, 601 bp, Human
cctggagtttgagaccagcctggctaacatggtgaaaccctgtctctactaaaaatacaacaaaattagccaggcgtggtgggcacacgcctgagtcccagctacttgggaggctgaggcatgagaatcactggaacccaggatggcagaggttgcaatgagctgagaagagtgccactgcactccaccctgggcaacagaggaagactctgtctcaaaaaaaaaaaaaaaaaaaaaaaaaaggccaggagcggtggctcacgcctgtaatcccaacactttgggagaggtcaggagttcragaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatatctatatctctatctatctacctacctatctatctgtctacagtcttgaactcccgacc

SEQ ID NO: 35803 - DNA, 601 bp, Human
ttaacatttattaccctctcttggccgggtgcagtggctcatgtctgcaatcccaggaggctgaggcaggcagatcacttgaggcctggagtttgagaccagcctggctaacatggtgaaaccctgtctctactaaaaatacaacaaaattagccaggcgtggtgggcacacgcctgagtcccagctacttgggaggctgaggcatgagaatcactggaacccaggatggcagaggttgcaatgagctgagaagagtgccactgcactccaccctgggcaacagaggaagactctgtctcaaaaaaaaaaaaaaaaaaaaaaaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaa

SEQ ID NO: 35804 - DNA, 601 bp, Human
tagtgacacaatctcagctcactacaacctccacctcctaggctcaagcaattctcgtgcctcagcctcccgagtagctgggattacagacatgcaccaccatacccagctaattttttgtatttttagtttcaccatgttggctagtcttgaactcctggcctcaaattgatccatctgccttggccttccagagtgctgggattacaggcatgagccaccgtgcccaggccaaagatgattaaatgggaaaataatactttttgtgtttttaacaaacagtgttgagacaaaagtatawccacatgtaaaagaatgaaattatactcctatctcacaccaaataacaaaagttaactcaaagtggatcatagaccagaagtagagagagcaatggtgatgataattaaaagcagcgattcactcatacaaccaatatttactatgtctagtactattctagatggaggggattcaatagaaaagcaaaataagatcctgcaaaataaaacataaaggacataatatactggtgaagggggtgactaggtagggagtaaatagcagacactgacaatgaagagacccaggaaagaaaaga

SEQ ID NO: 35805 - DNA, 601 bp, Human
gaaataaactcatacatacatctgtgatcaagcgattttcaacaataataaataccaagacaatttttttttttttttttttttgagacggagtctcgctctgtctcccaggctggagtgcagtggcacgatctcggctcactgcaagctccacctcctgggttcacgccattctcctgcctcagcctcccgagcagctgggactacaggcgcccagcaccatgcccggctaatttttttatttttagtagagacggggtttcaccatgttagccaggatggtctccatctcctgacctcrtgatctgcccgcctctgcctcccaaagtgctgggattacaggtgtgagccaccatgcctggccgacgatttttattttcttaattttttttttttttttttgagacagactcactctatcacccaggctggagggtagtgacacaatctcagctcactacaacctccacctcctaggctcaagcaattctcgtgcctcagcctcccgagtagctgggattacagacatgcaccaccatacccagctaattttttgtatttttagtttcaccatgttggctagtcttgaactcctggcctc

SEQ ID NO: 35806 - DNA, 601 bp, Human
atatggcttactgttatgatcacataaaacttaataaaagttaatatggcatatttaatgatatattcataattatttcatgctgcataatcaaatataaacggtaagtagttcatgtaagatgcttataattagtttaaaatctcaacacctcaccacaaagctatagtaatcaagaaagtgtggtaatagcataagaatagacacatacatcaataaaatggaattgacagtacagaaataaactcatacatacatctgtgatcaagcgattttcaacaataataaataccaagacaatttttttttttttttttttttgagacggagtctcgctctgtctcccaggctggagtgcagtggcacgatctcggctcactgcaagctccacctcctgggttcacgccattctcctgcctcagcctcccgagcagctgggactacaggcgcccagcaccatgcccggctaatttttttatttttagtagagacggggtttcaccatgttagccaggatggtctccatctcctgacctcgtgatctgcccgcctctgcctcccaaagtgctgggattacaggtgtgagccaccatgcctggcc

SEQ ID NO: 35807 - DNA, 601 bp, Human
gcaatgatctatgaaaactgaacttacatgcatatggcttactgttatgatcacataaaacttaataaaagttaatatggcatatttaatgatatattcataattatttcatgctgcataatcaaatataaacggtaagtagttcatgtaagatgcttataattagtttaaaatctcaacacctcaccacaaagctatagtaatcaagaaagtgtggtaatagcataagaatagacacatacatcaataaaatggaattgacagtacagaaataaactcatacatacatctgtgatcaagygattttcaacaataataaataccaagacaatttttttttttttttttttttgagacggagtctcgctctgtctcccaggctggagtgcagtggcacgatctcggctcactgcaagctccacctcctgggttcacgccattctcctgcctcagcctcccgagcagctgggactacaggcgcccagcaccatgcccggctaatttttttatttttagtagagacggggtttcaccatgttagccaggatggtctccatctcctgacctcgtgatctgcccgcctctgcctcccaaagtgctg

SEQ ID NO: 35808 - DNA, 601 bp, Human
actgcccttaagagccatttaaaaagtaatggcaggtgaattacaagcaatagtttcctaattgtttttggatgctgcataagcaaaaacctaaactacataagcaatgatctatgaaaactgaacttacatgcatatggcttactgttatgatcacataaaacttaataaaagttaatatggcatatttaatgatatattcataattatttcatgctgcataatcaaatataaacggtaagtagttcatgtaagatgcttataattagtttaaaatctcaacacctcaccacaaagctayagtaatcaagaaagtgtggtaatagcataagaatagacacatacatcaataaaatggaattgacagtacagaaataaactcatacatacatctgtgatcaagcgattttcaacaataataaataccaagacaatttttttttttttttttttttgagacggagtctcgctctgtctcccaggctggagtgcagtggcacgatctcggctcactgcaagctccacctcctgggttcacgccattctcctgcctcagcctcccgagcagctgggactacaggcgcccagcaccatgcccggc

SEQ ID NO: 35809 - DNA, 601 bp, Human
cctactatgtaccaaacttaggaaaaacagtgttgagacagacaaaattactactctcatagaatttacattgtagcagaagagatacacaatatataaatacattgtgtttgtgtaaataattagatagaaataaacacacacctgtgaaccccagcactttgggaggccgaggtgggcagatcacctgagctcaggagttaccagcctgggcaacatggtaaaacctcatctctacaaaaaatacaaaaattggccgggcatggtagcgtgtgcctgtagtcccagctatttgggaggytaaggcaggaagaggctgggagacagaggctacagtgagccgagatcacgccactgcactccagcctcagtgacagagcaggaccctgtcttaaaaaaaaaaaaaaaaagaaaaggaaacacaatcaaaaatataaaaacaagattaacagacaatgggggcacggcgatacagccctactttacataagtctgcaagtttttacactagaagcattagagaaaggcagtaagtttctaatacctgtataaggcagatgtcccataaaactttcaggaaaataactttggaaataattta

SEQ ID NO: 35810 - DNA, 601 bp, Human
tcattcatttaagcctaccaaatgcctaaaattatctgatataatactgccctaaatccacagcagatataatgcattgcatagaaaactagagtacttttttttttgtttaatttagagacagggtcttgctctattgcccaggctagcatgcagtgccacaatcatagctcactgcagcctcagacttctgtactcaagctatcctcccactatagcctcccaagtagctaggactatgggcatatgccaccatgtacatttatttatttattttgttggtagtgatggggtctcactmtgttgcccaggctgatttcaaactcctggcctcaagcaatcatcccacctcagcctcctagagtgctagggttataggcatgagcaatcacaccctgctgagcttactgttcttaacatctgaaccctgcccaatccctcacttagttctgcctctcaaggatttctgtcaaattatgattatacttctttgaaaacacatagataacaatgtccaaagggagatttgggtttagtaaagtggaattaaagcacaattcattcattcctttaagcatctgagtgcctactatgtaccaaa

SEQ ID NO: 35811 - DNA, 601 bp, Human
agttttcatggacagcacttgagtgtcattcttgggatattcaacacttacactccaaacctgtgtcaagctgaaaagcacaaatgattttcaatagctcttcaacaagttgactaaatctcgtactttcttgtaggctcctgaaattaaattgtttgagaaacacactcagcaagtgattatcaaccttttaaggacactaaaataagaaaagacatgtaaacaaataaaaataagatgcagcaacagtagaaaacctctataatcaatacatcattgacatctgtataaaccgtgtgayggcagtgatttagtaactttttgtcattcatttaagcctaccaaatgcctaaaattatctgatataatactgccctaaatccacagcagatataatgcattgcatagaaaactagagtacttttttttttgtttaatttagagacagggtcttgctctattgcccaggctagcatgcagtgccacaatcatagctcactgcagcctcagacttctgtactcaagctatcctcccactatagcctcccaagtagctaggactatgggcatatgccaccatgtacatttatttatttatttt

SEQ ID NO: 35812 - DNA, 601 bp, Human
ggcacacaccaccatgcccagataatttaaaaaaacttttaatatagacaaggacttgctatgttgcccaaactggtcttgaactcctgagctcaggcaatcctcaagcctcctagtgctggaattacaggcgtgagccacggcacccagctactttttttttttttttaattgcagagacagtgtctcactgtgttgcccaagctgggctcaaaggacctcctacctcagcctcccaaagggttgggattataggcatgagccatggcacccagctgaagtaatttccaaatgcttaaawatatcagtgaccttatggctattttagataagcatcacagagcagataaagctccaaagcaaggaagggcctataagagctctcttttttggccgggcttggtggctcacgcctgtaatcccagcactctgggaggccaaggagggtggatcacctgaggtcaggagttcgagaccagcctgaccaatatggtgaaaccccgactctactaaaattacaaaaattagccaggtctggtgtcgtacccctgtagtcccaactactcaggaggctgaggcaggagaatcacttgaacctggg

SEQ ID NO: 35813 - DNA, 601 bp, Human
gagcaaatcactacattttctttaacaattacaccttttaagttcaagtaattttccctttttttaaaagatagggtctcagtcacctgcgctggagtccagtggcacagtcatagctcaactgcagccttgactctctatgttaaagcaatgctccagcctcagcctcccaagtagctaggaccacaggtgcataccaccacgcccagctaagtttttttgttttttttttgagacagagtctcactctgtcgcccaggctggatcgcagtggcgggatctcggctcactgcaagctccrcctcccgggttcatgctattctcctgcctcagcctcccgagtagctgggactacaggagtccgccatcacgctcagctaatttttctgtgtttttagtagagacgggctttcaccatgtgagccaggatagtcttgatctccacacctcgtgatccacttgactcggcctcccaaagtgctgggattacaggcgtgaagctttttttttttttttttttgagacggagtcttgctctgtcgcccaggctggagtgcagtggcgcaatctcggctcactgcaacctccgacctctcaggtt

SEQ ID NO: 35814 - DNA, 601 bp, Human
ggtgcgatctcggttcaccgcaacctccacctcccgggttcaagtgattctcctgcctcagcctcccgagtagctgggattacagttatgtgccaccacacctggctaattttttattttttggtacagacagagtttctccatgttggctaggctggtctcgaactcccgacctcaggtgatccacccactttggcctcccaaagtgctgggattacaggtgtgagccaccatgcctggcctcttttgctccctttttaaagtaagattcttcaaggtgggaactgcgtcttttacattwtttataactcaccatagggctcataaaattcacttcccaaagctgcctaccacaaatacaaattatgaccaagatttttggcaaaactataagataaggaatccagcaattattattaaatacttaaaaaacctgagacccttacccaattcaatgtagacagacgtcttttgaggttgtatccgctgctttgtcctcagagttctcacagttccaaggttagagagttggacactgagactggtttcctgctaaacagtatggtaaagaacagtcaagcaattgttggccagttctgtg

SEQ ID NO: 35815 - DNA, 601 bp, Human
tactgtagcaatccatcatgttttttcttattgctactctccatctttccaaaacatatttacacatatttaaaaccagatattctttcttttgctctcttttttttttttagatggagtttcgctatttttgcccaggctggagtgcaatggtgcgatctcggttcaccgcaacctccacctcccgggttcaagtgattctcctgcctcagcctcccgagtagctgggattacagttatgtgccaccacacctggctaattttttattttttggtacagacagagtttctccatgttggstaggctggtctcgaactcccgacctcaggtgatccacccactttggcctcccaaagtgctgggattacaggtgtgagccaccatgcctggcctcttttgctccctttttaaagtaagattcttcaaggtgggaactgcgtcttttacattttttataactcaccatagggctcataaaattcacttcccaaagctgcctaccacaaatacaaattatgaccaagatttttggcaaaactataagataaggaatccagcaattattattaaatacttaaaaaacctgagacccttacccaa

SEQ ID NO: 35816 - DNA, 601 bp, Human
aattattatttttttgagatgcagtctcactctattgcccaggctggagtgcagtggtgtagtgttggctcattgtaacctccgcctccctggttcaagcgattctcctgcctcagcctcccaagtagctgggattacaagcatgtgctaccacacccagctaatttttttttttttttgtatttttagtaaagaggggtttcaccaggttatccaggctggtctcgaactctgacctcaggtgatctacctgcctcagcctcccaaagtattgggattacaggcatgagccaccgcacctgccaaaaatgtattattattttaaaaatagagacagggttcccctatgttggccaggctggtcttaaactcgtggactcaaccaatccttctgcctcggtcttccaaagcgttaggattacaggcacgagccatcctgcccagccaagattcagctctttttttttttttttgagatggagtttcactcttgttgcctaggctggagtgcaatggtgcgatcttggctcactgcaacctctgcctcctgggttcaagcgattctcctgcctcagcctcctgagtagctgggattacaggc

SEQ ID NO: 35817 - DNA, 601 bp, Human
taaaataagtataataggaacaatctcagaggtctgacaagcatctaatgagttatacaagaaaagcacaatagtgcctggaatatagttaagtgctcctaaatatcaactactataactatttttacaatgcctgttgtctaggaatttatgatcataaggggggaaaacagtaagtgttatgataaatagatggtggtgcctgggagctcaaaagatggctatcctttttaattataaatatattctaaaagaaaatccaatttgagagcccagtttgaattctgagctcagcagctcttttttttttttttttggaggtcttgctctgtcacccaggttggagtgcagtggcatgatcatagctcactacagcctcaaactcctgggttcaatgtatccactcacctctgcctcctgagtagctgggactacagatgcacaccaccacacccagctaatttaaaaaagaaatttttttgtagagatgaggtcttgctatgttgcccaggctggtctcaaactcctggcttcaagcaatcctctgccactgctgagattacagatgtgagctactatgctggcctcaacttttcttttt

SEQ ID NO: 35818 - DNA, 601 bp, Human
tatatgaggaacttagagaacaatctgctagaagcaagcatgtgcagagttctactgttatcctaaattcctttggacagtgctaataactaaatccaacaaacaaaaagggtatttcctccactataaaatgagagaactaaactagatgatctctaaggtttcttccaataccatgattctagtctggagaaacaccagcctacttgagggaggaaggtgggaagagggagaaattcagaaagaaagcaaacaaaaaactgtggggtatgcttagtacccggatgatgaaaaaaatctrtacaccaaatcccaagtcgtgtgtttacctatataacaaactgcacatacatccctgaacctaaaataaaagttaaaatatttttaaaaagagagaaacatcaatccttaatattaactaaataggaaaataccagcttcatagacaaaggttctctttgactcacctgcaataagttgccttattaacggtatcttcagaagaatcagatcctaaaaaatttccccccaaaaaataaatcaataaaagttttcttaattaaaagggttaaaaaaatgtacttgttgaaaaacagatatt

SEQ ID NO: 35819 - DNA, 601 bp, Human
gaggctgaggcaggagtatggcttcaacctgggaggcagacgttgcggagaggtgagatcacacctctgtactccagcctgggcaacagagcaagactctgtctcaaaaaaaaaaaaaaaaaagagagaaagaaagaaatggaatggtcaattaaccgggcgtggtggtgtatacctgtagtcccagctactcgtgagattgagacaggagaatcgcttgaaccagggagttggagattgcagtgagccgagatggcgccactacactccatcctggcaacagggcaagaccccgtctccaaaaaaaaaaaaaaaaaacctgggtcaagcaataattcctaaggaaggtaggtaacatagttggggttgcttgtagtttattatataacatacagacaaagcttgagagatatgtggaaataaggaacagaggaaagaaagagttgaaaatgaagtccttgaacattttcatcagtcacaattactgctgtgtcaatattactgtatatgaggaacttagagaacaatctgctagaagcaagcatgtgcagagttctactgttatcctaaattcctttggacagtgctaataactaaatcc

SEQ ID NO: 35820 - DNA, 601 bp, Human
aaagtaaagggcaggccaggcacagtggctcaagcctgtaactgcagcactttgggaggctgaagtgggcagactgcttgagtccaggagtttgagaccagcctcggtaacatggtgaaaccccatctctataaaaccacaaaaaattaaccgggtgtggtggcatgcgcctgtagtcccagctactcaggaggctgaagtgggaggatagcttgagccttggaggtggaggttgcagtgagccaagattgcatcactgcactccagcctgggcaacagagtgagaccccatctcaaaaamaaacaaacaaacaaacaaaaaaaaaaacgaaagggcaacaatcagttacagaaggtcttattataggtacattagtctagtaccatttaaatctatcagaccataccacgacatttgacagagaatgatactctaactctgccaagagattttgtgggttgtaaaggtcccaaatggtcttcagaataatctaattacagtactgtatctacccactctcttttcagtgcctgttaagttggcaaactttgccattacccttttttgcagaatccaaactgatttcatccctggttcctt

SEQ ID NO: 35821 - DNA, 601 bp, Human
tgccttccctagagtgctaacttccagtaacgagatactttcctgagtgccataatcagtaccaggtaccaatgaaatactgctactctctacagatctttcagtttgcaaaaccctttctccacttaacatgagatctttggggtcttcagcattattagacactttaactgtttctagtttctcttctttttcttctcttggaaggctaggattgacaaattctttaagttcactggtatttgaacacttagtaaaagaaccaggtgcatttgttaacttcagctctgggaaagtatcrctgtcatgtcttttacttgtctgttcatttggcttgttactcttcttggctccagttgcaggttctttaccttccatgagttgtaggtttctgctgtgcctgactggcatttggttgtacttttttttctttatctcttcactgctagaacaactatcaatttgcaattcagtacaattaggtgggcttagatttctactgactactagttcaagcgcatgaatatgcctggtagaagacttcctcctcagcctattctttttaggtgcttttgaattgtggatatttaattcgagttcc

SEQ ID NO: 35822 - DNA, 601 bp, Human
ctccattccagcctgggtaacagagtaagagaccctgtgtcaaagaaaccaaaaagaaaaaaataactagattttaaaagggaaaaaaaaaaagaagaagagaaagaagtatccacaaaacagtgaaaggctagatggtctctattaggaagagaaccctatagtctccaacttggtaccaagaataaacaccaaaattgcgattgctggcaataatattggtgagagttctgtacctggctgtgtggccttaggcagtttgcttaccttctctgacctgcagtaggcatattcttaaaakggagctatgcagagtcccttgaatcatcctgctgtggctcctttttctcacctctcttgatacagtaagtgccgtcatgtttttgctataggggaaatgatgtgtttttgtttgtttgtttttgagatggagtctcactttgtcacccaggctggagtgcagtggtacaatcccagctcagtgcaacctccgcctcccaggttcaggcgattctcctgtctcagcctccagaatagctgggattacaaggcattggccaccacgcccagctaatttttgtatttttagtagatgtggggt

SEQ ID NO: 35823 - DNA, 601 bp, Human
tgatacactggaaagatagaatcccatatagtaattaaaaatgaagtcacttaagaattttaacgacccaggctgagtgcggtggctcacgcctgtaaccccagcactttgggaggccgaggtgggtggatcacttgaggccaggagtttgagaccagcctggtcaacatggagaaaccctgtctctactaaaaatacaaagttagctgggcatggtggcacatgcctgtaatcccagctactcgggaggctgaggcaggagaatcgcatgaacccgggaggcagaggatgcggtgagccraggtcacaccactgcactccagcctgggcaacaagagtgaaactccatctcagaaaaaaaaaaaaaaaaagaaaaaagaattttaatgatccagtaaaagctagattataatgcacagaattatctggatttcttgtttttgagacagggtctcaccatatcacccaggatggagtgcagtggcaccatcatggctcaccacggcctcaacttgctgggatcaagcaatcctaccccagccactcaagtagctgagactacaggtgtgcaccactaagcctcactaattttttttttttt

SEQ ID NO: 35824 - DNA, 601 bp, Human
accaaaatcctagtcccagtaatttagactaaggaaataatcagggatgtaggcaaatatttagctatcaggatgccactatagtgatgtacataatagcaaactgtgcctcttaccctgaaacctccaacattcagcaataggtcaaataaatcatgatacactggaaagatagaatcccatatagtaattaaaaatgaagtcacttaagaattttaacgacccaggctgagtgcggtggctcacgcctgtaaccccagcactttgggaggccgaggtgggtggatcacttgaggccagragtttgagaccagcctggtcaacatggagaaaccctgtctctactaaaaatacaaagttagctgggcatggtggcacatgcctgtaatcccagctactcgggaggctgaggcaggagaatcgcatgaacccgggaggcagaggatgcggtgagccaaggtcacaccactgcactccagcctgggcaacaagagtgaaactccatctcagaaaaaaaaaaaaaaaaagaaaaaagaattttaatgatccagtaaaagctagattataatgcacagaattatctggatttcttgtttttgag

SEQ ID NO: 35825 - DNA, 601 bp, Human
ctgacccttgtttgttcacattcattacatataaatatatatataaaaccttcccataaaacatgtgtatttaatgagttaaaactatttctaatgttcctactactacataataagcctaatccagatacaagctgaagtcttagcacaaatagtggctttatcatgctagttttgtcgacatgttgtgaatattttcaaatatacagaaaacttgaagcaactttgcaatgagtgtttatatatctactacttagaatctataattaacatttcctatatttattttatcacatacatccacacacacacacacacacacacacacacacacacacacacacagaagtccccaccaataatccatctcctatcgggaacagatgatctctcactacttgatttacattgctaatgcattagtatacccaaatggaacacatgaccttgataggaggaagcttcccttaatcatatttgtctccctaatgcctagcagacagtaagcactcagcaagtgtttattaatgagaagataaattaataaataagtatagttaatcagtcttctgtaaaaacaaacaaaaacccagatatcaat

SEQ ID NO: 35826 - DNA, 601 bp, Human
aaaaattctcatctttcaaggcctagtttgaatgtctccttaagtccccaccaggaggagttgtgaaatatgagaagtaagggcaagtgggcagaatgtggctaattctaataagactcctgaaatgtgcagcagagcagccggaactggtctggagggaagcagagtgtatatctgacccttgtttgttcacattcattacatataaatatatatataaaaccttcccataaaacatgtgtatttaatgagttaaaactatttctaatgttcctactactacataataagcctaatccaratacaagctgaagtcttagcacaaatagtggctttatcatgctagttttgtcgacatgttgtgaatattttcaaatatacagaaaacttgaagcaactttgcaatgagtgtttatatatctactacttagaatctataattaacatttcctatatttattttatcacatacatacacacacacacacacacacacacacacacacacacacacacacagaagtccccaccaataatccatctcctatcgggaacagatgatctctcactacttgatttacattgctaatgcattagtata

SEQ ID NO: 35827 - DNA, 601 bp, Human
atgtatcttccatgggctccccatagcatctacttgttgtaggtactcagatgacaacatgaatgactgccttgggtccctctgactggtatattagttgtgagcagggacaagaaccaaggctccataattacccatgtgctgagcaaggatcataaaatgttggagctaggtccttactcttcagaaggagataaaggggaaggaaagaattttgcttaagatatcagtgtttggccaacaatacacacctttttctgatgtgctttgttctggatttcgcaggtcctcaagggcagargagtcacttatgatggaagggtagctgttagaaggctggctcccatgctgttctaacacagcttctagttcagccatttcctgctggagctttatcaggttatgttgcatggtatccctctgcttcaaaaacgataaatggcaccaagaaaatgaaatactttgagaagctttccattaaatgaaaatatatcatacaaattaattttagcacaggaattgaaatcacctagtatggaactacaagttctagctgaacaccttttaatctaaccacattcatgcaattaatgcccatgaa

SEQ ID NO: 35828 - DNA, 601 bp, Human
gccctttaataaggcttgtagcagcagtttccttctggagacagagttgatgtttaatttaaacattataagtttgcctgctgcacatggattcctgccgactattaaataaatccctagctcatatgctaacattgctaggagcagattaggtcctattagttataaaagagacccattttcccagcatcaccagcttatctgaacaaagtgatattaaagataaaagtagtttagtattacaattaaagaccttttggtaactcagactcagcatcagcaaaaaccttaggtgttaaaygttaggtgtaaaaatgcaattctgaggtgttaaagggaggaggggagaaatagtattatacttacagaaatagctaactacccattttcctcccgcaattcctagaaaatatttcagtgtccgttcacacacaaactcagcatctgcagaatgaaaaacactcaaaggattagaagttgaaaacaaaatcaggaagtgctgtcctaagaagctaaagagcctcagttttttacactcccaagatcaatctggatttatgattctaaaacccctggtgacagaatcagaggctgaaaacac

SEQ ID NO: 35829 - DNA, 601 bp, Human
tttagtagagacaaggtttcaccatgttgaccaggctggtctcgaactcctgacctcaagtgatccacctgccttggccactcaaagtgctgggattataggcatgagccaccacgcctggcctataaaattactttcacatttcattttgcctgatctgttgtcacagaagttctcagatggctgttctgaaattattcctcctcctacactctatcttatttacttctcactgttctcagtatcataaagtgcaacatctttttgaagcaatctgaattataaacagatacatttgcaygtatatatatgtatatatgcatatgcacacacacacttttttttttttaagagacagggtcttgctctgtgcaagtgcaagagtgcaatggtatgatcatagctcactgcagccttgaactcctgggctcaagtgattcttctggcttagcttcctcagtagctaagactacagaagcacactgccatgcccggctaattaaaaaaaaattttgtggagacagagtctcactatgttgcccaggctggtttcaaactcctggcctcaagtaatcttcctgtctcagcctcccaaagggct

SEQ ID NO: 35830 - DNA, 601 bp, Human
ttcaagtgattctcctgcctcagcctccccagcagctaggattacaggcacatgccaccacgctcgactaatttttttgtgtttttagtagagacaaggtttcaccatgttgaccaggctggtctcgaactcctgacctcaagtgatccacctgccttggccactcaaagtgctgggattataggcatgagccaccacgcctggcctataaaattactttcacatttcattttgcctgatctgttgtcacagaagttctcagatggctgttctgaaattattcctcctcctacactctatyttatttacttctcactgttctcagtatcataaagtgcaacatctttttgaagcaatctgaattataaacagatacatttgcatgtatatatatgtatatatgcatatgcacacacacacttttttttttttaagagacagggtcttgctctgtgcaagtgcaagagtgcaatggtatgatcatagctcactgcagccttgaactcctgggctcaagtgattcttctggcttagcttcctcagtagctaagactacagaagcacactgccatgcccggctaattaaaaaaaaattttgtgg

SEQ ID NO: 35831 - DNA, 601 bp, Human
ataaaattactttttttttttttttaagacagggtctcattctgtctcacaggctggagtgcagtggtgcaatctaggctcactgcaacctccgcctcccgggttcaagtgattctcctgcctcagcctccccagcagctaggattacaggcacatgccaccacgctcgactaatttttttgtgtttttagtagagacaaggtttcaccatgttgaccaggctggtctcgaactcctgacctcaagtgatccacctgccttggccactcaaagtgctgggattataggcatgagccaccaygcctggcctataaaattactttcacatttcattttgcctgatctgttgtcacagaagttctcagatggctgttctgaaattattcctcctcctacactctatcttatttacttctcactgttctcagtatcataaagtgcaacatctttttgaagcaatctgaattataaacagatacatttgcatgtatatatatgtatatatgcatatgcacacacacacttttttttttttaagagacagggtcttgctctgtgcaagtgcaagagtgcaatggtatgatcatagctcactgcagcc

SEQ ID NO: 35832 - DNA, 601 bp, Human
gttctgtatatttctccatagcatttattgttatcttaaattcatctttattgtgtatctcccctcgacagaacctgaatcctaccagggacttagttagtcttatttactgttgcattcctagtgcccagaacacagtaggctcccaataaatagccactgaataaaagttaaaaccaacaaaaataatcatttaattaattatgaatacatcgaattgtgcacaatagtttataaaattactttttttttttttttaagacagggtctcattctgtctcacaggctggagtgcagtggygcaatctaggctcactgcaacctccgcctcccgggttcaagtgattctcctgcctcagcctccccagcagctaggattacaggcacatgccaccacgctcgactaatttttttgtgtttttagtagagacaaggtttcaccatgttgaccaggctggtctcgaactcctgacctcaagtgatccacctgccttggccactcaaagtgctgggattataggcatgagccaccacgcctggcctataaaattactttcacatttcattttgcctgatctgttgtcacagaagttctcagatg

SEQ ID NO: 35833 - DNA, 601 bp, Human
atcaacaacctttgacagctaatactattccactgttctgtatatttctccatagcatttattgttatcttaaattcatctttattgtgtatctcccctcgacagaacctgaatcctaccagggacttagttagtcttatttactgttgcattcctagtgcccagaacacagtaggctcccaataaatagccactgaataaaagttaaaaccaacaaaaataatcatttaattaattatgaatacatcgaattgtgcacaatagtttataaaattactttttttttttttttaagacaggktctcattctgtctcacaggctggagtgcagtggtgcaatctaggctcactgcaacctccgcctcccgggttcaagtgattctcctgcctcagcctccccagcagctaggattacaggcacatgccaccacgctcgactaatttttttgtgtttttagtagagacaaggtttcaccatgttgaccaggctggtctcgaactcctgacctcaagtgatccacctgccttggccactcaaagtgctgggattataggcatgagccaccacgcctggcctataaaattactttcacatttcatt

SEQ ID NO: 35834 - DNA, 601 bp, Human
cgctgggcaaatttttgtatttttagtagagacagggtttctacctcagtgatctgtccgccttgacctcccaaagtgctgggattacaggaatgagccaccacacccagccgtgcccagctaatttttgcattttttagtagagatggggttttgccacgttggccaggctggtctcaaactcctgacctcaggggatctgcctgcctcggcctcctagagtgctggaattacaggtgtgagccactgtgcccgaaccttttatcattattatttcttgagacaggagtcttgctctgtygttcaggctggagtgcagtgatgcgatcttggctcactgtaactcctacctttcggttcaagtgattctcctgcctcagcctctggagtagctgggattacaggcactgggattacaggcacacaccaccacaccatgctagttttttgtatttttagtagagatggggtttcaccatgttggccaggctggtctcgaactcctgacctcaagtgatttgcctgccttggcttcccaaagtgctgggattataggcacgagccaccacacacgaccaacattggcctatcttttaaaaaa

SEQ ID NO: 35835 - DNA, 601 bp, Human
acctataaccctagcactttggcactttgggaggctgaggcaggaggacagcttgagaccaggagctggagacccagctgggcaacacagtgagaccccttctctagaaaaaagatacataaaacctcagccaggcatagttgcatgtgcctgcagtcccaatttcttgaaaagctgaagctggaggatcacttgagcccaggagttggaggctgcagtgaactgtgatcataccaccacactcccgcctgggtgacaaagtgagactctgctaaaaaaacacacacacacacacacacayaaaacaaaaaaaagaaagaaagaaaaagaattgctgggcagagatttgaccaaaagcaagtaaaatcattctttttggtagaccaggtgaaatgactaggatctcagctgttgaaatcaattcactgaagcaaatcttttgtgtgcagaacttaacaatcggcttttcacctcactgggacttaatgtattttaattttcaacatctatctcctctcaaaacattcacttagcatttagattagactgctaatactgtgctgttataaaggtaactgaaaaattccctatctcctaaatc

SEQ ID NO: 35836 - DNA, 601 bp, Human
gctgggcaccaatggctcacacctataaccctagcactttggcactttgggaggctgaggcaggaggacagcttgagaccaggagctggagacccagctgggcaacacagtgagaccccttctctagaaaaaagatacataaaacctcagccaggcatagttgcatgtgcctgcagtcccaatttcttgaaaagctgaagctggaggatcacttgagcccaggagttggaggctgcagtgaactgtgatcataccaccacactcccgcctgggtgacaaagtgagactctgctaaaaaaamacacacacacacacacacataaaacaaaaaaaagaaagaaagaaaaagaattgctgggcagagatttgaccaaaagcaagtaaaatcattctttttggtagaccaggtgaaatgactaggatctcagctgttgaaatcaattcactgaagcaaatcttttgtgtgcagaacttaacaatcggcttttcacctcactgggacttaatgtattttaattttcaacatctatctcctctcaaaacattcacttagcatttagattagactgctaatactgtgctgttataaaggtaactgaaa

SEQ ID NO: 35837 - DNA, 601 bp, Human
gaatggcgtgaacccgggaggcggagcttgcagtgagcggagatcacgccactgcactccagcctgggcaactgagcgagactccgtctcaaaacaaacaaacaaacaaacaaaaaaaccaaaaattagctgggcgtggtggcatgcacctgtagtcccagctactcgggaagctgaggcatgagaattgctggaatccaggaggcagaggttgctgtgagccacgatcatgccactgcactccagcctgggtgacagagtgaaactctgtctcaaaaaaaaaaaaaaaaaaaaaaaaaawtttaaggcattcagaattgccaggcaggcagtagctgggcaccaatggctcacacctataaccctagcactttggcactttgggaggctgaggcaggaggacagcttgagaccaggagctggagacccagctgggcaacacagtgagaccccttctctagaaaaaagatacataaaacctcagccaggcatagttgcatgtgcctgcagtcccaatttcttgaaaagctgaagctggaggatcacttgagcccaggagttggaggctgcagtgaactgtgatcataccaccacactcccg

SEQ ID NO: 35838 - DNA, 601 bp, Human
gcactttgggagactgaggcaggcagatcacttgaggtcaggagttcgacaccagtctgaccaacatggtgaaacctcatctctactaaaaatacaaaaaattagttgggcgtggtggcaggcacctgtaatcccagctacttgggaggctgaggcaggagaatcttttgaatgcaggaggtggaggttgcagtgagctgagatggtgccactgcactccagcctgggtaacagagcgagactccatctcgcatctcaaaaaattaaaaataaaattaaaaaaaaaaaaattaggccgggygtggtggctcacgcctgtaatcccaggactttgggaggccgagacaggcggatcacgaggtcaggagatcgagaccatcctggctaacacggtgaaaccccgtctctacttaaaatacaaaaaaattagccgggtgtagtggcaggcgcctgtagtcccagctactcgggaggctgaggcaggagaatggcgtgaacccgggaggcggagcttgcagtgagcggagatcacgccactgcactccagcctgggcaactgagcgagactccgtctcaaaacaaacaaacaaacaaacaaaaa

SEQ ID NO: 35839 - DNA, 601 bp, Human
gtgggtggatcacttggggtcgggagttcaagaccagcgtgaccaacatggagaaaccccatctctactaaaaatacaaaatcagctgggcgtggtggcacatgcctgtaatcctagctacttaggaggctgaggcaggagaatcacttgaaccctggaggcagagattgcggtgagccaagatcgcgccattgtacttcagcctgggcaagaagagcaaagcttcgtcttaaaaaaaaaaaaaaagaaatttgaagtttcacctctacatatacatttctcttccagagaaaaatactayggtgacatttagtattttcagaatgtcattactttgaccacatactttccatcattgctattctgcatggaggaaaaaatccaaagcactagaatttctttttaaagaggggaagaatctggtgctaatactgcctagcatacagtggaggaaaaacagaggactggctcacatggcgctcccctgtggtaaaggcagaagcagaaataaggccagcagcttttcttggcatctggaacaattacttgataggctcagaaggtaaaaacaggctgacctcagcagttcaaaactccaggc

SEQ ID NO: 35840 - DNA, 601 bp, Human
gatggagaccatcccgtctaacacagtgaaaacccgtctctactaaaaatacaaaaaattagctgggcatggtggcgggcacctgtagtcccagctacttgggaggctgaggcaggagaatggtgtgaacccaggaggtggagtggagctggtagtgagccgagacggcgccactgcactccagcctgggtgacatagcgagactctgtctcaaaaaaaaaaagaaatttgaagtttcaggccgggcgcggtggcctgtaatcctagcactttgggaggccgaggtgggtggatcacttgrggtcgggagttcaagaccagcgtgaccaacatggagaaaccccatctctactaaaaatacaaaatcagctgggcgtggtggcacatgcctgtaatcctagctacttaggaggctgaggcaggagaatcacttgaaccctggaggcagagattgcggtgagccaagatcgcgccattgtacttcagcctgggcaagaagagcaaagcttcgtcttaaaaaaaaaaaaaaagaaatttgaagtttcacctctacatatacatttctcttccagagaaaaatactatggtgacatttagtatt

SEQ ID NO: 35841 - DNA, 601 bp, Human
tgtaatcccagcactttgggaggctgaggcaggcggatcacgaggtcaagagatggagaccatcccgtctaacacagtgaaaacccgtctctactaaaaatacaaaaaattagctgggcatggtggcgggcacctgtagtcccagctacttgggaggctgaggcaggagaatggtgtgaacccaggaggtggagtggagctggtagtgagccgagacggcgccactgcactccagcctgggtgacatagcgagactctgtctcaaaaaaaaaaagaaatttgaagtttcaggccgggcgcrgtggcctgtaatcctagcactttgggaggccgaggtgggtggatcacttggggtcgggagttcaagaccagcgtgaccaacatggagaaaccccatctctactaaaaatacaaaatcagctgggcgtggtggcacatgcctgtaatcctagctacttaggaggctgaggcaggagaatcacttgaaccctggaggcagagattgcggtgagccaagatcgcgccattgtacttcagcctgggcaagaagagcaaagcttcgtcttaaaaaaaaaaaaaaagaaatttgaagtttcacctc

SEQ ID NO: 35842 - DNA, 601 bp, Human
gactgcgatagagaaaaaaatcaggaagctaaaaatacacggatggccttttagaaagtggtcaccctcccccttgacagacagacggacagaaacacacacacacacacacacacacacacacacacacacacactcttactttaccgccagagtgaaaagaaatggcagtaggacaagtctgtgtgttttttttttttttttgagacgcagtcttgcactgtcgcctgggctggagtgcaatggtgccatctcggctcactgcaacctccacctcctgggttcaagtgattctcctgcytcagcctccctagtagctgggattacaggtgcacaccaccacacccggctaattttttgtatttttagtagaaacggggtttcactatgttggccaggctggtcttgaactcctgacctcatgatccacccgcctcaggctcccaaagacaagtctgtttgttttaagggacagcatccatctgtgccactctcactacctgtatgaataaaccgcacccccaacctgttgataggacctgcatgctcataatgctagaagttctccccaggcagccaagtggagccaaatgctgacatg

SEQ ID NO: 35843 - DNA, 601 bp, Human
aatttaaacagtcccatgtggctggtggcaacagtgtgggacagtgcaaattctcataaacacactggcataggttcttagcaaataacttgggtatcacttaaaaataaaccctaaaattgtatcattttggatggatatgttttgggtgactctcagtgtcttgaccttcccattgcaataaaaagaaaattgccaaggcctaaaattcacctggcttcaaagagactgcgatagagaaaaaaatcaggaagctaaaaatacacggatggccttttagaaagtggtcaccctccccctygacagacagacggacagaaacacacacacacacacacacacacacacacacacacacacactcttactttaccgccagagtgaaaagaaatggcagtaggacaagtctgtgtgttttttttttttttttgagacgcagtcttgcactgtcgcctgggctggagtgcaatggtgccatctcggctcactgcaacctccacctcctgggttcaagtgattctcctgcctcagcctccctagtagctgggattacaggtgcacaccaccacacccggctaattttttgtatttttagtagaaa

SEQ ID NO: 35844 - DNA, 601 bp, Human
agtctgactacctggtttcctgaagacacagatcacactgcactgcctcttccacttacagggcttggcaacactgttcaaaacaactttctgtgatagtcacaatgttctatatctatgctaataaggtagccatgagtcacatatagttattgagcactggagatgtggttagggtgaatgaagaactaaacttcatattttaatttttttctttttttttgaagagatgaggtctcattctgtcactcaggctggagtacagtggcacgatcatagcttgctgcggtattgaacttcygggctcaagcaatcctcttgcctcagcctcctaagtagctgggactacaagtgcacaccaccatgactggctaatttgtaaaatttaaatttaaacagtcccatgtggctggtggcaacagtgtgggacagtgcaaattctcataaacacactggcataggttcttagcaaataacttgggtatcacttaaaaataaaccctaaaattgtatcattttggatggatatgttttgggtgactctcagtgtcttgaccttcccattgcaataaaaagaaaattgccaaggcctaaaattcac

SEQ ID NO: 35845 - DNA, 601 bp, Human
tcctcattgaactagtctgactacctggtttcctgaagacacagatcacactgcactgcctcttccacttacagggcttggcaacactgttcaaaacaactttctgtgatagtcacaatgttctatatctatgctaataaggtagccatgagtcacatatagttattgagcactggagatgtggttagggtgaatgaagaactaaacttcatattttaatttttttctttttttttgaagagatgaggtctcattctgtcactcaggctggagtacagtggcacgatcatagcttgctgcrgtattgaacttccgggctcaagcaatcctcttgcctcagcctcctaagtagctgggactacaagtgcacaccaccatgactggctaatttgtaaaatttaaatttaaacagtcccatgtggctggtggcaacagtgtgggacagtgcaaattctcataaacacactggcataggttcttagcaaataacttgggtatcacttaaaaataaaccctaaaattgtatcattttggatggatatgttttgggtgactctcagtgtcttgaccttcccattgcaataaaaagaaaattgccaag

SEQ ID NO: 35846 - DNA, 601 bp, Human
ccagggacaagcagtccaatgtccagaacactactggatttcagaagatcttcttgaagtgcatatgtagttgacctgcactctacaggcattctttgtcattcaaggactgagcatctcacttttgtcaccaatcaggccaaggctcctccctaatgatctctgcaggtgctttaacttgttagatgcaagggaaaaaaggtccttctgtatgtttaataagaggcttggatggctagaaactcaaagttattggctgaagtttgatgtttatccagacttggtacctcaagtactcacyatgaccccatcaacagaggggtctatgttgattttaggtgtacatgctccttgtctcctctgacttttttttttttttttgagacggagtctctctctgtcacctaggctggagcgtagtggtgcgatctgggctcactgcaacctctgcctccagggttcaagcgattctcctgccttagcctcctgagtagctgggattacaggcgcgcaccaccacgcccggctaatttttgtatttttagtagagacagggtttcaccatgttggtcaggctggtctcgaactcctgacctcgtga

SEQ ID NO: 35847 - DNA, 601 bp, Human
cactatgtaagacaaaggctggtgctggaactctggggttctcccaggctcttacctgtgggcatgttggtgaagggcccatagcaacagatttctagccccctgaagatctggaagaagagaggaagagagagggacaggggaatggagagaaggaaaatctagttataaaagaatattggcttttattcaaaaaacagactttcaaaaaggaagagcttttctttttcttctgttcaccacctgatgatttctgctgctacttcccagggacaagcagtccaatgtccagaacactacwggatttcagaagatcttcttgaagtgcatatgtagttgacctgcactctacaggcattctttgtcattcaaggactgagcatctcacttttgtcaccaatcaggccaaggctcctccctaatgatctctgcaggtgctttaacttgttagatgcaagggaaaaaaggtccttctgtatgtttaataagaggcttggatggctagaaactcaaagttattggctgaagtttgatgtttatccagacttggtacctcaagtactcactatgaccccatcaacagaggggtctatgttgattt

SEQ ID NO: 35848 - DNA, 601 bp, Human
catggagagggctgggcacagtggctcatgcctgtaatcctagcactttgggaggctgaggcgggtggatcacgaggtcaggagatcgggaccatattggctaacacggtgaaaccccgtctctactaaaaaaaaaatacaaaaaattagtcgggcgtggtggcacacgcctgtagtctcagctatttgggaggctgaggcaggagaatcacttgaacccgggaggtggaggttgcagtgagccgagatcgcgccattgcactctggcctgggcaacagagactcgacctcaaaaaaaaagaaaaaaaaaagaaatgttcaccgagaatcttcccctgctctgggcccgtccatggtgggccagctgctgtgctttcttctatgtaagtaaattaagatggtttaggaagaggagaactcctccttgatttttacctatccaaagatattttctcactaacatgttggcactaacagcagctcaacgccatctgaacacataacatactgaatcctaactattaaccaccttcatgctcttgagaagggggacaaggtatagtttttttttgccataggataacatttaggtgctgttttg

SEQ ID NO: 35849 - DNA, 601 bp, Human
tatagcagtcctaagcataacattgtattaagtgtcaagtttaattagaaaatgttcatggagagggctgggcacagtggctcatgcctgtaatcctagcactttgggaggctgaggcgggtggatcacgaggtcaggagatcgggaccatattggctaacacggtgaaaccccgtctctactaaaaaaaaaatacaaaaaattagtcgggcgtggtggcacacgcctgtagtctcagctatttgggaggctgaggcaggagaatcacttgaacccgggaggtggaggttgcagtgagccragatcgcgccattgcactctggcctgggcaacagagactcgacctcaaaaaaaaaaaaaaaaaaaagaaatgttcaccgagaatcttcccctgctctgggcccgtccatggtgggccagctgctgtgctttcttctatgtaagtaaattaagatggtttaggaagaggagaactcctccttgatttttacctatccaaagatattttctcactaacatgttggcactaacagcagctcaacgccatctgaacacataacatactgaatcctaactattaaccaccttcatgctcttgaga

SEQ ID NO: 35850 - DNA, 601 bp, Human
ccatgtactctggttatcagtctccataaggccacttggtataaggtttgatagtctctcaaataaaatgcttgaaagaaaaaaaaatcaaagatctaatttccattaatttgctaaattgctggctaagacactgtgtgaaaaaacacccaccttccttccctcccttcctcccttcatcctaattctgtgttggtaactgataatcacggccactgaaaataccatacttggtggtaattactgtaaatgtcaagagatgggaagataattcatccagtcaaaaaaatacatgttatcytggttagagactcagcagggaaaggctacatgctgagctggaatccatatactcaggggaataaaaatcagaagagactgtggagatgctgtgtacctggaaaatcagaactgcccaatgggctctgttggctgtgttcttcaagacattcatgtatgttgctctttcccatcagcccgtttctgggaattgctgaggtgctcctgtctgtctgactgaacgaaggttgactaactcacccccaaaataatactttctggcaaccctggtttccactataccaaagtaaaaaaacactga

SEQ ID NO: 35851 - DNA, 601 bp, Human
agacggggtttcgccatgttggttggccaggatggtctcgatctcttgacctcgtgatctgcccacctcagcctcccaaagtgctgggattacaggcgtgagccaccgcacctagcttttctctctctctctctttttttttttttagacaaagtctcactctgtcacccagtctggagtgcagtggtgcaatcttggctcactgcaacctctgcctcccacgttcaagcgatgctcacacctcaacttcccaaatagctggcattacaggcatgctccaccaggcctggctactttttgttttttttttttagtacagatggggtttcaccatgttggccaggctggtctcaaactcctgacaagtgatccacctgcctcggcctcccaaagtgctgggattacagacatgagccaccatgcccagcctccagcccatcatttcttgatgatttgttgaaacacagtatgctggggcagtcacagagaggagggggagggacatatgggaaaaagagttagagggaaaaagtcttccctcagtatatttaatatgtgcagttctcaaatccttacccatcccttacagatggagtctttt

SEQ ID NO: 35852 - DNA, 601 bp, Human
tgagacggagtctcgctctgtcgcccgggctggagtgcagtggcgcgatcttggctcactgcaacctccgcctccggggttcaagcgattctcctgccccagcccctcaagtagctgggactacaggcgtgcgcccctacgcccagctaatttttgtatttttagtagagacggggtttcgccatgttggttggccaggatggtctcgatctcttgacctcgtgatctgcccacctcagcctcccaaagtgctgggattacaggcgtgagccaccgcacctagcttttctctctctctctytttttttttttttagacaaagtctcactctgtcacccagtctggagtgcagtggtgcaatcttggctcactgcaacctctgcctcccacgttcaagcgatgctcacacctcaacttcccaaatagctggcattacaggcatgctccaccaggcctggctactttttgttttttttttttagtacagatggggtttcaccatgttggccaggctggtctcaaactcctgacaagtgatccacctgcctcggcctcccaaagtgctgggattacagacatgagccaccatgcccagcctcca

SEQ ID NO: 35853 - DNA, 601 bp, Human
ccatgaccggctaatttctgtatttttagtagagatggggtttcaccatgttggccaggctggtttcgaactcctgacctccagtgatctgcccaccttggcctcccaaagtgctgggattacaggcgtgagccaccatgcccaggtttcaagtttccttttcatttctaatacctgcctcagaatttcctccccaatgttccactccaacatttgagaactgcccaaggactattctgactttaagtcacataatcgatcccaagcactctccttccattgaagggtctgactctctgcmtttgtgaacacagggttttagagaagtaaacttagggaaaccagctattctcttgaggccaagccactctgtgcttccagccctaagccaacaacagcctgaatagaaagaatagggctgataaataatgaatcagcatcttgctcaattggtggcgtttaaatggttttaaaatcttctcaggtgaaaaattaccataattttgtgctcatggcagatttccaagggagacttcaagcagaaaatctttaagggacccttgcatagccagaagtccttttcaggctgatgtacataaaa

SEQ ID NO: 35854 - DNA, 601 bp, Human
ggtttcagcaacagggagcaaaggaaaaaaatcacctcaaagaaagcaacagcttccttcctggtgggatctgtcattttatagatatgaaatattcatgccagaggtcttatattttaagaggaatggattatataccagagctacaacaataaacattttacttattactaatgaggaattagaagactgtctttggaaaccggttcttgaaaatcttctgctgttttagaacacattctttagaaatctagcaaatatatctcagacttttagaaatctcttctagtttcattttcctttttttttttttttttgagccacagtctcactgtcacccaggctggagtgccgtggtatgatcttggctcactgcaacctccacctcccgggctgaagtgattctcctgccttagccacctgagtagctgggattacaggtgtccaccaccatgaccggctaatttctgtatttttagtagagatggggtttcaccatgttggccaggctggtttcgaactcctgacctccagtgatctgcccaccttggcctcccaaagtgctgggattacaggcgtgagccaccatgcccaggtttca

SEQ ID NO: 35855 - DNA, 601 bp, Human
acagttgagccacctcagacttctgaccttgcaacaatttgttttggcagcaacaggaaatacaaaaggtatttaagctgcctcaataaatcctaggaggtagatactatcattacccccattttacagagtgggagactgaagcacagtgaaaaggctctgagaaagtcggctggcctaagtctcaagaacagtcattcatggtggaagtgtttgctaccaagtttatttgcagtgttaacagcacaacatttacaaaacgtattttgtacaatcaagtcttcactgcccttgcacactrggggggctagggaagacctagtccttccaacagctataaacagtcctggataatgggtttatgaaaaacactttttcttccttcagcaagcaaaattatttatgaagctgtatggtttcagcaacagggagcaaaggaaaaaaatcacctcaaagaaagcaacagcttccttcctggtgggatctgtcattttatagatatgaaatattcatgccagaggtcttatattttaagaggaatggattatataccagagctacaacaataaacattttacttattactaatgaggaattagaa

SEQ ID NO: 35856 - DNA, 601 bp, Human; identical to SEQ ID NO: 35778

SEQ ID NO: 35857 - DNA, 601 bp, Human; identical to SEQ ID NO: 35779

SEQ ID NO: 35858 - DNA, 601 bp, Human; identical to SEQ ID NO: 35780

SEQ ID NO: 35859 - DNA, 601 bp, Human; identical to SEQ ID NO: 35781

SEQ ID NO: 35860 - DNA, 601 bp, Human; identical to SEQ ID NO: 35782

SEQ ID NO: 35861 - DNA, 601 bp, Human; identical to SEQ ID NO: 35783

SEQ ID NO: 35862 - DNA, 601 bp, Human; identical to SEQ ID NO: 35784

SEQ ID NO: 35863 - DNA, 601 bp, Human; identical to SEQ ID NO: 35785

SEQ ID NO: 35864 - DNA, 601 bp, Human; identical to SEQ ID NO: 35786

SEQ ID NO: 35865 - DNA, 601 bp, Human; identical to SEQ ID NO: 35787

SEQ ID NO: 35866 - DNA, 601 bp, Human; identical to SEQ ID NO: 35788

SEQ ID NO: 35867 - DNA, 601 bp, Human; identical to SEQ ID NO: 35789

SEQ ID NO: 35868 - DNA, 601 bp, Human; identical to SEQ ID NO: 35790

SEQ ID NO: 35869 - DNA, 601 bp, Human; identical to SEQ ID NO: 35791

SEQ ID NO: 35870 - DNA, 601 bp, Human; identical to SEQ ID NO: 35792

SEQ ID NO: 35871 - DNA, 601 bp, Human; identical to SEQ ID NO: 35793

SEQ ID NO: 35872 - DNA, 601 bp, Human; identical to SEQ ID NO: 35794

SEQ ID NO: 35873 - DNA, 601 bp, Human; identical to SEQ ID NO: 35795

SEQ ID NO: 35874 - DNA, 601 bp, Human; identical to SEQ ID NO: 35796

SEQ ID NO: 35875 - DNA, 601 bp, Human; identical to SEQ ID NO: 35797

SEQ ID NO: 35876 - DNA, 601 bp, Human; identical to SEQ ID NO: 35798

SEQ ID NO: 35877 - DNA, 601 bp, Human; identical to SEQ ID NO: 35799

SEQ ID NO: 35878 - DNA, 601 bp, Human; identical to SEQ ID NO: 35800

SEQ ID NO: 35879 - DNA, 601 bp, Human; identical to SEQ ID NO: 35801

SEQ ID NO: 35880 - DNA, 601 bp, Human; identical to SEQ ID NO: 35802

SEQ ID NO: 35881 - DNA, 601 bp, Human; identical to SEQ ID NO: 35803

SEQ ID NO: 35882 - DNA, 601 bp, Human; identical to SEQ ID NO: 35804

SEQ ID NO: 35883 - DNA, 601 bp, Human; identical to SEQ ID NO: 35805

SEQ ID NO: 35884 - DNA, 601 bp, Human; identical to SEQ ID NO: 35806

SEQ ID NO: 35885 - DNA, 601 bp, Human; identical to SEQ ID NO: 35807

SEQ ID NO: 35886 - DNA, 601 bp, Human; identical to SEQ ID NO: 35808

SEQ ID NO: 35887 - DNA, 601 bp, Human; identical to SEQ ID NO: 35809

SEQ ID NO: 35888 - DNA, 601 bp, Human; identical to SEQ ID NO: 35810

SEQ ID NO: 35889 - DNA, 601 bp, Human; identical to SEQ ID NO: 35811

SEQ ID NO: 35890 - DNA, 601 bp, Human; identical to SEQ ID NO: 35812

SEQ ID NO: 35891 - DNA, 601 bp, Human; identical to SEQ ID NO: 35813

SEQ ID NO: 35892 - DNA, 601 bp, Human; identical to SEQ ID NO: 35814

SEQ ID NO: 35893 - DNA, 601 bp, Human; identical to SEQ ID NO: 35815

SEQ ID NO: 35894 - DNA, 601 bp, Human; identical to SEQ ID NO: 35816

SEQ ID NO: 35895 - DNA, 601 bp, Human; identical to SEQ ID NO: 35817

SEQ ID NO: 35896 - DNA, 601 bp, Human; identical to SEQ ID NO: 35818

SEQ ID NO: 35897 - DNA, 601 bp, Human; identical to SEQ ID NO: 35819

SEQ ID NO: 35898 - DNA, 601 bp, Human; identical to SEQ ID NO: 35820

SEQ ID NO: 35899 - DNA, 601 bp, Human; identical to SEQ ID NO: 35821

SEQ ID NO: 35900 - DNA, 601 bp, Human; identical to SEQ ID NO: 35822

SEQ ID NO: 35901 - DNA, 601 bp, Human; identical to SEQ ID NO: 35823

SEQ ID NO: 35902 - DNA, 601 bp, Human; identical to SEQ ID NO: 35824

SEQ ID NO: 35903 - DNA, 601 bp, Human; identical to SEQ ID NO: 35825

SEQ ID NO: 35904 - DNA, 601 bp, Human; identical to SEQ ID NO: 35826

SEQ ID NO: 35905 - DNA, 601 bp, Human; identical to SEQ ID NO: 35827

SEQ ID NO: 35906 - DNA, 601 bp, Human; identical to SEQ ID NO: 35829

SEQ ID NO: 35907 - DNA, 601 bp, Human; identical to SEQ ID NO: 35830

SEQ ID NO: 35908 - DNA, 601 bp, Human; identical to SEQ ID NO: 35831

SEQ ID NO: 35909 - DNA, 601 bp, Human; identical to SEQ ID NO: 35832

SEQ ID NO: 35910 - DNA, 601 bp, Human; identical to SEQ ID NO: 35833

SEQ ID NO: 35911 - DNA, 601 bp, Human; identical to SEQ ID NO: 35834

SEQ ID NO: 35912 - DNA, 601 bp, Human; identical to SEQ ID NO: 35835

SEQ ID NO: 35913 - DNA, 601 bp, Human; identical to SEQ ID NO: 35836

SEQ ID NO: 35914 - DNA, 601 bp, Human; identical to SEQ ID NO: 35837

SEQ ID NO: 35915 - DNA, 601 bp, Human; identical to SEQ ID NO: 35838

SEQ ID NO: 35916 - DNA, 601 bp, Human; identical to SEQ ID NO: 35839

SEQ ID NO: 35917 - DNA, 601 bp, Human; identical to SEQ ID NO: 35840

SEQ ID NO: 35918 - DNA, 601 bp, Human; identical to SEQ ID NO: 35841

SEQ ID NO: 35919 - DNA, 601 bp, Human; identical to SEQ ID NO: 35842

SEQ ID NO: 35920 - DNA, 601 bp, Human; identical to SEQ ID NO: 35843

SEQ ID NO: 35921 - DNA, 601 bp, Human; identical to SEQ ID NO: 35844

SEQ ID NO: 35922 - DNA, 601 bp, Human; identical to SEQ ID NO: 35845

SEQ ID NO: 35923 - DNA, 601 bp, Human; identical to SEQ ID NO: 35846

SEQ ID NO: 35924 - DNA, 601 bp, Human; identical to SEQ ID NO: 35847

SEQ ID NO: 35925 - DNA, 601 bp, Human; identical to SEQ ID NO: 35848

SEQ ID NO: 35926 - DNA, 601 bp, Human; identical to SEQ ID NO: 35849

SEQ ID NO: 35927 - DNA, 601 bp, Human; identical to SEQ ID NO: 35850

SEQ ID NO: 35928 - DNA, 601 bp, Human; identical to SEQ ID NO: 35851

SEQ ID NO: 35929 - DNA, 601 bp, Human; identical to SEQ ID NO: 35852

SEQ ID NO: 35930 - DNA, 601 bp, Human; identical to SEQ ID NO: 35853

SEQ ID NO: 35931 - DNA, 601 bp, Human; identical to SEQ ID NO: 35854

SEQ ID NO: 35932 - DNA, 601 bp, Human; identical to SEQ ID NO: 35855

SEQ ID NO: 35933 - DNA, 601 bp, Human; identical to SEQ ID NO: 35778

SEQ ID NO: 35934 - DNA, 601 bp, Human; identical to SEQ ID NO: 35779

SEQ ID NO: 35935 - DNA, 601 bp, Human; identical to SEQ ID NO: 35780

SEQ ID NO: 35936 - DNA, 601 bp, Human; identical to SEQ ID NO: 35781

SEQ ID NO: 35937 - DNA, 601 bp, Human; identical to SEQ ID NO: 35782

SEQ ID NO: 35938 - DNA, 601 bp, Human; identical to SEQ ID NO: 35783

SEQ ID NO: 35939 - DNA, 601 bp, Human; identical to SEQ ID NO: 35784

SEQ ID NO: 35940 - DNA, 601 bp, Human; identical to SEQ ID NO: 35785

SEQ ID NO: 35941 - DNA, 601 bp, Human; identical to SEQ ID NO: 35786

SEQ ID NO: 35942 - DNA, 601 bp, Human; identical to SEQ ID NO: 35787

SEQ ID NO: 35943 - DNA, 601 bp, Human; identical to SEQ ID NO: 35788

SEQ ID NO: 35944 - DNA, 601 bp, Human; identical to SEQ ID NO: 35789

SEQ ID NO: 35945 - DNA, 601 bp, Human; identical to SEQ ID NO: 35790

SEQ ID NO: 35946 - DNA, 601 bp, Human; identical to SEQ ID NO: 35791

SEQ ID NO: 35947 - DNA, 601 bp, Human; identical to SEQ ID NO: 35792

SEQ ID NO: 35948 - DNA, 601 bp, Human; identical to SEQ ID NO: 35793

SEQ ID NO: 35949 - DNA, 601 bp, Human; identical to SEQ ID NO: 35794

SEQ ID NO: 35950 - DNA, 601 bp, Human; identical to SEQ ID NO: 35795

SEQ ID NO: 35951 - DNA, 601 bp, Human; identical to SEQ ID NO: 35796

SEQ ID NO: 35952 - DNA, 601 bp, Human; identical to SEQ ID NO: 35797

SEQ ID NO: 35953 - DNA, 601 bp, Human; identical to SEQ ID NO: 35798

SEQ ID NO: 35954 - DNA, 601 bp, Human; identical to SEQ ID NO: 35799

SEQ ID NO: 35955 - DNA, 601 bp, Human; identical to SEQ ID NO: 35800

SEQ ID NO: 35956 - DNA, 601 bp, Human; identical to SEQ ID NO: 35801

SEQ ID NO: 35957 - DNA, 601 bp, Human; identical to SEQ ID NO: 35802

SEQ ID NO: 35958 - DNA, 601 bp, Human; identical to SEQ ID NO: 35803

SEQ ID NO: 35959 - DNA, 601 bp, Human; identical to SEQ ID NO: 35804

SEQ ID NO: 35960 - DNA, 601 bp, Human; identical to SEQ ID NO: 35805

SEQ ID NO: 35961 - DNA, 601 bp, Human; identical to SEQ ID NO: 35806

SEQ ID NO: 35962 - DNA, 601 bp, Human; identical to SEQ ID NO: 35807

SEQ ID NO: 35963 - DNA, 601 bp, Human; identical to SEQ ID NO: 35808

SEQ ID NO: 35964 - DNA, 601 bp, Human; identical to SEQ ID NO: 35809

SEQ ID NO: 35965 - DNA, 601 bp, Human; identical to SEQ ID NO: 35810

SEQ ID NO: 35966 - DNA, 601 bp, Human; identical to SEQ ID NO: 35811

SEQ ID NO: 35967 - DNA, 601 bp, Human; identical to SEQ ID NO: 35812

SEQ ID NO: 35968 - DNA, 601 bp, Human; identical to SEQ ID NO: 35813

SEQ ID NO: 35969 - DNA, 601 bp, Human; identical to SEQ ID NO: 35814

SEQ ID NO: 35970 - DNA, 601 bp, Human; identical to SEQ ID NO: 35815

SEQ ID NO: 35971 - DNA, 601 bp, Human; identical to SEQ ID NO: 35816

SEQ ID NO: 35972 - DNA, 601 bp, Human; identical to SEQ ID NO: 35817

SEQ ID NO: 35973 - DNA, 601 bp, Human; identical to SEQ ID NO: 35818

SEQ ID NO: 35974 - DNA, 601 bp, Human; identical to SEQ ID NO: 35819

SEQ ID NO: 35975 - DNA, 601 bp, Human; identical to SEQ ID NO: 35820

SEQ ID NO: 35976 - DNA, 601 bp, Human; identical to SEQ ID NO: 35821

SEQ ID NO: 35977 - DNA, 601 bp, Human; identical to SEQ ID NO: 35822

SEQ ID NO: 35978 - DNA, 601 bp, Human; identical to SEQ ID NO: 35823

SEQ ID NO: 35979 - DNA, 601 bp, Human; identical to SEQ ID NO: 35824

SEQ ID NO: 35980 - DNA, 601 bp, Human; identical to SEQ ID NO: 35825

SEQ ID NO: 35981 - DNA, 601 bp, Human; identical to SEQ ID NO: 35826

SEQ ID NO: 35982 - DNA, 601 bp, Human; identical to SEQ ID NO: 35827

SEQ ID NO: 35983 - DNA, 601 bp, Human
cctataaatcagaagcacattaaataggtctttgtgatgtgacaccagtgttataaggaatatgtctgagtactttttcatagctttctgaaattatggggttgcctgtcaccaatttctcccattccacttagcttccaatagagcaagagctatgttgtataccatgtatcttccatgggctccccatagcatctacttgttgtaggtactcagatgacaacatgaatgactgccttgggtccctctgactggtatattagttgtgagcagggacaagaaccaaggctccataattacycatgtgctgagcaaggatcataaaatgttggagctaggtccttactcttcagaaggagataaaggggaaggaaagaattttgcttaagatatcagtgtttggccaacaatacacacctttttctgatgtgctttgttctggatttcgcaggtcctcaagggcagaagagtcacttatgatggaagggtagctgttagaaggctggctcccatgctgttctaacacagcttctagttcagccatttcctgctggagctttatcaggttatgttgcatggtatccctctgcttcaaaaacga

SEQ ID NO: 35984 - DNA, 601 bp, Human
taaacactctaagagccaagacagcttcctgaaacgcgtgaaggaaaatgatcagaaaaagaaagaagccaaagagaaaggtacgtgggttcaactgaagcaccagcctgctccacccagagaagcacactttgtgagaaccaatgggaaggagcctgagcagctggaacctattccctatgaattcatggcataataggtgttaaaaaaaaaaaaaaaagacctttggactgtaaaaaaaaagaaaagtcattctatcaccagaacatttagcatataaattcctcttcttactacaatrggcctcatgcaatgaagcaaataagataacttgttagaagttaacaactcaatagaacctgaaaaacagagcaaaacctttctgcttttttttctccttaatccttaattcattctctgaacagcaagcccaacctaagccttgtgacatgatgatctacttgctggctggtttaggaaagtctaaatgcagagatccagagtccaagtttcagaatattattgtagttcctcttaaatcattccctcatctagatgtcttaacatgttacattctttgtggataggaagtatgggccac

SEQ ID NO: 35985 - DNA, 601 bp, Human
tggccatgtatatgcgaatctgtaagaaaggtgaaattgtagacatcaagggaacgggtactgttcaaaaaggaatgccccacaagtgttaccatggcaaaactggaaaagtctacaacgtgacccagcatgctgttggcatcgctgtaaacaagttaagggcaagattcttgccaagagaattaatgtgcgtattgagcacattaaacactctaagagccaagacagcttcctgaaacgcgtgaaggaaaatgatcagaaaaagaaagaagccaaagagaaaggtacgtgggttcaactsaagcaccagcctgctccacccagagaagcacactttgtgagaaccaatgggaaggagcctgagcagctggaacctattccctatgaattcatggcataataggtgttaaaaaaaaaaaaaaaagacctttggactgtaaaaaaaaagaaaagtcattctatcaccagaacatttagcatataaattcctcttcttactacaatgggcctcatgcaatgaagcaaataagataacttgttagaagttaacaactcaatagaacctgaaaaacagagcaaaacctttctgcttttttttctc

SEQ ID NO: 35986 - DNA, 601 bp, Human
caaaaaaaatgaaaggcagagggaaggctcagatacaaacacagctattaaaaagtcattcctccttttggccagaaccaccatctttcagtaatttgccaaaatgacgaacacaaagggaaagaggagaggcacctgatatatgttctctaggccttttagaaaacatggagttgttcctttggccatgtatatgcgaatctgtaagaaaggtgaaattgtagacatcaagggaacgggtactgttcaaaaaggaatgccccacaagtgttaccatggcaaaactggaaaagtctacaaygtgacccagcatgctgttggcatcgctgtaaacaagttaagggcaagattcttgccaagagaattaatgtgcgtattgagcacattaaacactctaagagccaagacagcttcctgaaacgcgtgaaggaaaatgatcagaaaaagaaagaagccaaagagaaaggtacgtgggttcaactgaagcaccagcctgctccacccagagaagcacactttgtgagaaccaatgggaaggagcctgagcagctggaacctattccctatgaattcatggcataataggtgttaaaaaaaaaaa

SEQ ID NO: 35987 - DNA, 601 bp, Human
agagttaaaaaagtggccaggtgatgtggctcacgcctacaatcccagcactttgagaggccgaggtgggcagatcacctgaggtcaggagtttgagaccagcccggccaacatggtgaaaccctgtctctactaaaaatacaaaaattagctgggcgtggtggcgggtgcctgtaatcccagctacccaggaggctgaggcggacattgtaatgagccgaaatcacaccattgcactccagcctgggcaacaaaagtgaaacttcatctcaaacaaaaacaaaacaaaacaaaacaaaamaaatgaaaggcagagggaaggctcagatacaaacacagctattaaaaagtcattcctccttttggccagaaccaccatctttcagtaatttgccaaaatgacgaacacaaagggaaagaggagaggcacctgatatatgttctctaggccttttagaaaacatggagttgttcctttggccatgtatatgcgaatctgtaagaaaggtgaaattgtagacatcaagggaacgggtactgttcaaaaaggaatgccccacaagtgttaccatggcaaaactggaaaagtctacaacgtgac

SEQ ID NO: 35988 - DNA, 601 bp, Human
taatcattgatttcctgagttagtcttcaaatgcattatttatagtttcctttatgcttgtcttttctggacctgtgagtttctaggattgttaagaactctgttgaaagtaagtaggatctaactatgaagagaggtatcatcctccccacccccaatacagggtgataattgataaagggtaatgtgcaagttccaaggaaccatatcaaacggaattaaccattggaaagagttaaaaaagtggccaggtgatgtggctcacgcctacaatcccagcactttgagaggccgaggtggrcagatcacctgaggtcaggagtttgagaccagcccggccaacatggtgaaaccctgtctctactaaaaatacaaaaattagctgggcgtggtggcgggtgcctgtaatcccagctacccaggaggctgaggcggacattgtaatgagccgaaatcacaccattgcactccagcctgggcaacaaaagtgaaacttcatctcaaacaaaaacaaaacaaaacaaaacaaaaaaaatgaaaggcagagggaaggctcagatacaaacacagctattaaaaagtcattcctccttttggccag

SEQ ID NO: 35989 - DNA, 601 bp, Human
tcaggctagtctcgaactcctgacctcaagtgatccacccgccttggcctcccaaagtgcggggattacagacatgagccactgcgcccagcctaattcattttgtaatatatttactcctccaaatgtatcactttgtgccactgccttctaggaagtggcttaaaggcagaagtacttatttatttatttttatttatttattttttttgagatggagttttgctcttgttgcccaggctgcagtgcaatggcgtgatcttggctcaccacaacctctctgcctcccaggttcaagctrttctcctgcctcagcctcccaagtagttgggattacaggtatgcaccaccacgcccaactaattttgtatttttagtagagatggggtttctccatgttggtcacgctggtctcgaactcccgacctcaggtgatctgcctgcctcggcctcccaaagtgatgggattacaggcgtgagccactgcgcccgaccgttatttttcaacgagatgggtgtcttgctgtgttgaccaggctggtttcaaactttttttttttttgagacagagtcttgctctgttacccaggctggaatacag

SEQ ID NO: 35990 - DNA, 601 bp, Human
agtttttttggtatttttagtagagatgggattttaccctgttgatcaggctagtctcgaactcctgacctcaagtgatccacccgccttggcctcccaaagtgcggggattacagacatgagccactgcgcccagcctaattcattttgtaatatatttactcctccaaatgtatcactttgtgccactgccttctaggaagtggcttaaaggcagaagtacttatttatttatttttatttatttattttttttgagatggagttttgctcttgttgcccaggctgcagtgcaatggcrtgatcttggctcaccacaacctctctgcctcccaggttcaagctattctcctgcctcagcctcccaagtagttgggattacaggtatgcaccaccacgcccaactaattttgtatttttagtagagatggggtttctccatgttggtcacgctggtctcgaactcccgacctcaggtgatctgcctgcctcggcctcccaaagtgatgggattacaggcgtgagccactgcgcccgaccgttatttttcaacgagatgggtgtcttgctgtgttgaccaggctggtttcaaacttttttt

SEQ ID NO: 35991 - DNA, 601 bp, Human
tagtagctgacattacaggtgcctgccaccacgcccagctagtttttttggtatttttagtagagatgggattttaccctgttgatcaggctagtctcgaactcctgacctcaagtgatccacccgccttggcctcccaaagtgcggggattacagacatgagccactgcgcccagcctaattcattttgtaatatatttactcctccaaatgtatcactttgtgccactgccttctaggaagtggcttaaaggcagaagtacttatttatttatttttatttatttattttttttgagayggagttttgctcttgttgcccaggctgcagtgcaatggcgtgatcttggctcaccacaacctctctgcctcccaggttcaagctattctcctgcctcagcctcccaagtagttgggattacaggtatgcaccaccacgcccaactaattttgtatttttagtagagatggggtttctccatgttggtcacgctggtctcgaactcccgacctcaggtgatctgcctgcctcggcctcccaaagtgatgggattacaggcgtgagccactgcgcccgaccgttatttttcaacgagatggg

SEQ ID NO: 35992 - DNA, 601 bp, Human; identical to SEQ ID NO: 35828

SEQ ID NO: 35993 - DNA, 601 bp, Human; identical to SEQ ID NO: 35829

SEQ ID NO: 35994 - DNA, 601 bp, Human; identical to SEQ ID NO: 35830

SEQ ID NO: 35995 - DNA, 601 bp, Human; identical to SEQ ID NO: 35831

SEQ ID NO: 35996 - DNA, 601 bp, Human; identical to SEQ ID NO: 35832

SEQ ID NO: 35997 - DNA, 601 bp, Human; identical to SEQ ID NO: 35833

SEQ ID NO: 35998 - DNA, 601 bp, Human; identical to SEQ ID NO: 35834

SEQ ID NO: 35999 - DNA, 601 bp, Human; identical to SEQ ID NO: 35835

SEQ ID NO: 36000 - DNA, 601 bp, Human; identical to SEQ ID NO: 35836

SEQ ID NO: 36001 - DNA, 601 bp, Human; identical to SEQ ID NO: 35837

SEQ ID NO: 36002 - DNA, 601 bp, Human; identical to SEQ ID NO: 35838

SEQ ID NO: 36003 - DNA, 601 bp, Human; identical to SEQ ID NO: 35839

SEQ ID NO: 36004 - DNA, 601 bp, Human; identical to SEQ ID NO: 35840

SEQ ID NO: 36005 - DNA, 601 bp, Human; identical to SEQ ID NO: 35841

SEQ ID NO: 36006 - DNA, 601 bp, Human; identical to SEQ ID NO: 35842

SEQ ID NO: 36007 - DNA, 601 bp, Human; identical to SEQ ID NO: 35843

SEQ ID NO: 36008 - DNA, 601 bp, Human; identical to SEQ ID NO: 35844

SEQ ID NO: 36009 - DNA, 601 bp, Human; identical to SEQ ID NO: 35845

SEQ ID NO: 36010 - DNA, 601 bp, Human; identical to SEQ ID NO: 35846

SEQ ID NO: 36011 - DNA, 601 bp, Human; identical to SEQ ID NO: 35847

SEQ ID NO: 36012 - DNA, 601 bp, Human; identical to SEQ ID NO: 35848

SEQ ID NO: 36013 - DNA, 601 bp, Human; identical to SEQ ID NO: 35849

SEQ ID NO: 36014 - DNA, 601 bp, Human; identical to SEQ ID NO: 35850

SEQ ID NO: 36015 - DNA, 601 bp, Human; identical to SEQ ID NO: 35851

SEQ ID NO: 36016 - DNA, 601 bp, Human; identical to SEQ ID NO: 35852

SEQ ID NO: 36017 - DNA, 601 bp, Human; identical to SEQ ID NO: 35853

SEQ ID NO: 36018 - DNA, 601 bp, Human; identical to SEQ ID NO: 35854

SEQ ID NO: 36019 - DNA, 601 bp, Human; identical to SEQ ID NO: 35855

SEQ ID NO: 36020 - DNA, 601 bp, Human; identical to SEQ ID NO: 35778

SEQ ID NO: 36021 - DNA, 601 bp, Human; identical to SEQ ID NO: 35779

SEQ ID NO: 36022 - DNA, 601 bp, Human; identical to SEQ ID NO: 35780

SEQ ID NO: 36023 - DNA, 601 bp, Human; identical to SEQ ID NO: 35781

SEQ ID NO: 36024 - DNA, 601 bp, Human; identical to SEQ ID NO: 35782

SEQ ID NO: 36025 - DNA, 601 bp, Human; identical to SEQ ID NO: 35783

SEQ ID NO: 36026 - DNA, 601 bp, Human; identical to SEQ ID NO: 35784

SEQ ID NO: 36027 - DNA, 601 bp, Human; identical to SEQ ID NO: 35785

SEQ ID NO: 36028 - DNA, 601 bp, Human; identical to SEQ ID NO: 35786

SEQ ID NO: 36029 - DNA, 601 bp, Human; identical to SEQ ID NO: 35787

SEQ ID NO: 36030 - DNA, 601 bp, Human; identical to SEQ ID NO: 35788

SEQ ID NO: 36031 - DNA, 601 bp, Human; identical to SEQ ID NO: 35789

SEQ ID NO: 36032 - DNA, 601 bp, Human; identical to SEQ ID NO: 35790

SEQ ID NO: 36033 - DNA, 601 bp, Human; identical to SEQ ID NO: 35791

SEQ ID NO: 36034 - DNA, 601 bp, Human; identical to SEQ ID NO: 35792

SEQ ID NO: 36035 - DNA, 601 bp, Human; identical to SEQ ID NO: 35793

SEQ ID NO: 36036 - DNA, 601 bp, Human; identical to SEQ ID NO: 35794

SEQ ID NO: 36037 - DNA, 601 bp, Human; identical to SEQ ID NO: 35795

SEQ ID NO: 36038 - DNA, 601 bp, Human; identical to SEQ ID NO: 35796

SEQ ID NO: 36039 - DNA, 601 bp, Human; identical to SEQ ID NO: 35797

SEQ ID NO: 36040 - DNA, 601 bp, Human; identical to SEQ ID NO: 35798

SEQ ID NO: 36041 - DNA, 601 bp, Human; identical to SEQ ID NO: 35799

SEQ ID NO: 36042 - DNA, 601 bp, Human; identical to SEQ ID NO: 35800

SEQ ID NO: 36043 - DNA, 601 bp, Human; identical to SEQ ID NO: 35801

SEQ ID NO: 36044 - DNA, 601 bp, Human; identical to SEQ ID NO: 35802

SEQ ID NO: 36045 - DNA, 601 bp, Human; identical to SEQ ID NO: 35803

SEQ ID NO: 36046 - DNA, 601 bp, Human; identical to SEQ ID NO: 35804

SEQ ID NO: 36047 - DNA, 601 bp, Human; identical to SEQ ID NO: 35805

SEQ ID NO: 36048 - DNA, 601 bp, Human; identical to SEQ ID NO: 35806

SEQ ID NO: 36049 - DNA, 601 bp, Human; identical to SEQ ID NO: 35807

SEQ ID NO: 36050 - DNA, 601 bp, Human; identical to SEQ ID NO: 35808

SEQ ID NO: 36051 - DNA, 601 bp, Human; identical to SEQ ID NO: 35809

SEQ ID NO: 36052 - DNA, 601 bp, Human; identical to SEQ ID NO: 35810

SEQ ID NO: 36053 - DNA, 601 bp, Human; identical to SEQ ID NO: 35811

SEQ ID NO: 36054 - DNA, 601 bp, Human; identical to SEQ ID NO: 35812

SEQ ID NO: 36055 - DNA, 601 bp, Human; identical to SEQ ID NO: 35813

SEQ ID NO: 36056 - DNA, 601 bp, Human; identical to SEQ ID NO: 35814

SEQ ID NO: 36057 - DNA, 601 bp, Human; identical to SEQ ID NO: 35815

SEQ ID NO: 36058 - DNA, 601 bp, Human; identical to SEQ ID NO: 35816

SEQ ID NO: 36059 - DNA, 601 bp, Human; identical to SEQ ID NO: 35817

SEQ ID NO: 36060 - DNA, 601 bp, Human; identical to SEQ ID NO: 35818

SEQ ID NO: 36061 - DNA, 601 bp, Human; identical to SEQ ID NO: 35819

SEQ ID NO: 36062 - DNA, 601 bp, Human; identical to SEQ ID NO: 35820

SEQ ID NO: 36063 - DNA, 601 bp, Human; identical to SEQ ID NO: 35821

SEQ ID NO: 36064 - DNA, 601 bp, Human; identical to SEQ ID NO: 35822

SEQ ID NO: 36065 - DNA, 601 bp, Human; identical to SEQ ID NO: 35823

SEQ ID NO: 36066 - DNA, 601 bp, Human; identical to SEQ ID NO: 35824

SEQ ID NO: 36067 - DNA, 601 bp, Human; identical to SEQ ID NO: 35825

SEQ ID NO: 36068 - DNA, 601 bp, Human; identical to SEQ ID NO: 35826

SEQ ID NO: 36069 - DNA, 601 bp, Human; identical to SEQ ID NO: 35827

SEQ ID NO: 36070 - DNA, 601 bp, Human; identical to SEQ ID NO: 35983

SEQ ID NO: 36071 - DNA, 601 bp, Human; identical to SEQ ID NO: 35984

SEQ ID NO: 36072 - DNA, 601 bp, Human; identical to SEQ ID NO: 35985

SEQ ID NO: 36073 - DNA, 601 bp, Human; identical to SEQ ID NO: 35986

SEQ ID NO: 36074 - DNA, 601 bp, Human; identical to SEQ ID NO: 35987

SEQ ID NO: 36075 - DNA, 601 bp, Human; identical to SEQ ID NO: 35988

SEQ ID NO: 36076 - DNA, 601 bp, Human; identical to SEQ ID NO: 35989

SEQ ID NO: 36077 - DNA, 601 bp, Human; identical to SEQ ID NO: 35990

SEQ ID NO: 36078 - DNA, 601 bp, Human; identical to SEQ ID NO: 35991

SEQ ID NO: 36079 - DNA, 601 bp, Human
gtgtaaatacacatctctgaaagatattctaaatgttttctggctttgggagggcaaggcgggcggactacttgagtccaggaatttgagaccagcctgggcaacaaggtaaaactccatctctaccaaaaatacaaaaacttagtgggtgtgggtggcgcatgcttgtggacccagctactcaggaggctaaggtgggaggattgcttgagcctgaaaaacggaggatgcagtgagccatgactgcaccactgcaatctaggtgacacagggcgaccctgtctcaaaaaataataataayagtaattattattattattttctgtggtaaatcaacagctagactttttctagaaagacaagaattttaattagggcaagggctgccttgaagaagtctaccatcagtttccaagcttgttcaggttttacctccattatatttttttctgaccttcagaagggacatatctatctaaccgcacatttctcatgttgtagcttatgttataggttcaaaaaacctatataggattaaacaaaagaagtatcctagagcaataaaagtgtataaatgcctgtatgcaaaaaactggagaaa

SEQ ID NO: 36080 - DNA, 601 bp, Human
tttccgtcaaatcgtgtggcccagactcttccagctgttgctcctccacatcaacaaccttaatgagctcctcttgagatgggtagtttctattctgaagactcccagagcaactgtgcatgtaccacctatcatctaatgatgggcatttagaaggggatgacctagaaagataaatggaaggagaaaaccatcgccaccaattgtgaaaggacaaatcatacttgctgggcagccaaagcataaatgaaacagctcatgtcagagagatcagaaatgactggcaaaaaagagcccgcawgacagcctagaagtctggattcatgttgcctgccaatatgtcagggttgacatataacatggggttgggttggtctgaggcaccatatctcccagctgtttaaaagcaggtcagtagctgggtgtggtggctggcgcctgtaatctcagctactcgggaggctgaggcaggaaaattgcttgaacctgggagacagaggttgcagtgagccgagatcacgccactgcactccagcctgagtgacagagcaagactctgtcaagaaagaaaggaaaggaaagaaaggaaagaaaaggaaag

SEQ ID NO: 36081 - DNA, 601 bp, Human
agagtaaaatcaaagtgtttgttccaatacagcagatgaaatattacctagatcttgccttggcaagtaagatgtttccgtcaaatcgtgtggcccagactcttccagctgttgctcctccacatcaacaaccttaatgagctcctcttgagatgggtagtttctattctgaagactcccagagcaactgtgcatgtaccacctatcatctaatgatgggcatttagaaggggatgacctagaaagataaatggaaggagaaaaccatcgccaccaattgtgaaaggacaaatcatacttsctgggcagccaaagcataaatgaaacagctcatgtcagagagatcagaaatgactggcaaaaaagagcccgcatgacagcctagaagtctggattcatgttgcctgccaatatgtcagggttgacatataacatggggttgggttggtctgaggcaccatatctcccagctgtttaaaagcaggtcagtagctgggtgtggtggctggcgcctgtaatctcagctactcgggaggctgaggcaggaaaattgcttgaacctgggagacagaggttgcagtgagccgagatcacgccactg

SEQ ID NO: 36082 - DNA, 601 bp, Human
caggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcataggtatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggctaacacagt

SEQ ID NO: 36083 - DNA, 601 bp, Human
ccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcatagtaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggctaacacag

SEQ ID NO: 36084 - DNA, 601 bp, Human
tccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcatatgaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggctaacaca

SEQ ID NO: 36085 - DNA, 601 bp, Human
ttccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggctaacac

SEQ ID NO: 36086 - DNA, 601 bp, Human
attccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcagaggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggctaaca

SEQ ID NO: 36087 - DNA, 601 bp, Human
cagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggcta

SEQ ID NO: 36088 - DNA, 601 bp, Human
ccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttattcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggct

SEQ ID NO: 36089 - DNA, 601 bp, Human
tccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggc

SEQ ID NO: 36090 - DNA, 601 bp, Human
ttccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggttaagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctgg

SEQ ID NO: 36091 - DNA, 601 bp, Human
attccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtgtagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctg

SEQ ID NO: 36092 - DNA, 601 bp, Human
gattccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcct

SEQ ID NO: 36093 - DNA, 601 bp, Human
agaaattagtaatcgaaattaaattacacagaactgtgattgttttctagatttcttcctctaggttattaattgacaatacctacataaaactctttccagaatgttgttaagtcttagtcattagggagatacatatggatacactcacaaattcttctggggtcaggccagacaccaccatggacattcttttgttgaccctttctgttgaagctgtcaattctggcttctccctgctcacactttcttccattgcattatacccagcagtatcagtagtatgagcagcagctggacyctgggcagattctgcaactttcaattggggaactttcaatgcagaggttgaagatggtatgttgccaacacgagctgactctggggctctgtcttcagaaggatcagattcagggtcatcagagaagaggctgattccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaat

SEQ ID NO: 36094 - DNA, 601 bp, Human
aggacccaaggtgatgccaaaatcctaatagcaagggatattgcagggcagaagtggcagggcattcttacaagccaggatgaaaacaaacactagagaaatgctactatctggcagtacatttggaaccagtctgaatttagttaaatatgctggtaaattcacccatgtgagacaagggggagaaaaagatgccttctggggaataaaactatacctacttgcttttacagatagaaaggaaaattccaattcgaaagtcctatatcatacccaaagtatagcttttccactaatattyaataattattttctcaagtaaatatacataaaataatccacactatagctttatctagatctaaattttcagaaattagtaatcgaaattaaattacacagaactgtgattgttttctagatttcttcctctaggttattaattgacaatacctacataaaactctttccagaatgttgttaagtcttagtcattagggagatacatatggatacactcacaaattcttctggggtcaggccagacaccaccatggacattcttttgttgaccctttctgttgaagctgtcaattctggc

SEQ ID NO: 36095 - DNA, 601 bp, Human
ctggtcttgatctcctgaccttaggtgatctgaccacctcagcctcccaaagtgctgggattacaggcttgagccaccatgcccggccatgcaattatttttattatgaagtgatgacaatgacaattaattacaggggtggtaaacttctcaggatgtctgaaatccacaaatagcccaagcagaaacgaggttttactggtcttaatattttaatgggtatttttccacagtatgaagcaattcccatttctggcattaaggacccaaggtgatgccaaaatcctaatagcaagggatrttgcagggcagaagtggcagggcattcttacaagccaggatgaaaacaaacactagagaaatgctactatctggcagtacatttggaaccagtctgaatttagttaaatatgctggtaaattcacccatgtgagacaagggggagaaaaagatgccttctggggaataaaactatacctacttgcttttacagatagaaaggaaaattccaattcgaaagtcctatatcatacccaaagtatagcttttccactaatatttaataattattttctcaagtaaatatacataaaataatcc

SEQ ID NO: 36096 - DNA, 601 bp, Human
gctggtcttgatctcctgaccttaggtgatctgaccacctcagcctcccaaagtgctgggattacaggcttgagccaccatgcccggccatgcaattatttttattatgaagtgatgacaatgacaattaattacaggggtggtaaacttctcaggatgtctgaaatccacaaatagcccaagcagaaacgaggttttactggtcttaatattttaatgggtatttttccacagtatgaagcaattcccatttctggcattaaggacccaaggtgatgccaaaatcctaatagcaagggawattgcagggcagaagtggcagggcattcttacaagccaggatgaaaacaaacactagagaaatgctactatctggcagtacatttggaaccagtctgaatttagttaaatatgctggtaaattcacccatgtgagacaagggggagaaaaagatgccttctggggaataaaactatacctacttgcttttacagatagaaaggaaaattccaattcgaaagtcctatatcatacccaaagtatagcttttccactaatatttaataattattttctcaagtaaatatacataaaataatc

SEQ ID NO: 36097 - DNA, 601 bp, Human
aaaaaaatagaataccagttatcctagctttaagtctctgtttttctcagaaagggtacatttaaaaaattctaagacacctgaagtctcggctgggcgcggtggctcacgcctgtaatctcagcactttgggaggctgaggcgggcagatcacaaggtcaggagatcgagaccatcctggctaacacggtgaaaccctgtctctactaaaaatacaaaaaattagccaggcgtggtggcgggcacctgtagtctcagctactcaggaggctgaggcaggagaatggcgtgaacccaggargcagagcttgcagtaagccgagatggcgccactgcactctagcctgggcgagagtgcgagactccgtctcaaaaaaaaaaaaaagatacctgaagtctcaaataaatagtttaataaaaattatgtacacatcagcagacataaaattacaactaaggattcaaaataatattataaacctactacgtaccacaaaacttaaaacttaaaaaatatatactgggccagacacggcagctcatgcctataatcccagcactttgggaagctgaggtgggaggactgcttgagctcaagagt

SEQ ID NO: 36098 - DNA, 601 bp, Human
ctcgtgatctgcccgcctcggcctcccaaagtgctgcgattacaggcatgcgccaccgtgcctcgcctcatgtggttttatgcagcagatgcaaggtattctgtaaaggttcttggtatacctgttttcataacaacatgagtagtctcttcagtaattagattagttaaagtgatgtggtgttttctggcaaacttgtacacgagcatctgaaattaaatcaaatattccattatcatgagttacctctagcacacagctcagaatactagttattccaccatggcatatgtttacctaygtagcaatcctgcacgttctacacgtgtcctggaactatttaaagtgaatttttttttttttttttttagacagagtcttgctctgtcacccaggctggaggtaaaaaaaaaaaaaaaaaaaaaaaatagaataccagttatcctagctttaagtctctgtttttctcagaaagggtacatttaaaaaattctaagacacctgaagtctcggctgggcgcggtggctcacgcctgtaatctcagcactttgggaggctgaggcgggcagatcacaaggtcaggagatcgagaccatcctg

SEQ ID NO: 36099 - DNA, 601 bp, Human
ccaggatggtctcgatctcctaatctcgtgatctgcccgcctcggcctcccaaagtgctgcgattacaggcatgcgccaccgtgcctcgcctcatgtggttttatgcagcagatgcaaggtattctgtaaaggttcttggtatacctgttttcataacaacatgagtagtctcttcagtaattagattagttaaagtgatgtggtgttttctggcaaacttgtacacgagcatctgaaattaaatcaaatattccattatcatgagttacctctagcacacagctcagaatactagttatyccaccatggcatatgtttacctatgtagcaatcctgcacgttctacacgtgtcctggaactatttaaagtgaatttttttttttttttttttagacagagtcttgctctgtcacccaggctggaggtaaaaaaaaaaaaaaaaaaaaaaaatagaataccagttatcctagctttaagtctctgtttttctcagaaagggtacatttaaaaaattctaagacacctgaagtctcggctgggcgcggtggctcacgcctgtaatctcagcactttgggaggctgaggcgggcagatcacaa

SEQ ID NO: 36100 - DNA, 601 bp, Human
ttattttttcacgttttttttttttttttttgagacggagccttgctctgtcgccaggctggaatgcagtggcatgatctcggctcactgcaacctccatctccccggttcaagtgattctcctgcctcagcctcacgagtagctgggactacaggcgcacgcgaccacacccagctaatttttttattttttagtagagacggggtttcaccatgctggccaggatggtctcgatctcctaatctcgtgatctgcccgcctcggcctcccaaagtgctgcgattacaggcatgcgccacygtgcctcgcctcatgtggttttatgcagcagatgcaaggtattctgtaaaggttcttggtatacctgttttcataacaacatgagtagtctcttcagtaattagattagttaaagtgatgtggtgttttctggcaaacttgtacacgagcatctgaaattaaatcaaatattccattatcatgagttacctctagcacacagctcagaatactagttattccaccatggcatatgtttacctatgtagcaatcctgcacgttctacacgtgtcctggaactatttaaagtgaattttttt

SEQ ID NO: 36101 - DNA, 601 bp, Human
tatttgtctttcataaagtaattgattgactattagaagactatcatccatgctatgctcaacaaatattcttattttttcacgttttttttttttttttttgagacggagccttgctctgtcgccaggctggaatgcagtggcatgatctcggctcactgcaacctccatctccccggttcaagtgattctcctgcctcagcctcacgagtagctgggactacaggcgcacgcgaccacacccagctaatttttttattttttagtagagacggggtttcaccatgctggccaggatggkctcgatctcctaatctcgtgatctgcccgcctcggcctcccaaagtgctgcgattacaggcatgcgccaccgtgcctcgcctcatgtggttttatgcagcagatgcaaggtattctgtaaaggttcttggtatacctgttttcataacaacatgagtagtctcttcagtaattagattagttaaagtgatgtggtgttttctggcaaacttgtacacgagcatctgaaattaaatcaaatattccattatcatgagttacctctagcacacagctcagaatactagttattccaccatgg

SEQ ID NO: 36102 - DNA, 601 bp, Human
gccaggctggtctcgaactcctgacctcaggtgatccacccgcctcggcctcccaaagtgctgagattacaggtgtgagccaccgtgcctggcccacactccaaatcttaacccaaaacaaaaggaggtaaggaagcagcaaaactattatttgtctttcataaagtaattgattgactattagaagactatcatccatgctatgctcaacaaatattcttattttttcacgttttttttttttttttttgagacggagccttgctctgtcgccaggctggaatgcagtggcatgatctckgctcactgcaacctccatctccccggttcaagtgattctcctgcctcagcctcacgagtagctgggactacaggcgcacgcgaccacacccagctaatttttttattttttagtagagacggggtttcaccatgctggccaggatggtctcgatctcctaatctcgtgatctgcccgcctcggcctcccaaagtgctgcgattacaggcatgcgccaccgtgcctcgcctcatgtggttttatgcagcagatgcaaggtattctgtaaaggttcttggtatacctgttttcataacaaca

SEQ ID NO: 36103 - DNA, 601 bp, Human
caattcttctgtgtcagcctcccaagtagctgggattacaggcgcacaccaccacgcccagccaatttatgtatttttagtagagactgggttttaccatattggccaggctggtctcgaactcctgaccttgtgatctgcccgcctcaggctcccaaagtgctgggattactgatgcgagccaccgcgtccagctgcctcacttgttgttttaggacttaggctccacctcaccagtgtagtcccagcaggtagataggagttaatagttgactatctcagctcaccaccctccaaaccttttttttttttttttttttttgagacaagaatctcgctcttgtccccaggctggagtgcaatggtgcgatcttgggtcactgcaacctccacctcctgggttcaagcgattctgctgcctcagcctcctgagtagctgggattacaggtgcctgccaccacgcccacctaatttttatatttttagtagagacggggtttcaacacgttggccaggctggtctcgaactcctgacctcaggtgatccacccgcctcggcctcccaaagtgctgagattacaggtgtgagccaccgtgcct

SEQ ID NO: 36104 - DNA, 601 bp, Human
gagacagagtctcactctgtcgccaggctggagtgcagtggcaggatctcagctgactgcaacctcagcctccagagttcaagcaattcttctgtgtcagcctcccaagtagctgggattacaggcgcacaccaccacgcccagccaatttatgtatttttagtagagactgggttttaccatattggccaggctggtctcgaactcctgaccttgtgatctgcccgcctcaggctcccaaagtgctgggattactgatgcgagccaccgcgtccagctgcctcacttgttgttttaggayttaggctccacctcaccagtgtagtcccagcaggtagataggagttaatagttgactatctcagctcaccaccctccaaaccttttttttttttttttttttttgagacaagaatctcgctcttgtccccaggctggagtgcaatggtgcgatcttgggtcactgcaacctccacctcctgggttcaagcgattctgctgcctcagcctcctgagtagctgggattacaggtgcctgccaccacgcccacctaatttttatatttttagtagagacggggtttcaacacgttggccaggc

SEQ ID NO: 36105 - DNA, 601 bp, Human
tccaggttttgcctcacttgttctttcttttgttgttgttgagacagagtctcactctgtcgccaggctggagtgcagtggcaggatctcagctgactgcaacctcagcctccagagttcaagcaattcttctgtgtcagcctcccaagtagctgggattacaggcgcacaccaccacgcccagccaatttatgtatttttagtagagactgggttttaccatattggccaggctggtctcgaactcctgaccttgtgatctgcccgcctcaggctcccaaagtgctgggattactgatgygagccaccgcgtccagctgcctcacttgttgttttaggacttaggctccacctcaccagtgtagtcccagcaggtagataggagttaatagttgactatctcagctcaccaccctccaaaccttttttttttttttttttttttgagacaagaatctcgctcttgtccccaggctggagtgcaatggtgcgatcttgggtcactgcaacctccacctcctgggttcaagcgattctgctgcctcagcctcctgagtagctgggattacaggtgcctgccaccacgcccacctaattttta

SEQ ID NO: 36106 - DNA, 601 bp, Human
ggtataggacaaatgatctgtctcctcccttttttgctttttcatatgttaagactatctcagagctgttatcagacttttttcctgaaaaactctcaacaatactcaaactaggtgttacatgaagctggggtctccaggttttgcctcacttgttctttcttttgttgttgttgagacagagtctcactctgtcgccaggctggagtgcagtggcaggatctcagctgactgcaacctcagcctccagagttcaagcaattcttctgtgtcagcctcccaagtagctgggattacaggygcacaccaccacgcccagccaatttatgtatttttagtagagactgggttttaccatattggccaggctggtctcgaactcctgaccttgtgatctgcccgcctcaggctcccaaagtgctgggattactgatgcgagccaccgcgtccagctgcctcacttgttgttttaggacttaggctccacctcaccagtgtagtcccagcaggtagataggagttaatagttgactatctcagctcaccaccctccaaaccttttttttttttttttttttttgagacaagaatctcgctcttg

SEQ ID NO: 36107 - DNA, 601 bp, Human
agcacggtgcttaaaactgacatcatctttcaggcaatcactccattggagaatacagtggggctctggatctgtacttcacttgctccagagcctctgcttgtgttaatacggcccagtttcaaataagcatttttagcagccctgaaatgtgtactcagatttagtttatagtcaactaaaaacacccagaggtctcctgtattacacaagttataattaaaaccttaaaagagaaaggtataggacaaatgatctgtctcctcccttttttgctttttcatatgttaagactatctcrgagctgttatcagacttttttcctgaaaaactctcaacaatactcaaactaggtgttacatgaagctggggtctccaggttttgcctcacttgttctttcttttgttgttgttgagacagagtctcactctgtcgccaggctggagtgcagtggcaggatctcagctgactgcaacctcagcctccagagttcaagcaattcttctgtgtcagcctcccaagtagctgggattacaggcgcacaccaccacgcccagccaatttatgtatttttagtagagactgggttttaccatattg

SEQ ID NO: 36108 - DNA, 601 bp, Human
acctggctccaatgaacactaccctctgaccctgtggtataattttcatgagtaagtggaaacctaagatcttagaagttcaacggcaatgtgtccaaggggtttagatcctctccttaagtgcctgtatctctgtgaaaagaatcatcataggctaggcgcgatggctcacacctgtaatcccagcactttgggaggccgaggtaggtggatcacctgaggtcgggagtccaagaccagcctgactgacatggaaaaaccctgtctctactaaaaatacaaaattaggtatggtggtgcmttcctgtaatcccagctactcgggaggctgaggcaggagaatcgcttgaacccgggagggggaggttgcagcaagccaagatcgtgccattgcactccagcagcctgggcaacaagagtgaaaaactacacctcaaaaacaaaaacaaaaacaaaagaatcatcatcaagtgaactggaacacatccagagaactaattttgttagaaagattttagagttgagccacacaatctgcatcttctgcgtcctccatgcactcgtctgctttctggagccccatgagtgagtcttaatcctg

SEQ ID NO: 36109 - DNA, 601 bp, Human
gcctcagttttttacactcccaagatcaatctggatttatgattctaaaacccctggtgacagaatcagaggctgaaaacaccactaattataaccagcaggtatggatatttggaagtctaggggaggctgatatgaagttaagaccagaggaaatatctttccactccctcttctcaacacccatcttctagacgccaaggctagctatagatctccattatagtgttcaaggaattaggaattatccatgtcaatagttttgattaatgtggacggagaacatctatattactagatrgcaatatgtgaaagaagaaaacagtattgttgaaaacctaaatctgaaatgtcaatgtaatgacaaattttcacccctagaatgtctacctggggagtcctaaccctctaatattcccctgagagggatgggagaatacagtgcagagcttttatataagtatttcagaaagcagtagctaaagaatcacttgtttatttcccagtgtttcaaaggcccttctgaagaactaagcaaactaaggaaagaccatttagttttaaacaggagaaatgtatttaactaaatcctaaacacagc

SEQ ID NO: 36110 - DNA, 601 bp, Human
acccattttcctcccgcaattcctagaaaatatttcagtgtccgttcacacacaaactcagcatctgcagaatgaaaaacactcaaaggattagaagttgaaaacaaaatcaggaagtgctgtcctaagaagctaaagagcctcagttttttacactcccaagatcaatctggatttatgattctaaaacccctggtgacagaatcagaggctgaaaacaccactaattataaccagcaggtatggatatttggaagtctaggggaggctgatatgaagttaagaccagaggaaatatctktccactccctcttctcaacacccatcttctagacgccaaggctagctatagatctccattatagtgttcaaggaattaggaattatccatgtcaatagttttgattaatgtggacggagaacatctatattactagatggcaatatgtgaaagaagaaaacagtattgttgaaaacctaaatctgaaatgtcaatgtaatgacaaattttcacccctagaatgtctacctggggagtcctaaccctctaatattcccctgagagggatgggagaatacagtgcagagcttttatataagt

SEQ ID NO: 36111 - DNA, 601 bp, Human; identical to SEQ ID NO: 35828

SEQ ID NO: 36112 - DNA, 601 bp, Human; identical to SEQ ID NO: 35829

SEQ ID NO: 36113 - DNA, 601 bp, Human; identical to SEQ ID NO: 35830

SEQ ID NO: 36114 - DNA, 601 bp, Human; identical to SEQ ID NO: 35831

SEQ ID NO: 36115 - DNA, 601 bp, Human; identical to SEQ ID NO: 35832

SEQ ID NO: 36116 - DNA, 601 bp, Human; identical to SEQ ID NO: 35833

SEQ ID NO: 36117 - DNA, 601 bp, Human; identical to SEQ ID NO: 35834

SEQ ID NO: 36118 - DNA, 601 bp, Human; identical to SEQ ID NO: 35835

SEQ ID NO: 36119 - DNA, 601 bp, Human; identical to SEQ ID NO: 35836

SEQ ID NO: 36120 - DNA, 601 bp, Human; identical to SEQ ID NO: 35837

SEQ ID NO: 36121 - DNA, 601 bp, Human; identical to SEQ ID NO: 35838

SEQ ID NO: 36122 - DNA, 601 bp, Human; identical to SEQ ID NO: 35839

SEQ ID NO: 36123 - DNA, 601 bp, Human; identical to SEQ ID NO: 35840

SEQ ID NO: 36124 - DNA, 601 bp, Human; identical to SEQ ID NO: 35841

SEQ ID NO: 36125 - DNA, 601 bp, Human; identical to SEQ ID NO: 35842

SEQ ID NO: 36126 - DNA, 601 bp, Human; identical to SEQ ID NO: 35843

SEQ ID NO: 36127 - DNA, 601 bp, Human; identical to SEQ ID NO: 35844

SEQ ID NO: 36128 - DNA, 601 bp, Human; identical to SEQ ID NO: 35845

SEQ ID NO: 36129 - DNA, 601 bp, Human; identical to SEQ ID NO: 35846

SEQ ID NO: 36130 - DNA, 601 bp, Human; identical to SEQ ID NO: 35847

SEQ ID NO: 36131 - DNA, 601 bp, Human; identical to SEQ ID NO: 35848

SEQ ID NO: 36132 - DNA, 601 bp, Human; identical to SEQ ID NO: 35849

SEQ ID NO: 36133 - DNA, 601 bp, Human; identical to SEQ ID NO: 35850

SEQ ID NO: 36134 - DNA, 601 bp, Human; identical to SEQ ID NO: 35851

SEQ ID NO: 36135 - DNA, 601 bp, Human; identical to SEQ ID NO: 35852

SEQ ID NO: 36136 - DNA, 601 bp, Human; identical to SEQ ID NO: 35853

SEQ ID NO: 36137 - DNA, 601 bp, Human; identical to SEQ ID NO: 35854

SEQ ID NO: 36138 - DNA, 601 bp, Human; identical to SEQ ID NO: 35855

SEQ ID NO: 36139 - DNA, 601 bp, Human
agggggcgctgatgggcccagggcaggggaaccagaggtcctgctgtcggattgataaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacgagaaaaattcaaataatagataacctttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaag

SEQ ID NO: 36140 - DNA, 601 bp, Human
ccagaggtcctgctgtcggattgataaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacragaaaaattcaaataatagataacctttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaagagaagggaggagttaacattgactgaggtat

SEQ ID NO: 36141 - DNA, 601 bp, Human
aaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacgagaaaaattcaaataatagataacytttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaagagaagggaggagttaacattgactgaggtattgctataatacctgcatctttgcat

SEQ ID NO: 36142 - DNA, 601 bp, Human
tataacaaaagtttcatgaagtcttacctacccttactgtatgtaacgcactctgatagtttgtatttcattctgttctatttcattttttaaaaattctggttgtaatccactaaatttatttcatagactgactagtggcccatggcctggtttgaaaatgcgttgcacgtgcttctttatgtgggtgtaagtgtgtgcagataagttgccagaactgactgaaggttatgtgcatcaccaggtcaccctctatagaaattgtacaaatttgttctcccacaaacaatccatgaaaggrcttgtttccccttaacccacaccaacagtttattattagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggct

SEQ ID NO: 36143 - DNA, 601 bp, Human
gatagtttgtatttcattctgttctatttcattttttaaaaattctggttgtaatccactaaatttatttcatagactgactagtggcccatggcctggtttgaaaatgcgttgcacgtgcttctttatgtgggtgtaagtgtgtgcagataagttgccagaactgactgaaggttatgtgcatcaccaggtcaccctctatagaaattgtacaaatttgttctcccacaaacaatccatgaaagggcttgtttccccttaacccacaccaacagtttattattagacatgtaaaaacacytttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaactttttttttttttggctgtcttcacacattca

SEQ ID NO: 36144 - DNA, 601 bp, Human
tattattagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaacttttttttkttttggctgtcttcacacattcacttgtaccatatgaacatacatatacttcctttttaatgttcttatttttcttcacatcccaaagtcttctggctgaaatcctattgcccatatctgatgctttccaccactgcagaattctttagtaccaacactgcagtgtgcgtgacggacaaaagagcctgttatccctgtgtgactagacgtgggcctgtcagcttgctttttgggttattgttcttatcccagaggtggagctgcgttcttccattctgagggacgtacttcaggacattg

SEQ ID NO: 36145 - DNA, 601 bp, Human
attagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaactttttttttttttggctgtcttcacacattcacttgtaccatatgaacatacatatacttcctttttaatgttcttatttttcttcacatcccaaagtcttctggctgaaatcctattgcccatatctgatgctttccaccactgcagaattctttagtaccaacactgcagtgtgcgtgacggacaaaagagcctgttatccctgtgtgactagacgtgggcctgtcagcttgctttttgggttattgttcttatcccagaggtggagctgcgttcttccattctgagggacgtacttcaggacattgggcc

SEQ ID NO: 36146 - DNA, 601 bp, Human
cagaatttgagattcatccaaagagggagaatctgcctaagatgcctctgtctaaaagctagtatgtgccaggtgggtttgtttcattccaggtagagcacagggagcttatgtgaccaggcagtgtccaccattgggcaacacatcacacttcccttggcgtcttgcctcctccctccccgtctggcacagactctcccatcagccgtttgggcacctggggacttctgagcccacagcgtcatccagcagaccgtctgcggaggttccttcctgtgagggccgcactcgagggggtgtrttgggtgggatcgtatcactggaatgagtgaacatcgttagagggagctcccacagctatgcgtgtgaccgtgtggctcgccgctgaaaaatgctgctcacatagcagaacttcgatgcaatcctttttggatttctaaggggaaattttaagaccgataggaggaataggctggggttgaataagtttggttcttatttttaaattagctcatctttagaaaacaactgaatttagaagattcttctgtaaggccccaaaggatttctttctgcctccccgctcttggctcttatttgt

SEQ ID NO: 36147 - DNA, 601 bp, Human
gaccaggcagtgtccaccattgggcaacacatcacacttcccttggcgtcttgcctcctccctccccgtctggcacagactctcccatcagccgtttgggcacctggggacttctgagcccacagcgtcatccagcagaccgtctgcggaggttccttcctgtgagggccgcactcgagggggtgtattgggtgggatcgtatcactggaatgagtgaacatcgttagagggagctcccacagctatgcgtgtgaccgtgtggctcgccgctgaaaaatgctgctcacatagcagaacttygatgcaatcctttttggatttctaaggggaaattttaagaccgataggaggaataggctggggttgaataagtttggttcttatttttaaattagctcatctttagaaaacaactgaatttagaagattcttctgtaaggccccaaaggatttctttctgcctccccgctcttggctcttatttgtgtctctcctcgtgttctgagcttttcagcagcccttgtgggtcatcagccgaggaccatcagctcggggcccagagctggggactgggagttatgagctggactcttgaagggg

SEQ ID NO: 36148 - DNA, 601 bp, Human
gcgtgagccactgctcctggcaaaatgctgtttctaagcgtttctttgacaagtcccatccttcaggttcatgcatgattagggagaggcagcagccctgactgagcacctgagtgttcatggaaccaggtgcatagcgtaatgacatgccattcatgacactactttcttccctgaacatgccatgaattcctgatgattacacagttccccaacaagtgctgctcaaaacctggaactaatcagaaggaagcaccagccttgactgttagtgggacacggggaagatggctgtgaaccraatatgcggtgcctttgggggagaatggttttagtatttagtaagtgtcagtatgtaagttttatgttgaaaaatgaactaagtcacaacaaggtctataaatttaattattgaaaaggataaagttgggccattcagtgaaacctcctgtaactgaagtctctaacacagtagccaatgggggaatcaaatgagcccaagaagaaattctgcgtaaactaggacttaggggagcccttagcattccactttggagtgaaggaacccgatccgccagttggggaacgctcctttgaggcc

SEQ ID NO: 36149 - DNA, 601 bp, Human
gtaaccccaaaatgtgtgcctttggcttgcctgttttaggaattcacttgtgttatctccccaagcaaaacaaaagaaagagaaaccttcctgttgacgaatcctttttaccttcttgagagttgtcaatgggactaacttgtatatttctttgctaccttcttttaaaaacatttttcttatttactattacagacgtatagtaatggtgcctgacataacccacagccaaaggccttggccttgctgtgtgtatttcaggctttttcttcccttttctttttttttaagtaataagatrttacagttatagctgaagcctgatcctgttcccttttctccctctcgtcccaagcatcaccactgtcccaaatctgctccttcttcccacatctttgcagtttgggcaagtcttctgaatgcctagtcatgattttaagtcttctttccaccttcagtgatggttggctaccctgagcaagccagtagattcagttatgtgcctggagtccagatgttttatgtggatttttcatgtggaattgtttttggtaaggaagtattcccttgccacaccaatgaaaagagaagaaaacaggta

SEQ ID NO: 36150 - DNA, 601 bp, Human
tgttttatgtggatttttcatgtggaattgtttttggtaaggaagtattcccttgccacaccaatgaaaagagaagaaaacaggtagctggcacccactgcattgttgctttctgccagcctgctccttctccttcctctccagctctgttgtgtccagatgcaaactctacatgcagggtttgaccctaggtcctcacctgctgtagctctcacacggggaccgaatgctcttgtgtcgtaaatccttccttttgcttcctcgtgttggatgtgtttagtggttttcatcttctggtcastatttcattctaggtttatcccctttaaattataaattaaatgaattcttcgcttttcctaccagcaactacccaccaagttctaccatgtgttaatttaatcaacagttatttattgagtacttattacatgttgatttcctgttctcaacattggaatgaagacagcttagggttctgctttcatgaagcttgcatgctcttaggtggagacagacagtaattaagcagataaacaggaaattatgagctagtagtgggtccattgctgagaagtaagacaggtggtaggatgacccg

SEQ ID NO: 36151 - DNA, 601 bp, Human
aactctacatgcagggtttgaccctaggtcctcacctgctgtagctctcacacggggaccgaatgctcttgtgtcgtaaatccttccttttgcttcctcgtgttggatgtgtttagtggttttcatcttctggtcactatttcattctaggtttatcccctttaaattataaattaaatgaattcttcgcttttcctaccagcaactacccaccaagttctaccatgtgttaatttaatcaacagttatttattgagtacttattacatgttgatttcctgttctcaacattggaatgaaracagcttagggttctgctttcatgaagcttgcatgctcttaggtggagacagacagtaattaagcagataaacaggaaattatgagctagtagtgggtccattgctgagaagtaagacaggtggtaggatgacccgtgccgtgtgatgactttagattgggtggttggggaagacttcacggaccttaaaactggccttggaacgggaagcgagaactgggcacggaagatgagggagtgggagatttcaggcagagggagcagcagcaggtacagaggccctgaggccttttattgtgt

SEQ ID NO: 36152 - DNA, 601 bp, Human
tgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgcsgggggtgcccagggtacgtggggcaaggcgtctgctggcattaggcgatgcatctgcctggaagtctacctcctgcctgctgtccgagggcttcattggcgccacggaattgacttttccgtcttatatcattcctgtgtctttgtaggagtggaatcattctcatagtccgagtgtgtttccacatatggtgagagctgacaagcatggaggggttttggtgtaaaaagattagtcatttggagaggttttctcattttatggcaaggttcttttaaagccgtggatttccatgctgtt

SEQ ID NO: 36153 - DNA, 601 bp, Human
tgaaatgggaagtatgatttctgactggtatgaagtggctgctttagagaaaagatcacattctttagtcctagaaaccaaaggtggcttcctgatgctcttattcagcacgtgcctgtctttgaggcaggactggcactggggtgggggcatggtttggggttaccttaaggaccctggatatttctcagataggactttttcttttctttttttgagacggagtcttactctgttgcctaggctggagtgcagtggcatgatctcagctcactgcaacctccgcctccccaaattggckattctccttcctcagcctcacgagtagctgggattacaggcacccgccaccacacccagctaatttttgtatttttagtagagatggggtttcgctgtgttggcctggctggtctcaaactcctgacctcaagtgatctgcctacctcagcctcccagagtgctgggattataggcatgagccaccacacccggccctggactttttcttaattgaataaatatttatcaagttcttcacttctatttgacggttcctgggctcaacactggattagaaaatgaatgggacagagttctt

SEQ ID NO: 36154 - DNA, 601 bp, Human
tttgacggttcctgggctcaacactggattagaaaatgaatgggacagagttcttcatctgagacatagggtggtccaggtagtaggaggaagaaggattgcagcgcagcagtcctcgggacaccaccagggggtgaacgaaggagggacgggggagctgtgcaggtgccccagctccttgggttgcacagggttgaagaccagacccaagaaatggggccttgaccagctcagcaaactgagaatggcctagatttcagcacactttcaccaggatttgtcaaatgaaggaagattccaagcgcaaaataccctagatttcaaccagtaaaagcttgtctgaaaacttccaagatcgggttgtacaacttgacatttgaggaaacgctacttcagtagatggtgctgtggcattgttttctgaacaactgaaggaggagactccagagaagggtacctgctggagacctgtgtggtttgtggggtgggtttcttatatcactgaatctaaagtgggtgcctttcagaatgtgctttactaataatgtgttactctgcttttaattatacttctaataatttttcccaagagcctaattaa

SEQ ID NO: 36155 - DNA, 601 bp, Human
caggcacggtggcttacgcctgtaatcccagcactttggaaggccaaggctggtggattgcttgagcccaggagttaaagaccagcctgggcaacatggcaaaactctgcctctacaaaaaataccaaaaatcagccaggcgtggtggtgcgtgtgtattcctagctacttgggaggctgacatgggaggattacctgagcccgggaggttgaggctgcagtgagccgtaatcgtgccactgcactcctacctggggagcagagtgagaccctgtctccaaaaaaaaaaaaaaaaaaaaaagctgaaatccttgagtggattctaaatcatggcagtggctaacattcagcttcatcgtgcccttgctgtgtgcctggcagagacctctgtgcttactacatgtcgcatctcattgaatcctcacaaccttaagatccttccaggttgagcatcccggaccctaaaatcccaaatcctaaatgctcccaaatccaaaactttttgagcaccggcatgcagctcagaggaaatgcatactggaacatttcagattttggattttctaatttggagtgctcatctggtaatatagtgtggata

SEQ ID NO: 36156 - DNA, 601 bp, Human
aaatcctaaatgctcccaaatccaaaactttttgagcaccggcatgcagctcagaggaaatgcatactggaacatttcagattttggattttctaatttggagtgctcatctggtaatatagtgtggatattccccaatctgcaaagatctgagctccgaaacacttgtagccccaagcctttcagttaagggacattcaccctgtatcaacattttaatgctgagaaaatggaagagagagaggttaagtgactgacctggcatcacacagccaggagtggcagcatcaggatttgaacyggggcactcagctccaaagctcagctcttcttttttaaaattgaacccagattcttatttctcaaataccataaaatatttacataagccacagttatgccttttaaaaaaaaatcaccttttccccccactctcccatttacttcctttgcagtttgtggctacgatctaccttcctcttcaaaacccttgaaaaatccttgcagccttgcccaagcgtccttccctcagccgatttttgggcctcagtttcctcccatccagcctgtttcctatcgctggcttctccaagggcagagc

SEQ ID NO: 36157 - DNA, 601 bp, Human
ttagttggggagctccagaaagaagccgagaagaagggcagtcgtacccttggcagttgtacgcagtggctctctggccgcacaaggagggctcggagcctgctgttgccaggttgcacttgctcttgcaagacaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcggctcaccgcaagctccacctcccgggttcaagcaattctcctgcctcagcctcccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccaca

SEQ ID NO: 36158 - DNA, 601 bp, Human
gcacaaggagggctcggagcctgctgttgccaggttgcacttgctcttgcaagacaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcrgctcaccgcaagctccacctcccgggttcaagcaattctcctgcctcagcctcccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccacacccagcagtctcttcagtgtatttagctgtgttgatcctgattcatctgatgggtgaaggaatattggaaataaggata

SEQ ID NO: 36159 - DNA, 601 bp, Human
acaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcggctcaccgcaagctccacctcccgggttcaagcaattctcctgcctcagcctyccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccacacccagcagtctcttcagtgtatttagctgtgttgatcctgattcatctgatgggtgaaggaatattggaaataaggataatccctgtggtgtttcactgtgcctgtaacctctctcacctagcatttggtta

SEQ ID NO: 36160 - DNA, 601 bp, Human
agacaaacaaccctagtattcattaaagaaccagcctttgttttctacaagctatctgttcagtctactcaggaatagagataaactgccttaatagtaataaaagcaagcaccgctgagtgagtgctggcctcatgccaggaactgctcttggcactctgtgcacaagggagatactgacattctttctgttgtgcagatgagaaaacaggctcagagaaggtgagtaacttaccatggtcacacagcagcagagctaggtcagtataatccacaagtcattctcttaaccgctccgccrtaccgcccagaatgttcatctgcatctgggccagcctcgtcagtccgtgcaaagaggccagttgacccatctccctccctaacaagcacagaagagaccaggctgaaaattcatagctttcactcaaagtgtttccttcacctcattcatctgagttagctttattttactatataaagagaattttcttcagcaaaatgataggaatttttttaatgaaagtaaaggaatgtcacagaattgcgtcagggatatttccagtttaacacaactacaaacgtaggctgttttgttgttgtt

SEQ ID NO: 36161 - DNA, 601 bp, Human
aaacgtaggctgttttgttgttgttgttttggttttctattttgagatgaagtctcactctgtcgcccaggctgaagtgcagtggtgcgatcttggctcactgcaacctcctgctcccgaattcaagtgattctcctgcctcagcctcctgagtagctggaactacaggcatgcgctaccacgcctggctaatttttgtatttttagtagagatggggtttcaccatgttgaccaggttgttccggaactcaggtgatccaccttggcctcccaaagtgttgggattacaggcatgagccrccacactcggccagctgttgttaatagttaaaattataaattggacaaggtctgattccagcagggggagacaaattcacattgatttttctataagaaaaggaattatttgtactttcctcccttgtgtgtttgtgtgtatgtaagagagacagatgagaagagggctgcctttgagagccatgttccttttgcatgtacatacctctcaagattattacatgggtcttttagaagagggtcagtagctataaaagcaaatgatatttatgaaatgatttcattgtatgtggtttatta

SEQ ID NO: 36162 - DNA, 601 bp, Human
aaatgatttcattgtatgtggtttattatgtagtcttcaaaacagaaaaaccccacttgcttcgaaagcttcctttgagagctactttttaaccatattgttgatcaagcaagattcttaaagccccagtcctatacgtgagcagcattgaatccccggatactggcaggcgttcactgtccagcctttgacattagcatgtcaccctggtaaatcagagcactccatgccaaaaaacagcatggtctgctgagcacattaaggagcagagagggctcagaagaattaaacggccaatggrgtggtgacagaggtgagctctttccccctcggacagcttggcatggtgactaccaatgaggtttaattgacattaagagcagctcaccatttttaaagagcgataaattgtttccaagtttcagcctcacggagccctgagctaagagataatgggctgacacatagcctcattggtcacgcttcacttgtaaacaggattggccaaagcaagaaggctgtaagtaaaggttggcccgtcctctggaagcctcccccacagcagggtggggaactggggcagccatagcaagcaggacca

SEQ ID NO: 36163 - DNA, 601 bp, Human
tgcttcgaaagcttcctttgagagctactttttaaccatattgttgatcaagcaagattcttaaagccccagtcctatacgtgagcagcattgaatccccggatactggcaggcgttcactgtccagcctttgacattagcatgtcaccctggtaaatcagagcactccatgccaaaaaacagcatggtctgctgagcacattaaggagcagagagggctcagaagaattaaacggccaatggggtggtgacagaggtgagctctttccccctcggacagcttggcatggtgactaccaaygaggtttaattgacattaagagcagctcaccatttttaaagagcgataaattgtttccaagtttcagcctcacggagccctgagctaagagataatgggctgacacatagcctcattggtcacgcttcacttgtaaacaggattggccaaagcaagaaggctgtaagtaaaggttggcccgtcctctggaagcctcccccacagcagggtggggaactggggcagccatagcaagcaggaccatcaggacacggtgtctcccaaacgggccggaacatacaaggttctacgtttaataga

SEQ ID NO: 36164 - DNA, 601 bp, Human
attttgcattaactagtcaagtacttacccactgaaaagcacttcctgaaataatttcaccttcgtttttttccttctgcaggaggacaccatggaggtggaagagttcttgaaagaagctgcagtcatgaaagagatcaaacaccctaacctggtgcagctccttggtgagtaagcccggggctctgaagagagggtctcgcgccgcacccccagggtgacacaggcgctggggaagacgcacgggcggctcactgcacaaaacctcgttggaatatttgtgctctgccgacgttcagcygcgggtaaaatgaggcctgtatgggatgggtgtgtgcgtgtgtgcacatatgcacatgtatgtatgagagggagaatgtgattattttaagtggatacctaaaagcagtcaaatgcaaatctgaaattagtttctgaaacttgggcattttccagagttttctcactgaagtgattctgtaagtagacacataaccatcagacctaaccattcaggggtaaactgacggtggtgaaggtcatttgaggtggggccaggtctgcgtctgaattctgtggcagcctctccctgcgtaaattc

SEQ ID NO: 36165 - DNA, 601 bp, Human
tatgcacatgtatgtatgagagggagaatgtgattattttaagtggatacctaaaagcagtcaaatgcaaatctgaaattagtttctgaaacttgggcattttccagagttttctcactgaagtgattctgtaagtagacacataaccatcagacctaaccattcaggggtaaactgacggtggtgaaggtcatttgaggtggggccaggtctgcgtctgaattctgtggcagcctctccctgcgtaaattcaagttcactggcttgagaagaagaaaagagcctggccatgtccctcccrcacgagcacagtctcaggatgcaggtgcttgggaccatgttggaagttgggcccaggactgaggagcagagtcagaatccttcagaaggctttttctttagacagttgtttgttcagttgggagcggagccacgtgttgaagtcctcgttgtcttgttggcaggggtctgcacccgggagcccccgttctatatcatcactgagttcatgacctacgggaacctcctggactacctgagggagtgcaaccggcaggaggtgaacgccgtggtgctgctgtacatggccactcagatctcg

SEQ ID NO: 36166 - DNA, 601 bp, Human
tctcattccgctcttcccgtttgccttgtgatttcatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtcccatcaagtctgaataggacaagtggagatgcactctgatagaagtttcttgcaatcaaggactgggctcagtgtttgtctcygtgcctggcatagagtagcaataactgcacttactattctcgacacttcaatcaaagcacttagcatattaattaattacactcacagcaaccctaagaggtaggtgccattattatcgtcttcattttacggatgaggtaactgagtcccagggtaattaacttgctccaggtcatgaggccagggagcccgctcccagcaccagcctctccccatgttgggatctcagggtgtgtttgctgagaggctggcactgtgttaattgccgtgggcattaatacaaacttccagggcattgg

SEQ ID NO: 36167 - DNA, 601 bp, Human
tgtttttttgagacggagtctcactctgtcacccaggctggagtgcagtggtgcaatcttggctcattgcagcctctccctcccgggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttytttttttttttaactgtgtatttggcctgaggtccaaatatggtgcacagtgtatctgctgatctgttaagtctcctctataagccccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatgg

SEQ ID NO: 36168 - DNA, 601 bp, Human
gacggagtctcactctgtcacccaggctggagtgcagtggtgcaatcttggctcattgcagcctctccctcccgggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttttttttttttttaactgtgtatttggcctgaggtccaaatatggtgcacagtgtatctgctgatctgttaagtctcctctataagccccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatggtgtgcccttcc

SEQ ID NO: 36169 - DNA, 601 bp, Human
ggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttttttttttttttaactgtgtatttggcctgaggtccaaatatggtgcacagtgtatctgctgatctgttaagtctcctctataagmcccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatggtgtgcccttccatcagtagatacaaaatgcttcatttatttccttccttcctttcctcccctctccctcccctcctctcttctcc

SEQ ID NO: 36170 - DNA, 601 bp, Human
ctgattttaaatgtagtgtagtgaaatgctacacatcttgaacagcctttctctttcggttttctttcagcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgtaagccttcctcagcctgttctcacgagtatatgtgggcattccaggaaattcaactgtgcaggagtgtgtacacaragttgaaagtttttccatgagctctctccattccagttcttcagatgcagctaatgtagccatttgatacctattgacctttatttacagataaatagtatgtgcgtgacttgtcttttaaagcaaaaatggtattgatagataccaaacctgggtgtattcctaaatacagattcctgggccctgccttcacagacattctgctatagtagctaagctcatgaggtgattttttttttttttttttttgagacggagtttcgctcttgtcgcccaggctggagtacaatggcgcaatgt

SEQ ID NO: 36171 - DNA, 601 bp, Human
cagcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgtaagccttcctcagcctgttctcacgagtatatgtgggcattccaggaaattcaactgtgcaggagtgtgtacacaaagttgaaagtttttccatgagctctctccattccagttcttcagatgcagctaatgtagccatttgmtacctattgacctttatttacagataaatagtatgtgcgtgacttgtcttttaaagcaaaaatggtattgatagataccaaacctgggtgtattcctaaatacagattcctgggccctgccttcacagacattctgctatagtagctaagctcatgaggtgattttttttttttttttttttgagacggagtttcgctcttgtcgcccaggctggagtacaatggcgcaatgttggctcacttcaacctccacctccctggttcaagcgattctcctgcctcagcctcccaagtagctgg

SEQ ID NO: 36172 - DNA, 601 bp, Human
tacacaaagttgaaagtttttccatgagctctctccattccagttcttcagatgcagctaatgtagccatttgatacctattgacctttatttacagataaatagtatgtgcgtgacttgtcttttaaagcaaaaatggtattgatagataccaaacctgggtgtattcctaaatacagattcctgggccctgccttcacagacattctgctatagtagctaagctcatgaggtgattttttttttttttttttttgagacggagtttcgctcttgtcgcccaggctggagtacaatggcrcaatgttggctcacttcaacctccacctccctggttcaagcgattctcctgcctcagcctcccaagtagctgggattacaggcatgcaccaccacgcccggctaattttgtatttttagtagagatggggtttctccatgttagtcaggctggtctccaactcccaacctcaggtgatctgcctgcctcggcctcccaaagtgctgcgattacaggcgtgagccaccacgcccagctgcgaggtgatttttatctggtcgttttatactgattacatatgtgttatctgtactatgcaca

SEQ ID NO: 36173 - DNA, 601 bp, Human
tgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaatkcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaa

SEQ ID NO: 36174 - DNA, 601 bp, Human
ctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggartccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggtatccacgtgccttttctttagttgtatgcagatgagcactgttaccttacaaagaaagagaaccaccacaccaa

SEQ ID NO: 36175 - DNA, 601 bp, Human
ggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggyatccacgtgccttttctttagttgtatgcagatgagcactgttaccttacaaagaaagagaaccaccacaccaagccaacaccagtactgatggctgctggatttttgtttctgtccctgtatgattcttagaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcggta

SEQ ID NO: 36176 - DNA, 601 bp, Human
aaagaggtttcaccgactcacagttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtgggggrtaggccaagcatctgggttcacagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaa

SEQ ID NO: 36177 - DNA, 601 bp, Human
gttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtggggggtaggccaagcatctgggttcayagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaaaggcttgcatgctaaataagtc

SEQ ID NO: 36178 - DNA, 601 bp, Human
aataagtccaaatttgcaatacttcccgccccgctgggccatctcactcacctacttggaggttatggcgtatagactctccagaatcttccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtrcataattcattgcaatttcactctcctggcctccttccactagattaaagttttgggagggctttggtgttccctgattcagatgtcccgcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctc

SEQ ID NO: 36179 - DNA, 601 bp, Human
ccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtgcataattcattgcaatttcactctcctggcctccttccactagattaaagttttgggagggctttggtgttccctgattcagatgtcccrcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctcactgcaacctccacctcctgggttcaagcgattctcctgcctcatcctcctgagtagctgggactacaggcgtgtgccaccacacccagc

SEQ ID NO: 36180 - DNA, 601 bp, Human
atctcttggtgagccgagggtgtcaattaactgctcagtgctgaaactgagtggtgcataattcattgcaatttcactctcctggcctccttccactagattaaagttttgggagggctttggtgttccctgattcagatgtcccgcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctcactgcaacctccacctcctgggttcaagcgattctcctgcctcatcctcctgagtagctgggactacaggcgtgtgccaccacacccagctaatttttgcattttttagtagagacggggtttcatcatgttggccaggatggtctctatctcttgacctcatgatccgcccacctcagcctcccaaagtgctgggatgacaggcttgagccaccgcgcctggctaccagaaagatttcttatga

SEQ ID NO: 36181 - DNA, 601 bp, Human
ccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccrgcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaatttt

SEQ ID NO: 36182 - DNA, 601 bp, Human
gcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctcygtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctg

SEQ ID NO: 36183 - DNA, 601 bp, Human
ccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcaygtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagcccc

SEQ ID NO: 36184 - DNA, 601 bp, Human
gcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcacygtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaaggcccttcccctcccccactcctctaagacaaagtagattcttacaaggccctttcctttggaacaagacagccttcacttttctgagttcttgaagcatttcaaagccctgcctctgtgtagccgccctgagagaga

SEQ ID NO: 36185 - DNA, 601 bp, Human
gatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcasgtctgcaagggcccagagtgaaccgtcctttcacacatctgggtgccctgaaaggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgag

SEQ ID NO: 36186 - DNA, 601 bp, Human
cactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccrccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaatgtgatgtgccactatattttacacgta

SEQ ID NO: 36187 - DNA, 601 bp, Human
ttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccytcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaatgtgatgtgccactatattttacacgtatctct

SEQ ID NO: 36188 - DNA, 601 bp, Human; identical to SEQ ID NO: 17624

SEQ ID NO: 36189 - DNA, 601 bp, Human; identical to SEQ ID NO: 17625

SEQ ID NO: 36190 - DNA, 601 bp, Human; identical to SEQ ID NO: 17626

SEQ ID NO: 36191 - DNA, 601 bp, Human; identical to SEQ ID NO: 17627

SEQ ID NO: 36192 - DNA, 601 bp, Human; identical to SEQ ID NO: 17628

SEQ ID NO: 36193 - DNA, 601 bp, Human; identical to SEQ ID NO: 17629

SEQ ID NO: 36194 - DNA, 601 bp, Human; identical to SEQ ID NO: 17630

SEQ ID NO: 36195 - DNA, 601 bp, Human; identical to SEQ ID NO: 17631

SEQ ID NO: 36196 - DNA, 601 bp, Human; identical to SEQ ID NO: 17632

SEQ ID NO: 36197 - DNA, 601 bp, Human; identical to SEQ ID NO: 17633

SEQ ID NO: 36198 - DNA, 601 bp, Human; identical to SEQ ID NO: 17634

SEQ ID NO: 36199 - DNA, 601 bp, Human; identical to SEQ ID NO: 17635

SEQ ID NO: 36200 - DNA, 601 bp, Human; identical to SEQ ID NO: 17636

SEQ ID NO: 36201 - DNA, 601 bp, Human; identical to SEQ ID NO: 17637

SEQ ID NO: 36202 - DNA, 601 bp, Human; identical to SEQ ID NO: 17638

SEQ ID NO: 36203 - DNA, 601 bp, Human; identical to SEQ ID NO: 17639

SEQ ID NO: 36204 - DNA, 601 bp, Human; identical to SEQ ID NO: 31264

SEQ ID NO: 36205 - DNA, 601 bp, Human; identical to SEQ ID NO: 31264

SEQ ID NO: 36206 - DNA, 601 bp, Human; identical to SEQ ID NO: 31265

SEQ ID NO: 36207 - DNA, 601 bp, Human; identical to SEQ ID NO: 31266

SEQ ID NO: 36208 - DNA, 601 bp, Human; identical to SEQ ID NO: 31267

SEQ ID NO: 36209 - DNA, 601 bp, Human; identical to SEQ ID NO: 31268

SEQ ID NO: 36210 - DNA, 601 bp, Human; identical to SEQ ID NO: 31269

SEQ ID NO: 36211 - DNA, 601 bp, Human; identical to SEQ ID NO: 31270

SEQ ID NO: 36212 - DNA, 601 bp, Human; identical to SEQ ID NO: 31271

SEQ ID NO: 36213 - DNA, 601 bp, Human; identical to SEQ ID NO: 31272

SEQ ID NO: 36214 - DNA, 601 bp, Human; identical to SEQ ID NO: 31273

SEQ ID NO: 36215 - DNA, 601 bp, Human; identical to SEQ ID NO: 24637

SEQ ID NO: 36216 - DNA, 601 bp, Human; identical to SEQ ID NO: 24638

SEQ ID NO: 36217 - DNA, 601 bp, Human; identical to SEQ ID NO: 24639

SEQ ID NO: 36218 - DNA, 601 bp, Human; identical to SEQ ID NO: 24640

SEQ ID NO: 36219 - DNA, 601 bp, Human
tccgtgccagttgattaccacagtttataaaatgcctgaagactctaatgtttatttagcctcttagacattgcatttgagaaatgtggactggacatctctgtatgatcagctgtctcctgtctttttcattttgcctcttgttgactaatgtggtacgcacctaatgctttatgatttcagtgatttttttttcttttttccccaaccaatttgatggtaatttcagtgatttttaaacccccaaatataatacatggtctctatacactccagatttttattctcatgaggctttaaygcaggcatttttgatgtttccttggaggtttgaaagatgattgaagatgtttaggtgcttgtggcactcagacagtcctggcttctaggtctttccagactgaggagcaaaccagacagacgaagcctcgccctcacagaactgccctttagtgagaagataggtagtgaccaagtgagtgggttagtcggtaccacagtttcagatagtggtgagtgtcaagaaagaaggacagtgggatgggtgtgtgcagtgtggctgagggaggctggggaggcagctgttgtgcgtgggcctttc

SEQ ID NO: 36220 - DNA, 601 bp, Human
tctgatgactagtcagccaaattttctggtaggattttcattttgaaattatggtacaagggagacatcttactgtgtattttgcccccctttattacactagggtatcaagtacaaggtcttataaccggaatatcgacagaagtggattcacgtattcgtgtccgcactgtggaaagacgtttcaaaagccaagccagttaacgcgacacattaggatacacacaggtatgaaaacactgacttctggatgactgaccgtgtggctggaagggaagaacaggtgcctttttgctagctygacttggaatctgatcccagctttctcatagtttgctggataatcttgctgaaattagttactctttgtgtgattttatttcctcacttgaaaaatgtggctcttttatctgtatatagctgtcctaaattatacattaacaaatatacttagtgctcattgaaaagtgcttgatacatggtaggctgttaataattgggggttgatgttattactgttattggtatggtatttattccctcatttgttgttactgtgtgtcagatattatactgcactaattagagctaaattaacaaa

SEQ ID NO: 36221 - DNA, 601 bp, Human
ataattagatgactgattcagactgtcatctgaacctgtgaaaataagacaaactgtaatcattaatttgtgaaatgatgatttctacagtgttattgatgattattgaatattctttaaattataatttaagaattaattatcctttgtaggtaatatttctcttttcttatgtgacagtgataatttttcctaagtctttggacttttgaaactaaattatatttttcagtacatgtagttaaaaattgtatgactctaaatacatatgcctacacacagagagacacaggtgcgcacrcacacacacacacacacagggacatacacccactcttattttttctgtaggcgtctttagctcagtctcatttagttactcgtactgcactaccctctcaacagattaataaatggtaaaatttaagcatcaactataggtatcttaacagtagtagacattaaatacgaaagtgtcggaagttttaatgtatgcttatgaatgcagttacttggttgtattatgtcaacagctgcctcctaccagtatggaaaataagtctaattaatacttagtttttaaacattaggtttaccttta

SEQ ID NO: 36222 - DNA, 601 bp, Human
taggtaatatttctcttttcttatgtgacagtgataatttttcctaagtctttggacttttgaaactaaattatatttttcagtacatgtagttaaaaattgtatgactctaaatacatatgcctacacacagagagacacaggtgcgcacacacacacacacacacacagggacatacacccactcttattttttctgtaggcgtctttagctcagtctcatttagttactcgtactgcactaccctctcaacagattaataaatggtaaaatttaagcatcaactataggtatcttaayagtagtagacattaaatacgaaagtgtcggaagttttaatgtatgcttatgaatgcagttacttggttgtattatgtcaacagctgcctcctaccagtatggaaaataagtctaattaatacttagtttttaaacattaggtttacctttagtgtttgttttttcttttcttttttcataatatttgcagtgtgggatggttcctcaatatattcttgaccaggtagaatgttgtaaaatgaattataaagctggagaatagagtccaataattatgtcttcaaaattctattttggtct

SEQ ID NO: 36223 - DNA, 601 bp, Human
gtgcatcggtcgggtacatttgttacaactggtgaacgaatgtggatatattattattagtaaccaaagtccatagtttttgtcagggttcactctcagagttgtccattcaacgggttttgacaaaggtagagtgtcctgtccacaccctcacagtgtcgtatgggtagtttccctgccatccgttttcttctggatgggacatttcggattcccgagccctgcaggggtgggactggctctctctcccatcacagccctttcctctgacttaggttttcttggctgtagcattacagcrcctttattcctccagtctccttgcaggaagaattttttcacaaatgtgttgaattattttgactgcagtggtttctttcctactttttaaatttgtgtaacttgatattttaaaaattccttcacttcaattttatgggctaacaggaaggtgagggttcacgtgctcaatctgccatcttgagtctctatgctcactggaaaaaactgtacaaaattgcattagaacaatgtattgagtatattaagagccaatatcgtgccaaacaccagaatcagtgaggcattatatttaaaattt

SEQ ID NO: 36224 - DNA, 601 bp, Human
gagcccccagctttctagtccaccgtgacttcacactaactcttcactcctcctgtctctctgttacttgtttaaccttcctcctgtaccttcatggggaagagctggccaggggtatgaggaatctcagggtgtcgttctacagccgatacctgaaagttaaacccagtgtaactcaaaagccttaaaatagggattcccaagactatttagagacaaccaaagttgtgtgaggtaagatttctgaaagtcaaataaattttaattccctttaatttagaaatgtaaatgcttatattawtttgggtgggagcaagatgtcatatcatcagaaaggacgttacagcctcaaagggttggaagcctcacttataagtgatgacttggaattgtagattcttatttcttggagtggaattagaattctataggtaaagcttttgactgattttggtaggcagagttgggccatcgttaccttctaaccttttagttttgttctgtcttagcaagccttagaaaacagtgggctgtcttcaattccagctgcagcacatcctaatgactcctgccatgccaagacctctgcaccacacgctca

SEQ ID NO: 36225 - DNA, 601 bp, Human
aggtactgcacacaagtactgctcacagggactgcacaaagtatcacacacagtactgcacgtaagtgtggcccgcaatgcagcacccacaccggtactgcccacagggactgcacaaaggtctcaaacacagataccgcacacagtacccaacacagcaatgtgcacaggtactgcacacgagtactgcccacagggactgcacacagtactgcacacaggtactgcacacagtatgcaacagggcactgtgcacaggtactgcacacaagtactgcccacagggactgcacacagtacsccacatagtactgaacacagtactgctcacgggtatggcccacagtgctgcacccacacaggcattgcccaaaagtaccaaacacatagtactgcacatagtacccagcacagcactttgcacaggtactactgctcacaaatactgccctcagggactgcacacagtatcacacacaggtatggcccacagtgctgtacccacactggtactgcccacagaaactgcacacaagtatcaaaggcaggtaccagacacagtaccacacacaagtatggcccgcagtgctgcagccacgtg

SEQ ID NO: 36226 - DNA, 601 bp, Human
taagtgctgtttaaatgttagcttacgtaatctcagcagcagccctggaggcaggtgtctttaagccactttacaggtggtgacttaagagagagagcatccttacatactgtaaagttctgaagaactactgtccatattttacaatgtaagactttgtcctaaaaatactaaatgttctttttttacttaaaatgctcttataacatgccttaatatctataatatgcactgtatacaaacaagggaaaataatttacaatatccattaaattataagcatggcctaataaattgaagrttcaaatcagtattggaaataataacattttatgttagcatttgctgttgagatgtaatttctggaaataattctaaaatgtgatttcatttttattaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgact

SEQ ID NO: 36227 - DNA, 601 bp, Human
gactagtatgttttacagtcaagattaaaatctaagttgtatccaaactactgctcaaattgttttctcggattagagacaaataatgtgtaagtgaaaacagtagcgtgtaagtcctcattgaagaaacattgctacctcagtggaaccatcaaaagtgagaaggggtttttatgtgaaacacacagtgcacgttgttgttttcatctttaggttctttgtactgtgttacagattatttgggctactttaatctttggattaaaaaggaaaagaaaaatctgcctgcttttctttttargttcagtgttactataaccaacccaaactatgattttgttgatgatctagaaagaaaacactgcttgttagaatctttagaaaaattatatttgttagtactagaacaaaatttaagaaacctcattgtcttagtttgtttgagctcctgaatcaaaaataccactaactgtgtagcttgtaaatactaggagtttacttctcacagttctagaggctgggaagtccaagatcatggtgctggcagattgagtgtctagtgaggtctctcttcctcatagatagtgccttctggctatgt

SEQ ID NO: 36228 - DNA, 601 bp, Human
tgaggcaggagaatggcttgaacccaggaggcagaggttgcagtaagccaagattgcaccactggactccagcctggggaacaacagtgaaactctgtctcaaaaaaaaaaaagtctgataatttaatatacgaattgtactaagcttcctaggaactataattgttatgctatttaactgtttttgagcatagaatgggatcaaaacccccatggtagcgtagaatactttgatatccttgtccagttttggctgctcacaaaatgaagcaacagaccggtttcttctttcaggttgccrtaaatcaagttgtacacccatgggtttctggacttcaagtttttgaatcttcagttgagttaggttcttgactcttcagcaatttttcagggttaaaatgggatatattttgcttgttggcttcgcagatacttgtatcttagaccagataggggaacctgaattctttggtttaggctgaggaagacacatgagggaaatgattgctagagggagcttcacactgtaaattgtaaaatattgtaactatgtcttgtgcttaattttgttatttgtatttgtgttcatctcttctctcag

SEQ ID NO: 36229 - DNA, 601 bp, Human
ctcgggggcacatggatgttgaggatgcttgtgttcctgctcgctgtagcaggatgacgggtccccagttggcccaagagcttaccgtgctaagaagaatggagcttgggcgcttgcttgctcagtggaatgttaaaccaaatctttttcagtcaggaagccagcctcttccagtgtcctttcgtagtagtattgggaatatgggtgttcaggcccttgtttccggacccagtgaccaatgctgtaattgcggggtcacctttattaagtggtatattgtgcgaccattgtttgtcatcartttcgagggacacatgtaggagatgaatgtagagctttgagaggacactaagcagatcagcctgttgttgcagagctgcagtgctttgcttttacagattgtgtgcacttggaatctgcctacaaggagagcatccagccagggtttcattcctttgaattgttggaaattcccaaaataccacatatactcatgctaaagataggtaaagaaggttactgtagtaaaatttattggaaaaaacaaagaaccaaggaaacaaacagaaaacaagcctccatcagttagcgtgagacacac

SEQ ID NO: 36230 - DNA, 601 bp, Human
tatggtttcaaaccaaataactttttgcatgcattgtagatttttttttattgatgcatactattttgtggtctgcttaggtcttctggaaagtgacctttgcagccattctacacgtagtttccagtcaagaaaaggtggctgagtagaaattggaacttcgtggtggctggtcctgtaaagcctccggtgctgtaatgtctgctgagcacagcctcctgcctgttagcaaacagtgttaaagcttgctaatagcagctagtcctaattctaattcagaaaatagaaatgcccctttagrcattttaaatttataaaccttttcttagaacattttaatgtaactttaatatttttgtagaactcctcttttctaatttattttaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtagtgagtatggacagaggggtgcatacatggcagtatttagcaggtgctatgttattcttcac

SEQ ID NO: 36231 - DNA, 601 bp, Human
cgtcactgttttaagtcattattattccattttcgaaattagttaaatttatattatgccttttagttcaagactcttcatgtgctttacatataacaatctgtgtaccaggatacagcacaattagaaagacagctttttagatgtgtccgtccactggctcagcagtacatactgagcaccctctgtgcacaatgtacaagtaatttttgtatttttagtagagatggggtttcaccacattggccaggctggtctcaaactcctgacctcaggtgatccacctgcatcggcctcccaragtgctgggattacaggcgtgagccaccgccaaaccagatttacaagagtgaattttcaaaatgtattcagacacttccagcttttagtttaatttggacttgagaggaaagttagttgcctctacgtgggcacccagtcttgacttaggttatagtgtagggacgtcactaacctcttgctggagattaaaacttgagaatggacaaaagagacatactaatggaataagcttttaataatatgtgagtaggagttttgaaatttataattattttaatccttaagataacattagtct

SEQ ID NO: 36232 - DNA, 601 bp, Human
actcttcatgtgctttacatataacaatctgtgtaccaggatacagcacaattagaaagacagctttttagatgtgtccgtccactggctcagcagtacatactgagcaccctctgtgcacaatgtacaagtaatttttgtatttttagtagagatggggtttcaccacattggccaggctggtctcaaactcctgacctcaggtgatccacctgcatcggcctcccaaagtgctgggattacaggcgtgagccaccgccaaaccagatttacaagagtgaattttcaaaatgtattcagwcacttccagcttttagtttaatttggacttgagaggaaagttagttgcctctacgtgggcacccagtcttgacttaggttatagtgtagggacgtcactaacctcttgctggagattaaaacttgagaatggacaaaagagacatactaatggaataagcttttaataatatgtgagtaggagttttgaaatttataattattttaatccttaagataacattagtctattcagtaacaactgaaggggaaataatactgcatatttatatattattcagcataactccagtatactctg

SEQ ID NO: 36233 - DNA, 601 bp, Human
tagaaaatttatagactagttcttaatgcctaatctacctcatgtgctatgggagtgatgaaaagatggattggagaaaacatttctggggtagaatccacatgttgccagtttaaatgtaaaagaccaaggagagaggggacttgatttgttttgaagactgtgacttcacagagcctgctgatttcagtagagaaggcagtaagatgtcctatgtcaacttccatgttcttaaaacaatcccatttctaaaaattggaaacccacaccaaataaactgtctataattttgtaatttacttttttttttttttaaccaaagtctgttaagcctcaggataatgttgtaacttattaaacatatctttgtttggttttgactgcttctggttttaaggtagtgaaataggattggttccagccgttttttctgtttctgtgcttgcaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcaca

SEQ ID NO: 36234 - DNA, 601 bp, Human
ccttctctagtattcttttttaatcaattggaatgcgtccttatttttcatttaggaatgaatacttatgcatatagttctctctcagtatcagctgaggattggttcctggactcctgaggacaccaaaatctgcagatgctgaagttcctgatatcaaacagcatagtatctgcatgtaacctacacgcatccacttgtatactttaagccatctctagatcacttataatacctaatataaatgctatgtaaatagtttggggttcttttgagaaacagggtctcactctgtcacccrggcaggagtacactggcacaatcataattcactgcagccttgaactcctgggatcaagcaatcctcccacctcaggctcctgagtagcaggggctacaggctcaccaccacgcctggctgatttaaaaaaatttttttttgtagagacggggtcttgctctgttgcctaggaggtcttgaacttccctgccaagccccaccttggcctcccaatatgctgggattacaggcgcgcgcccccatgcctggttaatttttaaatttttggtaaagatggactcttgctgtgtggcccaggct

SEQ ID NO: 36235 - DNA, 601 bp, Human
ttgtgtaatgcagtgaactttttgtggatatggagggcccggcatcacttatctttgtgcccccaggcctagggcacggcctctcatgcagcaggtgcccagtgacgtccacgatgacttggtgcacgctgcttcatcatttccttggttttggagttcagcgtaggccacgtggataaggactagaaatggaagtctctggataaataccttttggtgcctctttctccattctgaagtagaggtgtgatttctgaggaacccagggcggcgttgggatagcaggttgcactagtccctyggtggatcctagtgtgcaccatcctgtaaaaattagcatttgttcctggacagtagaggggaaaagccagccaggaagtttttcagctcccagaggctcttggagggtggagcctatgctcatggtgctccgagccttcgtggcctttgatatacccagtaatcatgaaaagagcctaaggaactaggtacatgacactaggcacacagccctttgaccctagcatagaactttcctttgcatattctcccagtgtgatgcctacctgtgctggcattgtggttgcacctgtttggcaga

SEQ ID NO: 36236 - DNA, 601 bp, Human
ttagatgctgttggacagcaaaaattaacattgaattttatataattcagtaaccttcctccttttaaaattatatttatatctgaattttaatgttggaaatacagaagagttacaatattttaggaaagctatttggttgatccaattaactttctcgagtacacttaatataagaagtattgtgctaggtcctatcaaaactacatagtgcatggttcttgctcagagttaagaaaatgtattcttcagtttgtggattgtgcctctgttcttcctgtgtgttattattggccatttrgttattttgttagtatatttgaaagtgtagatgaatataactaatattttaagaatttggcttcagctgttctaggagaaaaccttaaatgagttaatgaaataagtttggtttcaactttgggcttcagattgttttttctcacttattatgatggataatgagaattggctatacagttccttatcccattttgaaagggctgcaaaaagcatttaatttatggtaacctgttaaaagcatctagatattccatagaaattttcaaagatttcatagtgtgttcttttttccattaac

SEQ ID NO: 36237 - DNA, 601 bp, Human
gctgttctaggagaaaaccttaaatgagttaatgaaataagtttggtttcaactttgggcttcagattgttttttctcacttattatgatggataatgagaattggctatacagttccttatcccattttgaaagggctgcaaaaagcatttaatttatggtaacctgttaaaagcatctagatattccatagaaattttcaaagatttcatagtgtgttcttttttccattaacacataggattataaatgcatgcaagtactagagaatgcacaaatcacttcagctaagttttgcagrctttaggcagttcatgagtcctagcattcagaaaaaggttacacgttgagtgaaaagcaaagacagtcctttgcctcccggaattaccctgtccagatacaatgaaagtccttttacctgatgttttcagcccagttattaataaaaaggtatataaaattgggaaccaaacaagtgacatctgcatactttggagattcatccacggatcttttgaatatgggtctgctcaggtgataatacattttctactttttaaaatttttgcctgtactcatgttcatcatgcagtttcatctc

SEQ ID NO: 36238 - DNA, 601 bp, Human
gcattttgtggtctcattttcatttttccataaattgtactgaaatgacaatgaaaactttgaggatagaattatatgtttaacacacttgccaatacgcatcttagaatgttgttttcagataccacaatattaatttccatttaggtcaagaacttattcaacacaattctaatggaaatagtgaactattaataaacgggagcataagattgttagcgcctgaaatcaataatcaatctacaggtgccaccctaacaataagcaatgatcagcttctctcccagagcacagcattgasctcttcaggcacacagcacacgagttagccaagaaagacattataagaggtcggagctaaagagctctgcccacagtcaatgaggagttaaactgtccttagcatgacaggtgtgtcagcgtcatgctttgtcacatggattatcattctgtaaggattactggcttatgtctaattctaggatacaaaattctctctaatgttaccaaccaatcgatgatgttactttttaagccatgaaagtaaataattttattcaactgtacaaagcatcgtatatttatacaagttagcatgtta

SEQ ID NO: 36239 - DNA, 601 bp, Human
gttctgaccgaagggagaagttggatggaatgagggcgcacgcactccagggctctgctctagctgcccgcgtttctttaaactcctgtgatctggctagttcggtagtaagtgctgtacctataaattcacctccacagacgcatgttggaagtgtcacaccagcatctcacactcaggtgagggtcctttcagggcaggcgagctgtcctcagtcagtgggtgcaaggctcccacatgttatgcagctgacatttctgtataaacagcaacatacccactttgctgatttgcatttttwaaattattattcttttagacctttttttaaagagccagccgaggccgggcatggtgggtcacgcctgtaatcccagcacttagggaggccgaggcgggcggatcacctgaggtcaggagtttgagaccagcctggccatcatggtgaaaccccgtctccattaaaaatacaacaaattagctgggcttggtggcgggtgcctgtaatcccagctactcgggaggctgaggcaggagaatcgcctgaacctgggaggtggaggttgcagtgagccgagattgtgccactccagcctgggtg

SEQ ID NO: 36240 - DNA, 601 bp, Human
aatttagcacaactttttaaggaattcatctcaaatgagtattatctttttgttcttaccttcgtccacttttaaatttaagataattttgatgaataaattgagttctgcttttgatgaaagaagcaaagaccagtatttgttttctatttatttgtagggttattctagccttagtttcttctagatttaagtataatcacttattttatttttaaatagttcaacaatttaacatttcccattccccggtgtatattaaaactgaagaggacgttctcatcctcacgagttgtccctytgagtgacctggatgcttgggaacgaggggctaccccgatgcttctctcctgttctgccgcccccacctcctgtcttcccacatttcagttaatcgcaagaaaaaactgatatcatatcttttaaattatttttagaaccttacaaaattatgttttcttagaagctatgaggtgatatcccaagagatttaagacaatgttgggtttgatgagcgtacagtttattaatctttttaacttatttttgagtcggaatcataaagtcagacttgtattgctctatacatgctggaggaaca

SEQ ID NO: 36241 - DNA, 601 bp, Human
tatttgtagggttattctagccttagtttcttctagatttaagtataatcacttattttatttttaaatagttcaacaatttaacatttcccattccccggtgtatattaaaactgaagaggacgttctcatcctcacgagttgtccctttgagtgacctggatgcttgggaacgaggggctaccccgatgcttctctcctgttctgccgcccccacctcctgtcttcccacatttcagttaatcgcaagaaaaaactgatatcatatcttttaaattatttttagaaccttacaaaattrtgttttcttagaagctatgaggtgatatcccaagagatttaagacaatgttgggtttgatgagcgtacagtttattaatctttttaacttatttttgagtcggaatcataaagtcagacttgtattgctctatacatgctggaggaacagtggtttcagaaaaataagtgaagaataaaagtaagagtctacaatcttcacttcagcatgggatcttcattttcatgctaagagtatttaatttgaatataagattgtagcttttaacaaatggatagttaagagctatttgtagcttgt

SEQ ID NO: 36242 - DNA, 601 bp, Human
ttgagtcggaatcataaagtcagacttgtattgctctatacatgctggaggaacagtggtttcagaaaaataagtgaagaataaaagtaagagtctacaatcttcacttcagcatgggatcttcattttcatgctaagagtatttaatttgaatataagattgtagcttttaacaaatggatagttaagagctatttgtagcttgtaatttaactgcatgcttaagaaaatttcagcttttttctgctctagtcatgtgttcttttcaatcatattgaggacagttctactggaaccggtrtcatcctctttgtggaaaatccattgaattaggacattattaaaggttcactgtttgagttgaaatacgaaatttggccctgtctgaagttgtttattattttcattgaactttgtgtcaggtttcactttaatcaaacacaagccttctctatctttttacatttttcatgctgcacagtcccggaacctctgataccttaataatcactagaaagtcaggattagttgactggtgggagtggggagaagatctttggttcctttatttcagcagttggggtgaggtttgaatttttgc

SEQ ID NO: 36243 - DNA, 601 bp, Human
gttcaagatctgtcatttggctagtcttttttcttaaaatacatgtttttgggagccaaaatatttagtaagcaatagtctaaatatggaagagtctaaaatctctttccttaaaagtttccagggtcagaattaaagcacagatgatgaataatctctgaatttaggaagcattaaacatttttagcaaatgagttttcaaaataatgacttaccggtttttctgtagaacaagggctttttcacaaagagatgagatataacgagcactggggatgtcctgcagtttgacctgagtaaycagagctgtctcactgaatttcagtttgtataactttagcacatttgtgtctggggtccccaagactgccttcaggtttgacgattcactacaaggtctcactggattcagaaaaatctgatctactggtggttgtggtttatacttgtggttacaatggaagggtgcaggtgagaaccagcggaaggaaaaggcacgtggggtggagtccagagaacccaggcacgagcttcccagtgtctgctccagtgaggtcacacggacactgctgattctcccaggaaagttgtgtgacaccgc

SEQ ID NO: 36244 - DNA, 601 bp, Human
cgattcactacaaggtctcactggattcagaaaaatctgatctactggtggttgtggtttatacttgtggttacaatggaagggtgcaggtgagaaccagcggaaggaaaaggcacgtggggtggagtccagagaacccaggcacgagcttcccagtgtctgctccagtgaggtcacacggacactgctgattctcccaggaaagttgtgtgacaccgcctgccaagtgtcgcccacttgggaagctcagctaagctctggtatccagaattgttttacaatcagtcatgtggccatggartgcccgcgtggttgggcttagctatgcggtctccaggcccctgcccctccaggtcaaacggatgcagtggtccaggtccccagatgaaacaaaaacaggccttcaccataagtcacatcatcagcacaaactatgtggcattgcccaaggttctgggtatgaaatacactcttacctactaatagcaggatgttccaggggcttatgggtgatgctcgggagctgatcaggggcactgtggagtgtgcagggtttgagcacctcaggcctggtgaggtaactgttgaccacacacattca

SEQ ID NO: 36245 - DNA, 601 bp, Human
cagaaaaatctgatctactggtggttgtggtttatacttgtggttacaatggaagggtgcaggtgagaaccagcggaaggaaaaggcacgtggggtggagtccagagaacccaggcacgagcttcccagtgtctgctccagtgaggtcacacggacactgctgattctcccaggaaagttgtgtgacaccgcctgccaagtgtcgcccacttgggaagctcagctaagctctggtatccagaattgttttacaatcagtcatgtggccatggaatgcccgcgtggttgggcttagctatgyggtctccaggcccctgcccctccaggtcaaacggatgcagtggtccaggtccccagatgaaacaaaaacaggccttcaccataagtcacatcatcagcacaaactatgtggcattgcccaaggttctgggtatgaaatacactcttacctactaatagcaggatgttccaggggcttatgggtgatgctcgggagctgatcaggggcactgtggagtgtgcagggtttgagcacctcaggcctggtgaggtaactgttgaccacacacattcattgagacagaaaaagcattggcagctt

SEQ ID NO: 36246 - DNA, 601 bp, Human
acctcagagataacatgcattcagttctagagcactgcaataaagcgattatcacaacaaagtcatacattaacattatgatttagttttctggtttcccagggcatatgatgtttatactatactgtaataatagtgttcagcagcattatttctctttttttttttttttgagacagagtcttgctctgttgcccaggctagagtgccagtggtgcaatctcagctcactgcaacctccgcctcctgggttcaagtgattctcctgcctcagcctcccaagtagctggaatcacaggtrtgcaccaccacacctggctaatttttgtatttttagtagagatgggattttgccatgttgccaggctggtctcaaactcctgagctcaagtgatcgcccacctcagcctcccacagtgctgggattacaggcatgagccactgtgcctgaccagcattacgtttttttttaaatgtacataccttaatttaaaaataccttattgctaaaaatgctaacgatcacctgagccttcagtgagttgtaatctttttgctggttgagggtcttgccttgatgttgatggctgctgactgatca

SEQ ID NO: 36247 - DNA, 601 bp, Human
ggaagagagttagagtcttgctctggattaggctttggcttaagcgaggattgtggctgttttgatctgtctaggccattaaaactttctgcttatcagcaacagtgcagtttcactttcttatcattcatgggctcactggataacacttttaatttccttcaagaacctttccttcatttcacaagttggctaatagtttgacacaagaggctgagctttcagcctgtctcagctctctgcgtgccttcctcattaagcttaatcatttctaggttttgaagtgagggatgtgtgactsttcgtttcacttgaacacttacaggcattgtgggatcattaattggcctcattttagtattgttgtgtctcagagaatagggaggcccaaggagaggtgggatggccagttggtgaagcagtcagacacaaacatttataggttaagtttgccattttatgtgggtggggtttgtggtgcctcaacacaattacaatagtaacatcaaagatcgctaatcacagatcactgtaatagatacgctgtaatgaaaaagtttgaaatattgcgagaattaccaaaatgtgacacacacacgaa

SEQ ID NO: 36248 - DNA, 601 bp, Human
gagagttagagtcttgctctggattaggctttggcttaagcgaggattgtggctgttttgatctgtctaggccattaaaactttctgcttatcagcaacagtgcagtttcactttcttatcattcatgggctcactggataacacttttaatttccttcaagaacctttccttcatttcacaagttggctaatagtttgacacaagaggctgagctttcagcctgtctcagctctctgcgtgccttcctcattaagcttaatcatttctaggttttgaagtgagggatgtgtgactcttcrtttcacttgaacacttacaggcattgtgggatcattaattggcctcattttagtattgttgtgtctcagagaatagggaggcccaaggagaggtgggatggccagttggtgaagcagtcagacacaaacatttataggttaagtttgccattttatgtgggtggggtttgtggtgcctcaacacaattacaatagtaacatcaaagatcgctaatcacagatcactgtaatagatacgctgtaatgaaaaagtttgaaatattgcgagaattaccaaaatgtgacacacacacgaactga

SEQ ID NO: 36249 - DNA, 601 bp, Human
cctcccacccccatgcagaataacctgctgtgggaagcacattatttctagctgtggccaagtttatgcctcaggcttaaaaatcatctcacactcattctgtaaccgatttccccttctcctttgggcaagtatgattttagcaagattctattaatataattcagtctctagatatgtagttatgaaattcagcagaacattggagatttgtttcacagtagtagcaataattcagaagctttgcttctgatgcgattatgctgaaaaatattttacagaaatagtttttaaagtttcrtgtgtttgtttgtctttccttgaatgatgtggaccagatattgaattctcacatctcatgagtaaaatgtttggttcagaaacaattttctgtgtgttcattgccatgactactggtagatgcttcgtaatactgatggaggacattaggtcgctccataactacaggtttttgtttgagttgatgttcttcagcatgcatttatctgcagttacacaaccagcctttagtgtcatttattcctgtgcttttcagacttttttgactcacatggaatatattttatgcagtgacctcaac

SEQ ID NO: 36250 - DNA, 601 bp, Human
atgcttcgtaatactgatggaggacattaggtcgctccataactacaggtttttgtttgagttgatgttcttcagcatgcatttatctgcagttacacaaccagcctttagtgtcatttattcctgtgcttttcagacttttttgactcacatggaatatattttatgcagtgacctcaacaggcatgtgtttctgtcatttttctttacactcacagatattcacatgtagacacacacctgacacaggtgtcattttctagaataacacctatagatactcacctgtagacacacaccygacacaggtgtcctattgtagaataacacctgcagatactcacgtgtaaactcacacacctgacacaggtatcatattatagaataacacctacagatatgtgtagacagacacctgacacacaggtgtcatattctagaatgacaccagtccctgcacatctcacgaggctgcaatgtcttttctgatcttttcctttgttcctttttttccccattccattttttaaattatagcacagattaataatatagcaccctgtataaatcttttttgttgtttaagtatttttctttaatg

SEQ ID NO: 36251 - DNA, 601 bp, Human
cttatttcttatattccagaattaatgaaaaagtatttgataaattaggaataataaaaatgtggacagatctcattaattttcattataattgttttgttaagccatcacatagaaatttgcaaaactggaatctgttgtttataaaagctgagtcagccaggtacagtgtctcacactgtaatcccagcacttgggagactgaggcaggaggatcctttgagttcaggagttctaagaccaacctaggcaacatagggagaccctgtctctacaaaaaataaaaaagttagctgggcaygatggtgaggtggtgcgtacctgtggacgcaggcgtgcgggagggctggggtgggaggattgcttgagcccaggagtttgaggctgtcctgagctgcgattgtgccactgaactccagcctgggcaagagagcaagacttcatctcaaaaaattttttcaaaaattttaaaaatgattttttcaagtggtggtggcatcccattaagatgatttgaaaaccgaattggttgtgatccacggtttggaaaaaatggtttaattccattaaaagctagaaacactttttgttgttacgaatt

SEQ ID NO: 36252 - DNA, 601 bp, Human
taaaagtctgtcagcacctgttgttgaggctgtggggaaacagaggctcgctcacgtaattgctagtgagactgtgacttggttggactttctgtaggggcattgggcagccctaacaaatgcatgtgtgctcaccctggggaccagccctgaagatgcccctccagcctcccaaggtttagctgcccacgctttccactgcagcagagccatcattgcacagtggagacctgagtgcccgcatgtgggaagcagaggatgagttctgggacatccccacagagggtgctgtgctacagtrggcaggaggcagaattccagcagggtgctctgatatccagcccagggcgccgtcttccgtgtgaagggaatggggtgtggaaggggtggaacacagaggagcgtgcagcacggatgcctagccagcaccactccagcccagcggccgtgggcagcatcagcacccacacatcaagactgcttctgtccttggcagtgtgggatgaaagtggcacttttcccaaaaaccccgtaacatgagaaaaacagacaaattccaagtgagggatagcctgcgaaatttctgaccagccatggccag

SEQ ID NO: 36253 - DNA, 601 bp, Human
cagaaactggaatccttggatccctgtgaccaggatggcttttttggagtgtggagtagagcacatgggctttggatgtattgcaggccagtggtgtcagcagtgacggccctgtccgggccaggaagcccagggccccacctgtggtgcttgcggtggctcctctcccaggtccctccaggggctggtgagccccgagaccctcagtcctccctctctgtcctgaagggagcctgtcgcttggctgcttgggttctttttcatttttaaatttcttttactttcactttaggttcggagrtgcatgtgcagggtttgttatacaggtaaactcaggtcacaggggattgttgtacagattatttcatcaccctggtactaagctaagtagccaataatttttcctgctcctctccctcctccctcaaggaggccccagtgtgtgtgatttgctcctctctacgggtccatgtgttctcaccatttagctcccacttatcagtgagaacatgtggtatttggttttctgtttcaagatggattgaagactgaaatgtaaaacccacaactctaaaaaccctggaagacaacctagacaata

SEQ ID NO: 36254 - DNA, 601 bp, Human
attgcacatcctcaggtgcctgcaagggcagcagctatcagatctttgagaaatttgcagtcacgtgaatgcagtatctctggcaagttgccaatcacaacaggagaagggaacagtttcctcttggctttaaaagcctctgtcgtatcaccgggagaacgcacttcagaatcatgggcattccgtgaggacttgtgggtgagagtcactgaacgggtcccagctgggtgccgcagggcctcaggccacaacctatgggtggcctcaggccacgacatatgggtggactcgtgtgtgaaayggggacaggatcccccacagccaacggagagagctcacctggactcctgcactaggctcatggcatgacgcccttggtctcggttaaagctgatgaaggagatatttctacccctatttgggacacagatgtggccaagccatatagctagcaggcagtaaagctcagatggggaccggagtctccccgagaagccccagtgttgtcactctgttgtcactaccgatgcattgaagtccttaagaacacaaatcacagattagcctttgattttgtccttgccactgacttgaactttgc

SEQ ID NO: 36255 - DNA, 601 bp, Human
gcattccgtgaggacttgtgggtgagagtcactgaacgggtcccagctgggtgccgcagggcctcaggccacaacctatgggtggcctcaggccacgacatatgggtggactcgtgtgtgaaacggggacaggatcccccacagccaacggagagagctcacctggactcctgcactaggctcatggcatgacgcccttggtctcggttaaagctgatgaaggagatatttctacccctatttgggacacagatgtggccaagccatatagctagcaggcagtaaagctcagatggggacyggagtctccccgagaagccccagtgttgtcactctgttgtcactaccgatgcattgaagtccttaagaacacaaatcacagattagcctttgattttgtccttgccactgacttgaactttgcagtgatttgcttcctcttgtttctagtctcgaaagctgttttgatcttgtttcttggtttctgtgtgttgtctcccaggagcacatgcagacacaccaggccggcccctctttgagctcccagaagccaagagtgtttaaatgtgacacttgtgagaaggcatttgccaaaccaagc

SEQ ID NO: 36256 - DNA, 601 bp, Human
ccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaarctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattactt

SEQ ID NO: 36257 - DNA, 601 bp, Human
acggggtttcactacattggccaggctagtctcaaactcctgagctcaagtggtccacccacctcggcctcccaaagtgctgggattacaggcatgagccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgcc

SEQ ID NO: 36258 - DNA, 601 bp, Human
cagagaattagtgcagatgcaagtgtacacatatatatacacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaaccycagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataa

SEQ ID NO: 36259 - DNA, 601 bp, Human
cacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcrtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtat

SEQ ID NO: 36260 - DNA, 601 bp, Human
gatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttgsttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattcttta

SEQ ID NO: 36261 - DNA, 601 bp, Human
tttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgc

SEQ ID NO: 36262 - DNA, 601 bp, Human
acatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctg

SEQ ID NO: 36263 - DNA, 601 bp, Human
ttgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgct

SEQ ID NO: 36264 - DNA, 601 bp, Human
ttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcat

SEQ ID NO: 36265 - DNA, 601 bp, Human
ggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctc

SEQ ID NO: 36266 - DNA, 601 bp, Human
tacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtgatcgcctgcctcggcctcccaaagtgctgggattacaggtgtgagccaccgcgcctggtgccttgtctgtttttatagtacaatctaaataggtgg

SEQ ID NO: 36267 - DNA, 601 bp, Human
gtcatctgaagactatagttatttttttgtgagcatgtgctaatatgaggaactgcaccttgcctgttttttttcttttatttgagacagagtctcgctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaattt

SEQ ID NO: 36268 - DNA, 601 bp, Human
tcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaat

SEQ ID NO: 36269 - DNA, 601 bp, Human
ctaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggag

SEQ ID NO: 36270 - DNA, 601 bp, Human
tggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatrtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagag

SEQ ID NO: 36271 - DNA, 601 bp, Human
atgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatacttcatgttctgtcttataagtgggagttatacattgagtacacatagacataaaaaggggacaatagacaacaggggctacttttgagggtggaggatgcaa

SEQ ID NO: 36272 - DNA, 601 bp, Human
aataacttaaagtagaactaccatttgacccagcagtcccattactgggtatatacccaagggaatataaagacacacgcacacatatgttcatcacagaactattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtctaccccctgaacctaaaataaaagttgggggaaagaaaaactgaatccaagggaaaacgagaaggtaaaaatgtttaatga

SEQ ID NO: 36273 - DNA, 601 bp, Human
ttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtcttttttttttttttttttttttygtcctttttagggatctgcctgcctcagcctcctgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattca

SEQ ID NO: 36274 - DNA, 601 bp, Human
atgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtctttttttttttttttttttttttgtcctttttagggatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttga

SEQ ID NO: 36275 - DNA, 601 bp, Human
aattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagaggtaagtgttagtaatasggctgagtcgagatgggctaaagtatcctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttctcctcattcattgccttagcaccctcttttctggctaagtgaatcacactgaggcttctaaagtgccctgccatattttcccttttaaa

SEQ ID NO: 36276 - DNA, 601 bp, Human
gtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaatatatatacatatatatatt

SEQ ID NO: 36277 - DNA, 601 bp, Human
aaaaaatgttgaattctggtcgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgt

SEQ ID NO: 36278 - DNA, 601 bp, Human
atgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggagraaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgt

SEQ ID NO: 36279 - DNA, 601 bp, Human
aggtcacttatgtcccaggtgggaaaggaccttgtggctggaccggtggatcctgtcctcagaggtatgtaatatttcttgaaaatagccactgtttttgcaccataataaattatagccgggaatatataatgttattcatgcaaggtacataatacatagtagggtcaggggatggtagtcacattatgctttagtaagtgaaaatgcagacactaataatatttgcctcatatggtcatttttagaatcatttgagataatgcaatactatatttagcctagtgccttgtgccttatragcattcaataaatgttaattatcatgcttatttctatttttactatcactattacttttactctatatctggtcaacaatcctgtccttaattgcttatgaatttcatgcacagttttgaagatttattattttctcttcatgctaggtcagaaagaagtttataacttggttcatattctaaaattaggagagcttctagttacaattatgcatggaaaagcagctaggtgaagcttttcttcttgtgtctattgtaattagccatgtcatttgattatcattttttaaaaaagtcta

SEQ ID NO: 36280 - DNA, 601 bp, Human
agcatactgcccttctggattcaaggtgagctctttttatttttttcttttctttaaacaaaccataagtatttatctttattctcgaatcttatcttttttatgccttctgagtgggtgcattcattcgctatttttaatactcgtgtcataattgccactttttcttttattatgtctgagctacatgcaacagatattcagtttgccaaagcaggaacattgaccccaacaatagttcaactaactgcctgagctcatccttacaaactctatatacagtccctttccaaattgcttygcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtctctaaaggccggtctgttataatgctattgctccacatgttcacggtttacccatgtaggtgactgttgtctccatatagttgtacgtggcaaactccaggataa

SEQ ID NO: 36281 - DNA, 601 bp, Human
atattcagtttgccaaagcaggaacattgaccccaacaatagttcaactaactgcctgagctcatccttacaaactctatatacagtccctttccaaattgctttgcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtcyctaaaggccggtctgttataatgctattgctccacatgttcacggtttacccatgtaggtgactgttgtctccatatagttgtacgtggcaaactccaggataataacaagggaggctagcccacatgacatgggctaaaatcacagctctaccccttttagatatgggactttgagagagttatttcatctctctgttctttggattcctcgtcaggaaatgaggataataataatgccttcatcataaactaaaatgaaaattaagcaagatagtatgtacccattttacagacccat

SEQ ID NO: 36282 - DNA, 601 bp, Human
tcaactaactgcctgagctcatccttacaaactctatatacagtccctttccaaattgctttgcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtctctaaaggccggtctgttataatgctattgctccacatgttcasggtttacccatgtaggtgactgttgtctccatatagttgtacgtggcaaactccaggataataacaagggaggctagcccacatgacatgggctaaaatcacagctctaccccttttagatatgggactttgagagagttatttcatctctctgttctttggattcctcgtcaggaaatgaggataataataatgccttcatcataaactaaaatgaaaattaagcaagatagtatgtacccattttacagacccatttgataaatagcaactaaatattaaagtcacatgggtaagact

SEQ ID NO: 36283 - DNA, 601 bp, Human
tacagtccctttccaaattgctttgcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtctctaaaggccggtctgttataatgctattgctccacatgttcacggtttacccatgtaggtgactgttgtctccatatagtygtacgtggcaaactccaggataataacaagggaggctagcccacatgacatgggctaaaatcacagctctaccccttttagatatgggactttgagagagttatttcatctctctgttctttggattcctcgtcaggaaatgaggataataataatgccttcatcataaactaaaatgaaaattaagcaagatagtatgtacccattttacagacccatttgataaatagcaactaaatattaaagtcacatgggtaagactaatatggccaaattgtacttatgacttacatttacaaa

SEQ ID NO: 36284 - DNA, 601 bp, Human
tccttttctactggtgctggatgttgggagaaattgtggataagctataataggtactgaaaagaccatgtataactacagaagctttgtgtgcaaacacagaaagaataaaaatgctgtgatactaggttgtaaggaaaccacagttttccaaaataagaccaaacttttgttctccaaagagtgtcattatggaagacccttgacatggaaggaacaacttattcttttaagggatctaagaaggctctcttcaattcattaataagaggttgcttaatgggtactgatccctaagaartgggattatgactaagaatcaacaagaacctcctgctgatccaaagttggcatgtcacatatttttccatctttctaatcagtttttgccatttcttttaggctaaactttagctcttacaaacataaggttggttactgctaaaaacatctattcactgtgtttggcatggatctagtcatacaaaacaaggcactcaattaagaaatgtgacttaaagggctgtctttaagaatgcagctgaatatcccttaacaatggtggtgtaattttttaagggattgaaattcagtatcttta

SEQ ID NO: 36285 - DNA, 601 bp, Human
cattcagtaacacagaaagcaaatgattcatttttcttttcttacatcactttgggatctttgctttagtttgggtggtatggaaacctaagaaagattttttttaatgagatataaattcactaaaattctgaaataatttgaaatatctacattttattatatatactgaagtctttgactgaatattccatttggttgataaacatgatgtctctaactatagcctaacatattcatttttagttaaagtgagtcatattaatttacttccattgtgttatctacttcaagaataaaracgcagttaggggatcaagatagctagttgcatggttgtctcaatactattgatggagacattgaggataaatctgaagtgcattattatcccccaaattttctaggttatggtgtaaaatctattaaatatatcctaaaacattccagctattattaatattaaagaataataatttatatatgtgaataggctttgcctgaattttgtgctcttcaaacagtgggcttaaaagcaggctatgtttctttctggaggatcaacaggataatccatttcctgctaatccaagatgctggc

SEQ ID NO: 36286 - DNA, 601 bp, Human
aactagacctagaattattgtacacaagggtgtattactgaagtcagtagtagttccgtcatgtctttcatccaaaggaccttagttttatggttttagtatgttctagtatgttctgcaagtgatatctcctctcagatttattattcaaggaattgatcaccttttataaattatagtaatttttaaaattctataagtaaatgtagttaagaggtatttttattattacgtgttattaatgtttaatttcaaactttttatcttttagagatgcttaaagtctcatataattaaaacyatgtattattaattatttctttctctaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaagg

SEQ ID NO: 36287 - DNA, 601 bp, Human
atgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaagrcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaac

SEQ ID NO: 36288 - DNA, 601 bp, Human
caatattgctatatagaggcagtttatggaaaattctaccccctcacaaactttttttctcttgtgcatcctaaaaatatatggatgtatatatctgactgatagaaacactttctcctcaaacaagcagttaaagaaatacgcctttgatttatgtctggtatggtcatttaaatgaggctttaatacatgcttagtaacacgttttctgtgaaggttaaactaatggcaccattttgactgtgtgagaactgttagaacatgctcaaatgtattaagtaaaacaagatggcttttttayttatttaaattcataagtattggtgctttggatttacttcaggagtgcaccatttctgatttttatacagaaatgtatgtgcagcataaaaatgtgttatttaatgactgcaaaaaaacctatttcaaatcagctttttcttaataatatcctgcatagtgaaatgtaaattttttagtctgtttttagatctcagcctttgtaagtacaattggcattaattacacagaaaattgcctttgtctactttgctgcagtgaatatgactttatatggttttcgttttagcctttagaaact

SEQ ID NO: 36289 - DNA, 601 bp, Human
tgacataaccataataatcatagagtgctttgaattcctttatctctggggagatcaaagcaacatgcaaattatctttgaggcatttctgtgaggaaggtatcaaatgttatttttattctgtcctgatctaaatggagaaactgaggcaacaagaggctaagcaatttagagtaatttaccccagagaagagacaggcattgagacacgtgcacctttgctaagtttgatggatggcctttctcttctgctaagactttttgtaactgagataaaaatgacgaagatataaggaaagacaaataagataaaaacatgaaaattaactcttgccattttttcctctaacagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcat

SEQ ID NO: 36290 - DNA, 601 bp, Human
tccttcgaccaccccgacccccctccccaacgtaccgatccagtccccgaccctgggagactcaccctgccactccaggagccgctcgggggtaagcgccgccgccacaccctcggcgcagccccgcggcgcccccagcagcagcagcagcagcagcgacggcgacagcagcatcgctaaccactgggctctccgggagccccttgtcccgggagccccttatcccgggagcccagagccgcgtcccaagcacccggccccgccgcgcggaagcggatccgtagcctcctccgcgccccacccctccgggggccttgccagcccagagccctggagacccactccgccaccgctgtctccacagtgaaccgacactcggggctctgggctgggatgcgggaaagtcgcggaggttttcctcgccccacccactgcggcttggggaaggaggaggaggaggggtgggccatctgcccatcccagaaattcctgcctttggggtggggacaggcggagtgaggctgctcgggtcacactctccgctcctctagcttgcagccctgctctctcctttctgggggaggccgaagaggagttgtgg

SEQ ID NO: 36291 - DNA, 601 bp, Human
acaaacgcggccgcccttgcccgccagcttggcccctagcttcgccccttcttcctctccttcgaccaccccgacccccctccccaacgtaccgatccagtccccgaccctgggagactcaccctgccactccaggagccgctcgggggtaagcgccgccgccacaccctcggcgcagccccgcggcgcccccagcagcagcagcagcagcagcgacggcgacagcagcatcgctaaccactgggctctccgggagccccttgtcccgggagccccttatcccgggagcccagagccgcgwcccaagcacccggccccgccgcgcggaagcggatccgtagcctcctccgcgccccacccctccgggggccttgccagcccagagccctggagacccactccgccaccgctgtctccacagtgaaccgacactcggggctctgggctgggatgcgggaaagtcgcggaggttttcctcgccccacccactgcggcttggggaaggaggaggaggaggggtgggccatctgcccatcccagaaattcctgcctttggggtggggacaggcggagtgaggctgctcgggtcacactctccgct

SEQ ID NO: 36292 - DNA, 601 bp, Human
aaatctttacttataggcaaaccttaaaaaaacaccattccctgagtgcttctttaaattatttttacctttgtgtagatattcacaaatgtctccaccacctgacccataagaaatccacttatgaatatacttccgtgaggccaccactgtgttgtcatgcgccacctggacagagtactgcagcgggcctgtgatcatcttcctgttacagcgccaccgtaaggaaacgagggtggagtcacattcatataagcttaatggctgctctggggcggagaaattcaggcccaggcaaccrctgcctcctatgttaaagaggccatggtttgaaacccatttccacagcatgtgcttgtttgcttgcttgcagttctccagggtcagaaccgatttacctgcttgaatgcatttcttgagactctcactttggataacaaatattcctttatctgaaacaaaaatcaaagatgtggcatgaaattttcatatataattaactagcgtcatgaggatctcagtgtgcatatctaagtgcgatatgcgacagttgccagccatttcccacagatctggagttgttgggcagggtccacctgaa

SEQ ID NO: 36293 - DNA, 601 bp, Human
tccttgctctgcttcccaggaccgtacagaattcttaggagcatatgctcttgtgaaagcataattctacagagcagcacgagggtaggggctccacctgtcctgtggacctttgtaaaccaggtgcctagtccagtgcctgatgaatgtggggtggatttgttagcagtgctatacaaaaatgcgggatgaatggatggatggatggatggatagatagatggatggatggatagagtgagctaccaaacaaaacgctgagggacaggtttgagatttgaatttaactatgtaactttcttttttttttctgtttagaaatgacaaaaataaccatagaaaatgaaattcccctctaaaccatgcttccccaccaaccatgcttggcacacaccaaataacccccgacaatagtctgtcatttctcttcaagtgacttgtaacatgattaatcacatgaatgccagccagcatcaggaggcattggaggtgtcctggacacatacctccataggtggggatgagtttttacaataagagaaatggcggcaggggaggagagattattatatttgtcatgacaaaagtcttcaaagatctt

SEQ ID NO: 36294 - DNA, 601 bp, Human
gatgtcagctttatctttggaaactgctatatatcgaaagcattttttatggactgaaaccctcttggggcagatactcactacagcagagtgagccctcaggtcctcactgtctcctgtcagtagaggtgtgagactgagtgctgggctcagaggaagtgctgatacatggtttgcttatgcatttatctacttgtttacttactatggtgagctgtcacagtaacattcatatttgtggatggatgagaaagaaactttaatggagatttaacttcataataccttccagtcgccaaayacatcagccattagcatctaaagctcaatagattcataggcatttattaatttattcattcaataaatatttattgaacatttaatgtactcagtactggggatacaacagtgaacaaaccagcaaaagttcctttatgtggaacttctatcaaggagagagaaagagaaagcaaatatacaagtaaacatacagtatcattgcaggtagcggtgccatgatgaaaaataaataggatgagaagacagagtggggtgtgtgtgtgcgtgtgtgtgtgtgtgtgtgtgtgtgtgtatgtgt

SEQ ID NO: 36295 - DNA, 601 bp, Human
tgtcgtggcacaccacagtaagtcatcttcccgaccttcacgggtacattcatgatgccactgatggttatactggaagggaaacatacacggcatcccgtgggtgttccctttgattgtatgcaaatctaggagaaagaaatgtacaaagtcagataagtatgatgtcagctttatctttggaaactgctatatatcgaaagcattttttatggactgaaaccctcttggggcagatactcactacagcagagtgagccctcaggtcctcactgtctcctgtcagtagaggtgtgagacygagtgctgggctcagaggaagtgctgatacatggtttgcttatgcatttatctacttgtttacttactatggtgagctgtcacagtaacattcatatttgtggatggatgagaaagaaactttaatggagatttaacttcataataccttccagtcgccaaacacatcagccattagcatctaaagctcaatagattcataggcatttattaatttattcattcaataaatatttattgaacatttaatgtactcagtactggggatacaacagtgaacaaaccagcaaaagttccttta

SEQ ID NO: 36296 - DNA, 601 bp, Human
tttctaatcatctttgattcattcatgacatatagagaagacaaaatttattcttactgggatcagggcaaaatccccacttttcatctctttcataacggcttgtcgtggcacaccacagtaagtcatcttcccgaccttcacgggtacattcatgatgccactgatggttatactggaagggaaacatacacggcatcccgtgggtgttccctttgattgtatgcaaatctaggagaaagaaatgtacaaagtcagataagtatgatgtcagctttatctttggaaactgctatatatygaaagcattttttatggactgaaaccctcttggggcagatactcactacagcagagtgagccctcaggtcctcactgtctcctgtcagtagaggtgtgagactgagtgctgggctcagaggaagtgctgatacatggtttgcttatgcatttatctacttgtttacttactatggtgagctgtcacagtaacattcatatttgtggatggatgagaaagaaactttaatggagatttaacttcataataccttccagtcgccaaacacatcagccattagcatctaaagctcaatagatt

SEQ ID NO: 36297 - DNA, 601 bp, Human
gacacgtcattttgagttatattggctaccgggagccaaaagtaacaagaaaggaagaaaactggcactgaacaaataaacatgctctctgctggttgtggtaaagggcaggagggctggaatctggcaggctgtcaagcagaggaagcttctgagctgtacaaggctgaacaaatagatggtctggggaatgaaaagcctggagcaccactgaacccaggcttccactgggaaactgtcattggaagtttcccagtggaaacttcttaaggtttcagaaccttaagaagaatattgtagtttttttttttgaagtccctagtattagagccatgtgaagtacgtgttaactttattagtattggttcatttatttggttttaataatgacctctattggggatggaaaaggaaaaagaagagatgatgcaaataatatgacaataataaaaataatatgacatctgtttcaggagtcaaggggtgtagagatcacatgcatacacacctacatgcatacatttagattcaaatagagaaggctggtgatctgacagttataaaataataaaatgctttcattctggttggtgaatagcca

SEQ ID NO: 36298 - DNA, 601 bp, Human
atatttaaaaaaatttcccacataagaaggatgagatacagcagtacagacctttactttattccactcactcttctctgtcctatccacttgttgaccccatggaaagagctatcagcttgctcaggtttcaatctccgacacgtcattttgagttatattggctaccgggagccaaaagtaacaagaaaggaagaaaactggcactgaacaaataaacatgctctctgctggttgtggtaaagggcaggagggctggaatctggcaggctgtcaagcagaggaagcttctgagctgtasaaggctgaacaaatagatggtctggggaatgaaaagcctggagcaccactgaacccaggcttccactgggaaactgtcattggaagtttcccagtggaaacttcttaaggtttcagaaccttaagaagaatattgtagtttttttttttgaagtccctagtattagagccatgtgaagtacgtgttaactttattagtattggttcatttatttggttttaataatgacctctattggggatggaaaaggaaaaagaagagatgatgcaaataatatgacaataataaaaataatatgac

SEQ ID NO: 36299 - DNA, 601 bp, Human
agtgctgggattacaggtgtgagccactgtgcccagcctaaatctgctttattatatcactcgagcaactgatcagaattatataaaaataaggttcaagggcaatcatatcatttcacaggttggtatcgtaaaaatatctcaaattaactaagtgtgattctgcagctctgtaaggcacacaaccaagagagtccagaatggcccataattgcctctaaacaaacccagagagattcctgtgtgtcatcctttttgctgaagatgttttattacatccttcaccgctagtatatttgtrtatgtgtttatgaatactacatttaaattttgctcatttacaatcaactttttttttaaatgtagcatcattttacattgagatatttaaaaaaatttcccacataagaaggatgagatacagcagtacagacctttactttattccactcactcttctctgtcctatccacttgttgaccccatggaaagagctatcagcttgctcaggtttcaatctccgacacgtcattttgagttatattggctaccgggagccaaaagtaacaagaaaggaagaaaactggcactgaacaaataa

SEQ ID NO: 36300 - DNA, 601 bp, Human
ccaaagtgctgggattacaggtgtgagccactgtgcccagcctaaatctgctttattatatcactcgagcaactgatcagaattatataaaaataaggttcaagggcaatcatatcatttcacaggttggtatcgtaaaaatatctcaaattaactaagtgtgattctgcagctctgtaaggcacacaaccaagagagtccagaatggcccataattgcctctaaacaaacccagagagattcctgtgtgtcatcctttttgctgaagatgttttattacatccttcaccgctagtatatwtgtatatgtgtttatgaatactacatttaaattttgctcatttacaatcaactttttttttaaatgtagcatcattttacattgagatatttaaaaaaatttcccacataagaaggatgagatacagcagtacagacctttactttattccactcactcttctctgtcctatccacttgttgaccccatggaaagagctatcagcttgctcaggtttcaatctccgacacgtcattttgagttatattggctaccgggagccaaaagtaacaagaaaggaagaaaactggcactgaacaa

SEQ ID NO: 36301 - DNA, 601 bp, Human
ctcatttccccactttccattttgacaacttctactcatctcttgggctacagttcaaatacaacttcctcaggaaaaccttccatgactcccaattttaacttcggtttctcacttgtaatactgtattttcttaaggtagaacttatgacaaactgtaattatgtattaatttgggtattatacttgaatgtgaatttcatcagggcaggcactatgactttcacatttcacattcacggttataaccccaggagccagagaagtccctggcacatagtaggtgttcaatacatatttkttaaatgaataaatggatgaatggtctgtggaaatggaggtcaaggtcaggcatgcattgttgtagaagtcaagaggagacagtgccctgaagaaggtatagacaattcttttgcgaattctctctatttagaggatgagagagagaggtgttttcaggaggcagaaatagggatgaaagaattgcagtatttttaagatgttatttcaagactcgcacaggtctaactgctaaggaaaagggcccagcaaagaagcacccaggggtgtgcactggaatcacctagaagtttgttaaaac

SEQ ID NO: 36302 - DNA, 601 bp, Human
ttgctttaatcagctactccaacacctgacagctctgctgtctccagcccagctaagctcctgacaaccaggtcctgttcagtttatctacaagttagatcttcaataaatccacatttttccaatccccttgctgccacctaactgaagccaccactactcctggcccagactattgctctagccttctacctggtctccaggatttgcctattgctcccttccaagccattcagtataatagagccagagtaatccttaaatatatatttttaaaatcatcactcccctgcttaaaacycttttgatagctttcttttgcacttagaattaggtaagtccttacctttatgacactcatggactctgtctgccctttcagagtgtcttgtttctctcttcttcattcactgtactcttgccacattgtctttcttagatggcaataacctctttcccccctcaaaaccttcagatatctggccagtgacatgctgagggctgggggtggaggagcagtcagcctggacaggtgggcgtattttatcactgacattgtttggaatggttagagcatgtgcctggtgactcaaaagcatgc

SEQ ID NO: 36303 - DNA, 601 bp, Human
tgttgttgtttagtgttctctcaatagtgagctgagctgaactccacatctgtgctgatccactgaccctcgatggctgtgctgttccctggggaaaaatggaacgggggaggtggcgaattcttcttttagtctctttgttataccattgtagtgagtgatcaacagcttaacaccttcatttttggcttgttgctttaatcagctactccaacacctgacagctctgctgtctccagcccagctaagctcctgacaaccaggtcctgttcagtttatctacaagttagatcttcaatamatccacatttttccaatccccttgctgccacctaactgaagccaccactactcctggcccagactattgctctagccttctacctggtctccaggatttgcctattgctcccttccaagccattcagtataatagagccagagtaatccttaaatatatatttttaaaatcatcactcccctgcttaaaactcttttgatagctttcttttgcacttagaattaggtaagtccttacctttatgacactcatggactctgtctgccctttcagagtgtcttgtttctctcttcttcattc

SEQ ID NO: 36304 - DNA, 601 bp, Human
agtatatgttcaccagaattagcaagaaacattagactattttcatcattaaaaaataccttggttggaacaggtttctgtctttatgaacagacttctgtttttccaaacaattcccaaagactaattatagaactgaggtagttaaatcaaagtccctgacatgtcttatttttttaaatggttattcaaatttgatgaataagtccagaccttctcatgagaaatcctggcagttaagatagataattgtaattcataaatggcatgtaaacttttatataaaaaccatttcaggctkaaaatgattttgaaaattgatgttttcctgcactatgacttactcaaatcaaattcaataataatttctgacttttagggtgggcacacattgctcattcatttcttacaatccttctggaagatattaacaacttacaaaagctttaaagtgtgcttacttttccatccagtgaacccacttctgcaaacttatagagaaataattggggatgtatgcacaaaggtttgtgcagggatggtttataataccaactaataaatacataacaaaacaaatagttttatcaatatctctaat

SEQ ID NO: 36305 - DNA, 601 bp, Human
tagtatatgttcaccagaattagcaagaaacattagactattttcatcattaaaaaataccttggttggaacaggtttctgtctttatgaacagacttctgtttttccaaacaattcccaaagactaattatagaactgaggtagttaaatcaaagtccctgacatgtcttatttttttaaatggttattcaaatttgatgaataagtccagaccttctcatgagaaatcctggcagttaagatagataattgtaattcataaatggcatgtaaacttttatataaaaaccatttcaggcytaaaatgattttgaaaattgatgttttcctgcactatgacttactcaaatcaaattcaataataatttctgacttttagggtgggcacacattgctcattcatttcttacaatccttctggaagatattaacaacttacaaaagctttaaagtgtgcttacttttccatccagtgaacccacttctgcaaacttatagagaaataattggggatgtatgcacaaaggtttgtgcagggatggtttataataccaactaataaatacataacaaaacaaatagttttatcaatatctctaa

SEQ ID NO: 36306 - DNA, 601 bp, Human
ctgtggcattcatatggaatctctttctaatgtctatttgattattcctttcaatagcaccattcgattgaatcgtttagcaggtcttatgatgataagaagtgaaatggattgacagggcagggagaaattttcacgtttcacatccaggcaagtgccaagtgatattttaaaatctagttaaaatattaaaacgttaattattcttatcttagaatttttttgaatacccattgtgcaattgttttaataatgcagataaaaaataattgtgcaatttataacctgtgtctgaaggcayaaaaaaccatctatttacctttaggactaagctggcccacgatactgtaataagaaactcgaatttaaattcctttggatatttctcggcattcatgacagcttagataattccttgtaccatagtatatgttcaccagaattagcaagaaacattagactattttcatcattaaaaaataccttggttggaacaggtttctgtctttatgaacagacttctgtttttccaaacaattcccaaagactaattatagaactgaggtagttaaatcaaagtccctgacatgtcttatttttt

SEQ ID NO: 36307 - DNA, 601 bp, Human
ccagagtgtctcgggggatccctagcaggttgggacctaaggctgtgtgcagtgcaaactggaggctgcttccacagcttgaggtgggagaagtttaatggcaggctggctctgtggcccctcctcttaaccagtccactacaacttgcagtttaatgcaataccatttttgttatagatactatgaataaaaacatgcattgacatgcagaaagacatagttatcaaaattaaagaattatgggaatttttcctcagtttttctttttgtgcacctaaattttaaacattattccagaayaaataggtactacttatgcagcaaaatttcggggggaaaaaaaccaaaacctagtgtcagaaacataatgaaagtggcaattttgtgatgctttgaaatgttgccatttactcgtttaatctataaaggagagcattgttcgcttacaattcacctgattcagagcccaatttatttttagtcagacgcaggggtcctgcctaagattaagaccctgacggataagggttataaacagggtgaccgtatgcccccattttcctggaaaactcatggttcatgctggtatttccagaataa

SEQ ID NO: 36308 - DNA, 601 bp, Human
atcccagctactcgagaggctgaggcagaattgcttgaacccaggaggcggaggttgcagtgagccaagatcgtgccattgcactccagcctgggccacaaaagcaagacttcaatcaatccacagaagaatgtgttgaacttgaagcaaagcaaataatccaaacaagctaacttaactactcccatttctggtcttctgacctcaattagcagatagaaggataaatataacagaaggaaagaagggtggcaggagggaatgcaagatggcataagaaggaaagaaagaaaaaatgaawagagaaggaacggagaaaggaatatgaaagaaggaagagagggagggaaaaggacaataacaggtggtagcaatttcagcaaattcctgaaataatggaaaaatctctacataaaaaaatgacaagttgcttcttctttccccagcttgtaccccatattctacaaaacttctaggcttagctatttaaaggaaaatgaaagttaaaacccaattctaagagacaatatttaaaaatgacaattcagcttattattttaaatctagagttttttctaattatttttgtaatgattcttta

SEQ ID NO: 36309 - DNA, 601 bp, Human
cacatgcttattttggctttcctttctcacgagactgtccccaatctgatgatggcatttttaccttattttattaaccacaacgaggtgcctccattaagaacgaatttagttaaactaaatatgatttcactgctatttgggaaacaaaacattcttttaaaattgtttctaggactctggcagcaattagaatcatggccaaagagtgttagaactttgtatatcattgaccccaatggttttcagcctaaaaaagcactcatgaaatcctttttgaacttggaattttaggctgcgygtggtggctcacgccgtaatcccagcactttgggaggctgaggtgggcggactgcctcaggtcaggagttcgagaccagcctggccaacatggtgaaaccccgtctctataaaaatacaaaaattagccgggcgtggtggcaggtgcctgtaatcccagctactcgagaggctgaggcagaattgcttgaacccaggaggcggaggttgcagtgagccaagatcgtgccattgcactccagcctgggccacaaaagcaagacttcaatcaatccacagaagaatgtgttgaacttgaagc

SEQ ID NO: 36310 - DNA, 601 bp, Human
gagctgctccatctacccttcctggttgttgctgtgctgtgcccctcagagcctgagctggcttatcaccctgcctccaaagaaatggtgccttggcctcccagagtagtcatgttccccagtgtgtgtgctgaagtggcaccctgcctcccagggaatccctaccctggctgcccaaaacagtcacaccccaggcacctgagctgaagtggctctcaaatccaggggaaacagtgctttagctgcccaaagcagtcataccccccagcacctaagctgaagcagccccatctcatggggraatgggtgccttggctgagctgagcagagcagctgtgccttgtagggcttggctgatgtggtaccctgcatccaagggaaacagcattggcaaggctgggacatcctgccctccaacacaaacagctgtagcaccttgccttcctggaactggactagtcccacaaagcctgaactgctgaggcaccccaccttcccagggagaggagtcatcattttgctgctccttgacccccaggaaacaaaccacaggtatatgccaccattcctgggtccttgctgctactgaacctgacctcac

SEQ ID NO: 36311 - DNA, 601 bp, Human
tcagaggcctttgaacaacagcaactccatcttgtttaggagctgggtaaaataaggctgagacctactgagctgcatttccaggaggtcaggcattctaagttacaggatgagacagaaagtctcatcaagaaagcttgctaataaaacaagctgcagtaaagaagctggccaaaacccatcaaaaccaagacggtgaggaaggtgacctctggtcaccctcgctgctcattatatgctaattataatgtattagcatgctaaaagacactcccaccagtgccatgacagtttacaagcygtggcaacatcaggaagttaccctacatggtctaaaagggggaggaaccctcagttccgaaaattgtataccccgttcccagaaaactcatgaataatctaccccttgtttagcatataatcgagaaagaactgtaagtgtaatcagctgagcagcccaagctgctgctctgcctatggagtagccattctttattcctttactttcctaataaacttgctttccttttatggattcgcctccaattctttcttggggtttggatcaggacccctttctggtaacacctgggatctcatc

SEQ ID NO: 36312 - DNA, 601 bp, Human
cattttccggatgagctagtgaaggtacaaagaagtaaggagaggagggatggcagcaagatggccgatagagacacctgtgtcagaggcctttgaacaacagcaactccatcttgtttaggagctgggtaaaataaggctgagacctactgagctgcatttccaggaggtcaggcattctaagttacaggatgagacagaaagtctcatcaagaaagcttgctaataaaacaagctgcagtaaagaagctggccaaaacccatcaaaaccaagacggtgaggaaggtgacctctggtcaycctcgctgctcattatatgctaattataatgtattagcatgctaaaagacactcccaccagtgccatgacagtttacaagccgtggcaacatcaggaagttaccctacatggtctaaaagggggaggaaccctcagttccgaaaattgtataccccgttcccagaaaactcatgaataatctaccccttgtttagcatataatcgagaaagaactgtaagtgtaatcagctgagcagcccaagctgctgctctgcctatggagtagccattctttattcctttactttcctaataaactt

SEQ ID NO: 36313 - DNA, 601 bp, Human
atatttccacgcatctttttctttttaaaccaacaaaaaacaatgtcattttccacaattattttaacattacttattacagcttatgtaaattgccattaatatgattactttaaaaatgtgaaaaacagaaatatacaaaatgacatatatcatggaattctagatcttcagagttgagaagggtctaatctatgatctagatttagatctaggatcaaatgaacctcagtatttcattttccggatgagctagtgaaggtacaaagaagtaaggagaggagggatggcagcaagatgrccgatagagacacctgtgtcagaggcctttgaacaacagcaactccatcttgtttaggagctgggtaaaataaggctgagacctactgagctgcatttccaggaggtcaggcattctaagttacaggatgagacagaaagtctcatcaagaaagcttgctaataaaacaagctgcagtaaagaagctggccaaaacccatcaaaaccaagacggtgaggaaggtgacctctggtcaccctcgctgctcattatatgctaattataatgtattagcatgctaaaagacactcccaccagtg

SEQ ID NO: 36314 - DNA, 601 bp, Human
aaaatgaaataaataatttcagtatttttcagcataagtctatgtcaaatacatgacacagtgaagagcaggccaactctgagggactcaggctgtgcggaagccaggagcctaaaattcctatacatggggaacagtctgaacatcacctcaccaaataaattacccatgttcactggcgaaaattgtttacatctaattatttgcctaaggggttccctttattatgtggattacatgttaacaacacactactgctatctagtggccataaagctaaattacaggtttaggtttttcrttagaagttttaggaaatgaactttcctactttccaaaaatttaaaaatcatctaatatatgtggcatatatgaagatgttacaaagtttctgaacatgtattttgtaaaaatccaataaatttgaactcctgaataacatttagaaactttaaatatatgtgcaatgaataaccacttttaaatagcttaaatttcttttcaactccactaataaaagtagttactacattatattttatgccttttaaaccaaaggcagctgggactcaccatctccaaggagggttacaagaaactc

SEQ ID NO: 36315 - DNA, 601 bp, Human
tatttttaaaaaactgaaaaatgaaataaataatttcagtatttttcagcataagtctatgtcaaatacatgacacagtgaagagcaggccaactctgagggactcaggctgtgcggaagccaggagcctaaaattcctatacatggggaacagtctgaacatcacctcaccaaataaattacccatgttcactggcgaaaattgtttacatctaattatttgcctaaggggttccctttattatgtggattacatgttaacaacacactactgctatctagtggccataaagctaaattccaggtttaggtttttcgttagaagttttaggaaatgaactttcctactttccaaaaatttaaaaatcatctaatatatgtggcatatatgaagatgttacaaagtttctgaacatgtattttgtaaaaatccaataaatttgaactcctgaataacatttagaaactttaaatatatgtgcaatgaataaccacttttaaatagcttaaatttcttttcaactccactaataaaagtagttactacattatattttatgccttttaaaccaaaggcagctgggactcaccatctccaagg

SEQ ID NO: 36316 - DNA, 601 bp, Human
gcaaatgattaggaaaaataacagagaaggatgcatgtttttactccaaactaaaatgtaacaattgaaaaggtcatcaaaggagatcctggacatttttttgtatttttaaaaaactgaaaaatgaaataaataatttcagtatttttcagcataagtctatgtcaaatacatgacacagtgaagagcaggccaactctgagggactcaggctgtgcggaagccaggagcctaaaattcctatacatggggaacagtctgaacatcacctcaccaaataaattacccatgttcactggckaaaattgtttacatctaattatttgcctaaggggttccctttattatgtggattacatgttaacaacacactactgctatctagtggccataaagctaaattacaggtttaggtttttcgttagaagttttaggaaatgaactttcctactttccaaaaatttaaaaatcatctaatatatgtggcatatatgaagatgttacaaagtttctgaacatgtattttgtaaaaatccaataaatttgaactcctgaataacatttagaaactttaaatatatgtgcaatgaataaccacttt

SEQ ID NO: 36317 - DNA, 601 bp, Human
ttgaggcgattctgctaagtgaaataactcagaatgtcaaatactgcgtgttcttacttataagtgggagctaaacaatggggacacatggagatacagagcaggataaaaaacactggagattccaaaaggtagcagaggtgaggctgagggttgaaaaatcacctgttgggtacaatgttcaccatctaggtgatggggccactaagaggccagacttcaccactgcaatatatgcatgtaagaaatactcacttgtacctcttaaacctattttttaaagtatttttttcctttttcttttttctgccataggaaaaaaggagcaaaacctcttaaaggcattgaaatggagttgctgcaaaagtaattaaaacttgacagcctaggtaggaaaggaccctatgtggctgaaagagatgtgtaagtgcccttgttgagataagcagcccacagggttctttaatcccaaatgcaaatgattaggaaaaataacagagaaggatgcatgtttttactccaaactaaaatgtaacaattgaaaaggtcatcaaaggagatcctggacatttttttgtatttttaaaaaactgaaaaatga

SEQ ID NO: 36318 - DNA, 601 bp, Human
ggagggttggataaagaaaatatggaatatatatatacacatacacataccatggaatactactcagccatagaaaagaatgaaatcatatctttcgcacacaggtagcacttgaggcgattctgctaagtgaaataactcagaatgtcaaatactgcgtgttcttacttataagtgggagctaaacaatggggacacatggagatacagagcaggataaaaaacactggagattccaaaaggtagcagaggtgaggctgagggttgaaaaatcacctgttgggtacaatgttcaccatcyaggtgatggggccactaagaggccagacttcaccactgcaatatatgcatgtaagaaatactcacttgtacctcttaaacctattttttaaagtatttttttcctttttcttttttctgccataggaaaaaaggagcaaaacctcttaaaggcattgaaatggagttgctgcaaaagtaattaaaacttgacagcctaggtaggaaaggaccctatgtggctgaaagagatgtgtaagtgcccttgttgagataagcagcccacagggttctttaatcccaaatgcaaatgattaggaaa

SEQ ID NO: 36319 - DNA, 601 bp, Human
cccactactgggtatatacccaaagggaaaaaaatcattatatcaaaaagacacctgtactcatatgtttatcacagcattattcacaatagcaaagatggaatcatgtaagtatccatcagaggagggttggataaagaaaatatggaatatatatatacacatacacataccatggaatactactcagccatagaaaagaatgaaatcatatctttcgcacacaggtagcacttgaggcgattctgctaagtgaaataactcagaatgtcaaatactgcgtgttcttacttataagtgrgagctaaacaatggggacacatggagatacagagcaggataaaaaacactggagattccaaaaggtagcagaggtgaggctgagggttgaaaaatcacctgttgggtacaatgttcaccatctaggtgatggggccactaagaggccagacttcaccactgcaatatatgcatgtaagaaatactcacttgtacctcttaaacctattttttaaagtatttttttcctttttcttttttctgccataggaaaaaaggagcaaaacctcttaaaggcattgaaatggagttgctgcaaaag

SEQ ID NO: 36320 - DNA, 601 bp, Human
gtttttttttccccaacagatgttggtgaggatgcaaaaaaaggaacacttatacactattggtgggaatgtaaattagtacaacatttatggaaaacagtactgggattactcaaagaactaaaaatagaactacctttcaatccagcaatcccactactgggtatatacccaaagggaaaaaaatcattatatcaaaaagacacctgtactcatatgtttatcacagcattattcacaatagcaaagatggaatcatgtaagtatccatcagaggagggttggataaagaaaatatggwatatatatatacacatacacataccatggaatactactcagccatagaaaagaatgaaatcatatctttcgcacacaggtagcacttgaggcgattctgctaagtgaaataactcagaatgtcaaatactgcgtgttcttacttataagtgggagctaaacaatggggacacatggagatacagagcaggataaaaaacactggagattccaaaaggtagcagaggtgaggctgagggttgaaaaatcacctgttgggtacaatgttcaccatctaggtgatggggccactaagaggcca

SEQ ID NO: 36321 - DNA, 601 bp, Human
ccctgctatggtttgaatgtttgtcccctccaaaattcaggttgaaacttaatccccagtgtggtagtattgagaaggaggcctctaaggggtgaatgggtcatgaaggctctgccctgatgaatggattaatgggttaatggattaactagttctcatgggaatggtactggtggctttataagaggaggaagagagacctgagatagcacactcagccccctctccatgtgatgccctgtgccaccatgggactctgcagagaatccccaccagcaaggagaccctctccagatgtggycctttgaccttgaacttcccagcctccataactgtaggaaataaatttcttttatttataaattactcagtttctttgtattctactataatcaatagaaaatggactaagacatccccataatatccagatctgcttgatataggccttataagtgaggcagaatgtgagctaaagccaatgcaacaacaaagcctaagcaagttggattcctggggctctggtttctgctagaaccatgtatgtatgttaagtagatctgaaaaatctggttttgcttctgcctagagaaaggaaaaa

SEQ ID NO: 36322 - DNA, 601 bp, Human
ttaaacattttcccttccctgctatggtttgaatgtttgtcccctccaaaattcaggttgaaacttaatccccagtgtggtagtattgagaaggaggcctctaaggggtgaatgggtcatgaaggctctgccctgatgaatggattaatgggttaatggattaactagttctcatgggaatggtactggtggctttataagaggaggaagagagacctgagatagcacactcagccccctctccatgtgatgccctgtgccaccatgggactctgcagagaatccccaccagcaaggagaycctctccagatgtggccctttgaccttgaacttcccagcctccataactgtaggaaataaatttcttttatttataaattactcagtttctttgtattctactataatcaatagaaaatggactaagacatccccataatatccagatctgcttgatataggccttataagtgaggcagaatgtgagctaaagccaatgcaacaacaaagcctaagcaagttggattcctggggctctggtttctgctagaaccatgtatgtatgttaagtagatctgaaaaatctggttttgcttctgc

SEQ ID NO: 36323 - DNA, 601 bp, Human
gataaatgtaaattacttatgggatcctattatttgcaaaggaggtaacaccctggagttattactaaaatataccacttcacatgtgatttcttctttatttctttgcatgatgaaatctgtttaagtcttggtataaaatgtctgtttaaacattttcccttccctgctatggtttgaatgtttgtcccctccaaaattcaggttgaaacttaatccccagtgtggtagtattgagaaggaggcctctaaggggtgaatgggtcatgaaggctctgccctgatgaatggattaatgggytaatggattaactagttctcatgggaatggtactggtggctttataagaggaggaagagagacctgagatagcacactcagccccctctccatgtgatgccctgtgccaccatgggactctgcagagaatccccaccagcaaggagaccctctccagatgtggccctttgaccttgaacttcccagcctccataactgtaggaaataaatttcttttatttataaattactcagtttctttgtattctactataatcaatagaaaatggactaagacatccccataatatccagatctgc

SEQ ID NO: 36324 - DNA, 601 bp, Human
cttggtctctgccacagcccaaagctccaacacaggtggccttcagtacaagaccagcaaagtgagcactgaacaaatgaatcaacttacagactgctctgctgagacacacagctggcttctatttggaaaaatgtggggctcaagtgtgtgccaattagtaaagatgactgaagagtcattagaccattcaaaggaaactggaattttattgctgctcaaaccaatccatgtttctgatgcattttctgtaagagataaatgtaaattacttatgggatcctattatttgcaaaggagrtaacaccctggagttattactaaaatataccacttcacatgtgatttcttctttatttctttgcatgatgaaatctgtttaagtcttggtataaaatgtctgtttaaacattttcccttccctgctatggtttgaatgtttgtcccctccaaaattcaggttgaaacttaatccccagtgtggtagtattgagaaggaggcctctaaggggtgaatgggtcatgaaggctctgccctgatgaatggattaatgggttaatggattaactagttctcatgggaatggtactggtggcttta

SEQ ID NO: 36325 - DNA, 601 bp, Human
ctctctcacccccacatctaacttagcaacaccttctgttctccaaagcacacttggatctgtccacttctcttcacagtcactaccctaagtcaactctggtgtagcctccaaactggcttttctgcttccattttattcctctcctaaccattctctgtgtagcagccacagttaattgtaaaatgtaaatcaggtcatgccctttgtttccttgaagtactttattggttcctataccacaatctagaaacctggcattttagaattcctactgcccatctcttacgacctcctcacyactggtctcctttttgatcattcaacatggcaagtcttggtctgcctttgggcctttgcacttgctaccctctgcatgttctgcttagaatattcttcccccttctctctgagagtttttttttaagtccaagcttaaatattaacttttcagaaatgctttctgtggctgtcctgtcctgccccaacccaagcttttcactatcatgtcacatagttccttggagcaatcattacaactataattaccatgttttttctgtgtgtacttgtttgctctctaacatggaaggcccatgag

SEQ ID NO: 36326 - DNA, 601 bp, Human
agtcaatggcaccaccatacaccaaaaccatggttgctcaagccaaaagccgacctctctctcacccccacatctaacttagcaacaccttctgttctccaaagcacacttggatctgtccacttctcttcacagtcactaccctaagtcaactctggtgtagcctccaaactggcttttctgcttccattttattcctctcctaaccattctctgtgtagcagccacagttaattgtaaaatgtaaatcaggtcatgccctttgtttccttgaagtactttattggttcctataccacartctagaaacctggcattttagaattcctactgcccatctcttacgacctcctcactactggtctcctttttgatcattcaacatggcaagtcttggtctgcctttgggcctttgcacttgctaccctctgcatgttctgcttagaatattcttcccccttctctctgagagtttttttttaagtccaagcttaaatattaacttttcagaaatgctttctgtggctgtcctgtcctgccccaacccaagcttttcactatcatgtcacatagttccttggagcaatcattacaactataa

SEQ ID NO: 36327 - DNA, 601 bp, Human
ttcctgttttgctggcataattactttgtcaagccacatcagtaacatttaataaactgcctcttcggagaacctgacagagtatcctggtggttagaagaacatggacatctaccaaatcccaacaaccccctaaaactcagccagtgtattcagcagctatcttgatcaaagagattaagtctgttttaggcataataaactgttcaaatggcttgggattaagctaattctgtataatcagatgctttagataaatgagagactagaacatagggatgaatgtgatgttcaggctackgggaccactccatccacatgaggaaaaaaagcaagatttgccactgatccacaattttcaaagaggttacacatactgtttaaatccttttatgtgaataacataatggagcttaaaaaccatcactctccagagtaatcttccatccctcagttcttcccctcatcttcatcacagcagtcaatggcaccaccatacaccaaaaccatggttgctcaagccaaaagccgacctctctctcacccccacatctaacttagcaacaccttctgttctccaaagcacacttggatctgtcca

SEQ ID NO: 36328 - DNA, 601 bp, Human
aaggctactctcagatctttcattaataatgatataataactgctaacatattaaaattttatcctcccataggattttttaataacacaaatcagaaccttaggctaaagttacacaattcaaattccaggtggtatttcacacatctagaattttaggggaatgtggagcccttccatgacccttagaaaaatacaacgtccagggctgataccttcatctgtaagaggagccctgcatcgctcccccatggagtcttccagcaaacaatccagttacaggatagtgtcaggcatactrtagttaagaactgttagatgaatggaagaacaaatgaattgtttcctaggctctcatattcaaatttgtgtcaactgtgattggggaacttgttaattataataattatattcatactaagttctactccatggaaataaatgttaatttttacacatctactatttaaggagcttctgagcttccagaaaaggggccataaaatattacacttacggcagcattgtcctgacatatccaatactattaatacctatcatcaatctcttaaaaaaaaatctctgtccaaatattggctcc

SEQ ID NO: 36329 - DNA, 601 bp, Human
agggattataattcccattttaaaggttagagttagcattttacatggtcctagagtcagtaaaaattggagctaggattgataccaaggtcagcctggctttccattaagctgttctcaatttttctatgaaaagatgggatagagccatggttctcaatctcgagtgtgctccagaagcacctggagggctaactgaaacctagatgattgggctgcatgaccagtgtctcatttggtaggtctggtgggacttgagaattggcattcctaacaagttttcaggtgatgttaatgctgmtggtctgggggtcacactgtgagaaccactgggatgaagccatcctcctgaccaagtgagagtgctgacgcctctcttcaaccacttctaagtgttacattaaatgctttgctgctttcatgtctctacctgatgctggggaaattcctggaagctaccatgaaacaccctaggtaatattggcatagctgaaactcatgttcacccttcaatgatccctccatcaggaattcgaacagcaccaccccatctcctctttatatgctaggcagataccttcatgtctttctctaatcctat

SEQ ID NO: 36330 - DNA, 601 bp, Human
aggagagagagagagatgaaagagaggagagagagagaggagaaagagaaattcacttcaaattgatggtggaattgatattctagctatgaagtccctgtacctaaattgcaatgttaacagcacttacctcttgacatcctgattcagcatcagagaggacatggcctgcttttttacaaatgtaaaaaagtctttcttcacaatttttgactttccagtgtccctcctacggagaaaaatgttacaagagaatgaatacactctgtgctgataccgatgggcaatagcaattcttataaaaaaaaatatgatgaataatgtgctcccgcgtgggataatgtttcaggcggcactctgctttgtcacggaaagggttgacactttgtctagggaaaggcccctctctccagcatgagttccaaggtgtgcaatctgtaactgggtgggcaggagagagggagcaactattaacaactggtgcttcttgatagctgccatgtgctaggcttaatgcagggcgattttcatatattatctcaatgttccagtgaggtagggattataattcccattttaaaggttagagttagcattttac

SEQ ID NO: 36331 - DNA, 601 bp, Human
ggaaaggaaagaaggggggggtgcgaggagagagagagagatgaaagagaggagagagagagaggagaaagagaaattcacttcaaattgatggtggaattgatattctagctatgaagtccctgtacctaaattgcaatgttaacagcacttacctcttgacatcctgattcagcatcagagaggacatggcctgcttttttacaaatgtaaaaaagtctttcttcacaatttttgactttccagtgtccctcctacggagaaaaatgttacaagagaatgaatacactctgtgctgatrccgatgggcaatagcaattcttataaaaaaaaatatgatgaataatgtgctcccgcgtgggataatgtttcaggcggcactctgctttgtcacggaaagggttgacactttgtctagggaaaggcccctctctccagcatgagttccaaggtgtgcaatctgtaactgggtgggcaggagagagggagcaactattaacaactggtgcttcttgatagctgccatgtgctaggcttaatgcagggcgattttcatatattatctcaatgttccagtgaggtagggattataattcccatt

SEQ ID NO: 36332 - DNA, 601 bp, Human
tgctgtatcaggaccatttacatttttaatctcaaaagaaaagtaatcctgtgtagaagatagcaagacaacatttctcaggacaggaaaaaaaagaggaaaggaaagaaggggggggtgcgaggagagagagagagatgaaagagaggagagagagagaggagaaagagaaattcacttcaaattgatggtggaattgatattctagctatgaagtccctgtacctaaattgcaatgttaacagcacttacctcttgacatcctgattcagcatcagagaggacatggcctgcttttttrcaaatgtaaaaaagtctttcttcacaatttttgactttccagtgtccctcctacggagaaaaatgttacaagagaatgaatacactctgtgctgataccgatgggcaatagcaattcttataaaaaaaaatatgatgaataatgtgctcccgcgtgggataatgtttcaggcggcactctgctttgtcacggaaagggttgacactttgtctagggaaaggcccctctctccagcatgagttccaaggtgtgcaatctgtaactgggtgggcaggagagagggagcaactattaacaact

SEQ ID NO: 36333 - DNA, 601 bp, Human
ctgagactgtgccactgcactccagcctgggtgacaaagcaagactctgtctcaaaaaaaaaaaaaagaaaaagaaaaagaaaagaaagaaagactaggaaaaccaagtgtgagacagggcatcacacatcacaggatagtcactgtacagatgctgtatcaggaccatttacatttttaatctcaaaagaaaagtaatcctgtgtagaagatagcaagacaacatttctcaggacaggaaaaaaaagaggaaaggaaagaaggggggggtgcgaggagagagagagagatgaaagagagragagagagagaggagaaagagaaattcacttcaaattgatggtggaattgatattctagctatgaagtccctgtacctaaattgcaatgttaacagcacttacctcttgacatcctgattcagcatcagagaggacatggcctgcttttttacaaatgtaaaaaagtctttcttcacaatttttgactttccagtgtccctcctacggagaaaaatgttacaagagaatgaatacactctgtgctgataccgatgggcaatagcaattcttataaaaaaaaatatgatgaataatgtgct

SEQ ID NO: 36334 - DNA, 601 bp, Human
ttgagcctgggaggtggaggttgcagtgagctgagactgtgccactgcactccagcctgggtgacaaagcaagactctgtctcaaaaaaaaaaaaaagaaaaagaaaaagaaaagaaagaaagactaggaaaaccaagtgtgagacagggcatcacacatcacaggatagtcactgtacagatgctgtatcaggaccatttacatttttaatctcaaaagaaaagtaatcctgtgtagaagatagcaagacaacatttctcaggacaggaaaaaaaagaggaaaggaaagaaggggggggkgcgaggagagagagagagatgaaagagaggagagagagagaggagaaagagaaattcacttcaaattgatggtggaattgatattctagctatgaagtccctgtacctaaattgcaatgttaacagcacttacctcttgacatcctgattcagcatcagagaggacatggcctgcttttttacaaatgtaaaaaagtctttcttcacaatttttgactttccagtgtccctcctacggagaaaaatgttacaagagaatgaatacactctgtgctgataccgatgggcaatagcaattct

SEQ ID NO: 36335 - DNA, 601 bp, Human
atatctactatccaactagagtatgaagttcacttgtttacacattgattaatgaataaaatgaagattctaaggggatgggtcattgttcaattgcaatacaaataactggattagaagagaaaataattaaagcatagttgcataaagaccaggtctggaaaactgttgagactgataaagcatagttcactctgactcagaggaacacaattgttttatgacatctcacttgaaaactaggaaaaccataggtcaggcacagtggctgaagcctgtaatcccgatactttgggaggcygaggcagtagatcacttgaggtcaggagttcgagacaagtctggccaacatggcaaaatcccgtctctactaaaaatacaaaaattagccaggcgtagtggcgcacgcctgtaatcccagctactcgggaggctgaggcatgcgaattgcttgagcctgggaggtggaggttgcagtgagctgagactgtgccactgcactccagcctgggtgacaaagcaagactctgtctcaaaaaaaaaaaaaagaaaaagaaaaagaaaagaaagaaagactaggaaaaccaagtgtgagacaggg

SEQ ID NO: 36336 - DNA, 601 bp, Human
atgtcagctacggcatatctactatccaactagagtatgaagttcacttgtttacacattgattaatgaataaaatgaagattctaaggggatgggtcattgttcaattgcaatacaaataactggattagaagagaaaataattaaagcatagttgcataaagaccaggtctggaaaactgttgagactgataaagcatagttcactctgactcagaggaacacaattgttttatgacatctcacttgaaaactaggaaaaccataggtcaggcacagtggctgaagcctgtaatcccgrtactttgggaggccgaggcagtagatcacttgaggtcaggagttcgagacaagtctggccaacatggcaaaatcccgtctctactaaaaatacaaaaattagccaggcgtagtggcgcacgcctgtaatcccagctactcgggaggctgaggcatgcgaattgcttgagcctgggaggtggaggttgcagtgagctgagactgtgccactgcactccagcctgggtgacaaagcaagactctgtctcaaaaaaaaaaaaaagaaaaagaaaaagaaaagaaagaaagactaggaaaacca

SEQ ID NO: 36337 - DNA, 601 bp, Human
acatgtcagctacggcatatctactatccaactagagtatgaagttcacttgtttacacattgattaatgaataaaatgaagattctaaggggatgggtcattgttcaattgcaatacaaataactggattagaagagaaaataattaaagcatagttgcataaagaccaggtctggaaaactgttgagactgataaagcatagttcactctgactcagaggaacacaattgttttatgacatctcacttgaaaactaggaaaaccataggtcaggcacagtggctgaagcctgtaatccygatactttgggaggccgaggcagtagatcacttgaggtcaggagttcgagacaagtctggccaacatggcaaaatcccgtctctactaaaaatacaaaaattagccaggcgtagtggcgcacgcctgtaatcccagctactcgggaggctgaggcatgcgaattgcttgagcctgggaggtggaggttgcagtgagctgagactgtgccactgcactccagcctgggtgacaaagcaagactctgtctcaaaaaaaaaaaaaagaaaaagaaaaagaaaagaaagaaagactaggaaaac

SEQ ID NO: 36338 - DNA, 601 bp, Human
tcagagattataatcattagataaaatggtgacatgtcagctacggcatatctactatccaactagagtatgaagttcacttgtttacacattgattaatgaataaaatgaagattctaaggggatgggtcattgttcaattgcaatacaaataactggattagaagagaaaataattaaagcatagttgcataaagaccaggtctggaaaactgttgagactgataaagcatagttcactctgactcagaggaacacaattgttttatgacatctcacttgaaaactaggaaaaccatargtcaggcacagtggctgaagcctgtaatcccgatactttgggaggccgaggcagtagatcacttgaggtcaggagttcgagacaagtctggccaacatggcaaaatcccgtctctactaaaaatacaaaaattagccaggcgtagtggcgcacgcctgtaatcccagctactcgggaggctgaggcatgcgaattgcttgagcctgggaggtggaggttgcagtgagctgagactgtgccactgcactccagcctgggtgacaaagcaagactctgtctcaaaaaaaaaaaaaagaaaaa

SEQ ID NO: 36339 - DNA, 601 bp, Human
aaagccacagtaagacaaatccccccaccctcacccctgccccgtcttcaatatttcatatcaggtagagattaatcagagatcagctataactaattcagagattataatcattagataaaatggtgacatgtcagctacggcatatctactatccaactagagtatgaagttcacttgtttacacattgattaatgaataaaatgaagattctaaggggatgggtcattgttcaattgcaatacaaataactggattagaagagaaaataattaaagcatagttgcataaagaccaggyctggaaaactgttgagactgataaagcatagttcactctgactcagaggaacacaattgttttatgacatctcacttgaaaactaggaaaaccataggtcaggcacagtggctgaagcctgtaatcccgatactttgggaggccgaggcagtagatcacttgaggtcaggagttcgagacaagtctggccaacatggcaaaatcccgtctctactaaaaatacaaaaattagccaggcgtagtggcgcacgcctgtaatcccagctactcgggaggctgaggcatgcgaattgcttgagc

SEQ ID NO: 36340 - DNA, 601 bp, Human
ctgtttagagaattgcattgaagcaactttctaaaaaagagaaaactttcaaaaccatattcatagactgatgcataataaaattactggaaatttcttcacaaagctagagaattggctatgaactcaggaactttaaatactggtaatgctggctggaaaagggaagccatgaacaaaagtttgaatagaacatcagttctgtatttgcagtgtaaaaagttaattgtcctttcaacaaaaataaaacacgttgagtttcccagaaagccacagtaagacaaatccccccaccctcacmcctgccccgtcttcaatatttcatatcaggtagagattaatcagagatcagctataactaattcagagattataatcattagataaaatggtgacatgtcagctacggcatatctactatccaactagagtatgaagttcacttgtttacacattgattaatgaataaaatgaagattctaaggggatgggtcattgttcaattgcaatacaaataactggattagaagagaaaataattaaagcatagttgcataaagaccaggtctggaaaactgttgagactgataaagcatagttc

SEQ ID NO: 36341 - DNA, 601 bp, Human
acttctattcccaatcttctctctgtgagtaactgacagctccatacagctccttcatgcatccctccagggtaggagcagggatattagactgctcctgtacttggaaggacagggagagggaggctggcaatttgacctttccgataatgtattcttcttcattagcagtttttagatcataggctgcttagcaaaacaaacaaacaaaaaaatccaataactgaaccagctcaagaaaagggagggaaaaaaagatctggcatagaataatcagaaacaccgacttgttacttcaagrctttgtccacacaatgaatacgggaaggataactgattatatcagttaaccctttgtacactaggtgccatttcatttttaaatgaaaggatggtggtgacaaaactgaaggaattgctcatattgtccaatcccaaaaaagtgactcagaaggaaaaacaaatcacttcttttgctttgaaattatcaagattgattttacaaattgatttttcaagtgcagactgtttagagaattgcattgaagcaactttctaaaaaagagaaaactttcaaaaccatattcatagactgatgcat

SEQ ID NO: 36342 - DNA, 601 bp, Human
tgaactcactccccttcacttctattcccaatcttctctctgtgagtaactgacagctccatacagctccttcatgcatccctccagggtaggagcagggatattagactgctcctgtacttggaaggacagggagagggaggctggcaatttgacctttccgataatgtattcttcttcattagcagtttttagatcataggctgcttagcaaaacaaacaaacaaaaaaatccaataactgaaccagctcaagaaaagggagggaaaaaaagatctggcatagaataatcagaaacacmgacttgttacttcaagactttgtccacacaatgaatacgggaaggataactgattatatcagttaaccctttgtacactaggtgccatttcatttttaaatgaaaggatggtggtgacaaaactgaaggaattgctcatattgtccaatcccaaaaaagtgactcagaaggaaaaacaaatcacttcttttgctttgaaattatcaagattgattttacaaattgatttttcaagtgcagactgtttagagaattgcattgaagcaactttctaaaaaagagaaaactttcaaaaccata

SEQ ID NO: 36343 - DNA, 601 bp, Human
ccccgacaggagggtagaaattaagtgttggctctagggtcaggatgcatgggtttgaattctggctccactactgtgcaaccttgtttaatatcatagttttttcatctatacgatgaggataataatagtatttatggggttgttctgagaatcagagaaggacaatacagatagagattttagaattgaacagaggggaaagagaacatgaacaaagagaatatatgtatctagataatattagagatttttttcaactttcatattgattatttcatgttatccctctgagattcaytgagattagggacttggataaagtcaaactagtggatcagttgggcctgaaacccaattctggaacagtccaggatggtcttgtttggagcataatgcttccaaatagagaatggccaatatatgtattttttctttttctttctttttttttttttttgtaaagattattcctaaattaactggctggccttttggaggggaagaaagtaagctttggcactcagacaaaaatgacaaacatgtaggtctatgttttagccctgggaacaacgaagggtggctcttcctttgaaatcat

SEQ ID NO: 36344 - DNA, 601 bp, Human
ctacctctctctttctctctctctctctctctctctctctctgtgtgtgtgtgtgtgtgtgtgtgtgtgtgtgtgtgtgtgtgtgtgtgtgtgtctctctctctctgacttacagaatttcatataaatggccccgacaggagggtagaaattaagtgttggctctagggtcaggatgcatgggtttgaattctggctccactactgtgcaaccttgtttaatatcatagttttttcatctatacgatgaggataataatagtatttatggggttgttctgagaatcagagaaggacaatrcagatagagattttagaattgaacagaggggaaagagaacatgaacaaagagaatatatgtatctagataatattagagatttttttcaactttcatattgattatttcatgttatccctctgagattcattgagattagggacttggataaagtcaaactagtggatcagttgggcctgaaacccaattctggaacagtccaggatggtcttgtttggagcataatgcttccaaatagagaatggccaatatatgtattttttctttttctttctttttttttttttttgtaaagatta

SEQ ID NO: 36345 - DNA, 601 bp, Human
cacaatctcatttagttaaataccaagagatatttttgcatactcttttaccacctacataactttcttctcttactcctttaaaactccttgaatttttgtcttgatatttttatatttattctatccagtaatgccattaactacacccacttctacatttatttaatttattatcttaaaacctaaaatttttaattaacttaaaacgtaaaaccttaaaagtaaatgaaaataaagggcattcattcaagatctctacctctctctttctctctctctctctctctctctctctctstgtgtgtgtgtgtgtgtgtgtgtgtgtgtgtgtgtgtgtgtgtgtgtgtgtctctctctctctgacttacagaatttcatataaatggccccgacaggagggtagaaattaagtgttggctctagggtcaggatgcatgggtttgaattctggctccactactgtgcaaccttgtttaatatcatagttttttcatctatacgatgaggataataatagtatttatggggttgttctgagaatcagagaaggacaatacagatagagattttagaattgaacagaggggaaagagaacat

SEQ ID NO: 36346 - DNA, 601 bp, Human
gtggagaaactggaacctttatgcactactggtgggaatggaaaatggtgtagccattatggaaaagagtacagtggttccttaaaaaatttaaaatcaaattatcatatgatccagcaatttcacttataggcatacatgccaaagaattgaaagcagggactcgaagggtatttgtacattcatgttcatggtagcattagtcacaatagccaaatggtgggagcaacccaaatgtccattaatggatgaatggataaacaatatgtgtatatacatacaatggaatatgaattagccytaaaacagaatttccagaaacgaaattctgacactacaacatgctaaatgaaataaaccagacacagaaaaacataattccacttatatgagacatgtagagtagttaaactcacagagacagaaaatagaatagtagttgccagggtctgggaggaggggagaataggcagctattgtttaatgggtacagagtttcagtttgggaagatgaaaaaagttctggagatggatgatggtagtgggtgaacaacaatctgaatgcagttaatgacactgaactgcacactgaaaaatgact

SEQ ID NO: 36347 - DNA, 601 bp, Human
tatattaaaaattcctataactaaacaatagaaaagacaaacatcccaattaaaaaatggacaaaggacttgaatagacatttctccaaagaagatacacagatagccaataagcacgtgaaaagatgttcaacatcatcaatcaccagtggaatgcagatcaaaaccacagtgaaataccactgcacacccaataggatggctattatcaaaacaaaacaaccagataatagtaagcattggctaggatgtggagaaactggaacctttatgcactactggtgggaatggaaaatggtgyagccattatggaaaagagtacagtggttccttaaaaaatttaaaatcaaattatcatatgatccagcaatttcacttataggcatacatgccaaagaattgaaagcagggactcgaagggtatttgtacattcatgttcatggtagcattagtcacaatagccaaatggtgggagcaacccaaatgtccattaatggatgaatggataaacaatatgtgtatatacatacaatggaatatgaattagccttaaaacagaatttccagaaacgaaattctgacactacaacatgctaaatg

SEQ ID NO: 36348 - DNA, 601 bp, Human
caacggaataagaaattaataaattggactttataaaaattaaaaactttgcacatcaaaggacactatcaacagaatgaaaaggcaacccacaaaatgggagaaagtatttgcaagttgtacatcagataagggattaatatccagaatatattaaaaattcctataactaaacaatagaaaagacaaacatcccaattaaaaaatggacaaaggacttgaatagacatttctccaaagaagatacacagatagccaataagcacgtgaaaagatgttcaacatcatcaatcaccagtgraatgcagatcaaaaccacagtgaaataccactgcacacccaataggatggctattatcaaaacaaaacaaccagataatagtaagcattggctaggatgtggagaaactggaacctttatgcactactggtgggaatggaaaatggtgtagccattatggaaaagagtacagtggttccttaaaaaatttaaaatcaaattatcatatgatccagcaatttcacttataggcatacatgccaaagaattgaaagcagggactcgaagggtatttgtacattcatgttcatggtagcatta

SEQ ID NO: 36349 - DNA, 601 bp, Human
atgagagctaaaactataaaactcttacaaggaaacacaggaaaaagacttcataacattgtatttggcaatgatttcttgtatatgataccaaaagcacaggcaacggaataagaaattaataaattggactttataaaaattaaaaactttgcacatcaaaggacactatcaacagaatgaaaaggcaacccacaaaatgggagaaagtatttgcaagttgtacatcagataagggattaatatccagaatatattaaaaattcctataactaaacaatagaaaagacaaacatcccarttaaaaaatggacaaaggacttgaatagacatttctccaaagaagatacacagatagccaataagcacgtgaaaagatgttcaacatcatcaatcaccagtggaatgcagatcaaaaccacagtgaaataccactgcacacccaataggatggctattatcaaaacaaaacaaccagataatagtaagcattggctaggatgtggagaaactggaacctttatgcactactggtgggaatggaaaatggtgtagccattatggaaaagagtacagtggttccttaaaaaatttaaaatca

SEQ ID NO: 36350 - DNA, 601 bp, Human
tgccaagactgttcagtgcagaaaggacagtcttctcaataaactgtgcagggaaaactagacaaccacttgcaacagaatgaagttagacccttaccttatactatgcacaaaaatgaactcaaagtagattaaagacctaaacatgagagctaaaactataaaactcttacaaggaaacacaggaaaaagacttcataacattgtatttggcaatgatttcttgtatatgataccaaaagcacaggcaacggaataagaaattaataaattggactttataaaaattaaaaactttgcrcatcaaaggacactatcaacagaatgaaaaggcaacccacaaaatgggagaaagtatttgcaagttgtacatcagataagggattaatatccagaatatattaaaaattcctataactaaacaatagaaaagacaaacatcccaattaaaaaatggacaaaggacttgaatagacatttctccaaagaagatacacagatagccaataagcacgtgaaaagatgttcaacatcatcaatcaccagtggaatgcagatcaaaaccacagtgaaataccactgcacacccaataggatggct

SEQ ID NO: 36351 - DNA, 601 bp, Human
cctgacttcaagtgagccgcctgcctcggcctcccaaagtgctgggattacaggcgtgagtcactgtgcctggccctgtgcctggtatttctgcttaacagatatcaatcttcatgaggaagccttcaatatcaccaggatgtgtcaattttttttacttaaaaattatttggaatatgattgaaaggatagagacaggcaacaaatgttgattaagcacctgctgtctgtcaggcactgttctggaaaaaaaaagggccccggaataaaggaatttgggatacatggatcaaattaaaayagtgttggtcctgttaagaatgtccatgtaaccttggtatcaccttgaagcaactggccagaccaggctctgactcccagtccaaatagcaggggtgaaagggccatctctcttcatactctgctttttcctgattttcaactggctgcttgcacaaggacattgccttaaagtgccgacagtgcttcacttcccagcgaccaagtggatgccttcctcgcatggcaacacagccaccactgtagcctaaaagcagaaaacaagcatttttaataccagacgactaaaacgttttgtgct

SEQ ID NO: 36352 - DNA, 601 bp, Human
tgtcacccaggatggagtgctatggcgcagtctcggctcactgcaacctctgcctcccgggttcgagccattctcctgtctcagcctcctaagtagctgggactacaggtgcatgccaccatgcctggctactttttgtatttttagtagagatgggatttcaccatgttggccaggctggtctggaactcctgacttcaagtgagccgcctgcctcggcctcccaaagtgctgggattacaggcgtgagtcactgtgcctggccctgtgcctggtatttctgcttaacagatatcaatcktcatgaggaagccttcaatatcaccaggatgtgtcaattttttttacttaaaaattatttggaatatgattgaaaggatagagacaggcaacaaatgttgattaagcacctgctgtctgtcaggcactgttctggaaaaaaaaagggccccggaataaaggaatttgggatacatggatcaaattaaaatagtgttggtcctgttaagaatgtccatgtaaccttggtatcaccttgaagcaactggccagaccaggctctgactcccagtccaaatagcaggggtgaaagggccatctc

SEQ ID NO: 36353 - DNA, 601 bp, Human
gttcagctgtgcctaaaatctctgctgcttctcagctgtcttcatggtggcaggaagaagccagatgaatggaaggtcttctgttggctttatttaagattggggaaagggactgaagacccagagcttgcaatcccagtcctcttacccttcttatttttaactgcctggcactaagcctgagcctctgatgccagacaggtacaccctgtggccagccctcaccaggctcttacttgctgagaccagaatgaatagctttccaagtcctgtggaccacagcacaacctttccatctttyaaattatatgtcaaaacttgcctcctctgggaacctcttcccgaatcactataagctcataaatcctaccaccatgcctatcacacacaccatgcatttgttgacatatcagggtgatatatagtagaaaaggcaccagaccagaagtcctaaaccaggcatttattccaactctgtcaataaataatcgtgatcttgggcaaatcactacatttcacaggccccagtttactcatctctaaggtttaacttattaatgggcgaggccacttttgggcctattattctatgaatgtaatg

SEQ ID NO: 36354 - DNA, 601 bp, Human
taaacttccatcccaccagattgccttctgacagattagaattagcagattgatcattactctggctgacccagggcaagaaatgagaaattagacctgggacctagggtagctctatttctagagtctttgaatcttagttgaactggcagtgcagtggttcagctgtgcctaaaatctctgctgcttctcagctgtcttcatggtggcaggaagaagccagatgaatggaaggtcttctgttggctttatttaagattggggaaagggactgaagacccagagcttgcaatcccagtcytcttacccttcttatttttaactgcctggcactaagcctgagcctctgatgccagacaggtacaccctgtggccagccctcaccaggctcttacttgctgagaccagaatgaatagctttccaagtcctgtggaccacagcacaacctttccatcttttaaattatatgtcaaaacttgcctcctctgggaacctcttcccgaatcactataagctcataaatcctaccaccatgcctatcacacacaccatgcatttgttgacatatcagggtgatatatagtagaaaaggcaccagac

SEQ ID NO: 36355 - DNA, 601 bp, Human
ctgaattcaaggttctgtaaacttgcaagatggatacagataagggaaagcttgtttcctcaaatgaaaacttaggaggttgggttggaattaaaaaaaaaattactgggactctttttttttttttttccaaacaaaatcttacataggctccaattatatacaaaataattagcggtggagctggtcagagccgctctggtgaggcgtggaaggaactaggagctctgcctacgtggccctctcatactcctggggttccaggattcttgggatccttccacaacactttgaaaaccaytggggtagataattcctgagtttggcaggaaagctctacagttctgacttgaggcacaaagaaaagatttcaaatatctaaacaattgtcactttgttctttgttttatgaaatgagaacctggtacaagataaacataaaactatatgtatatttatttttcttggctttgggcataatacaaatatgggaattttaaacaactacttgggatactcaccctcagaagccattactgggagatagaatatttgactgtaatttttcataattaacaagtatttaccaattaaattttga

SEQ ID NO: 36356 - DNA, 601 bp, Human
ttctgaaactggaaggaattatgcagacagcagatgaccacggtatgtggtgggaggtagcacaagacggtttagagttcttacaatttaagcttgagtttctaactccactgaattcaaggttctgtaaacttgcaagatggatacagataagggaaagcttgtttcctcaaatgaaaacttaggaggttgggttggaattaaaaaaaaaattactgggactctttttttttttttttccaaacaaaatcttacataggctccaattatatacaaaataattagcggtggagctggtcaragccgctctggtgaggcgtggaaggaactaggagctctgcctacgtggccctctcatactcctggggttccaggattcttgggatccttccacaacactttgaaaaccattggggtagataattcctgagtttggcaggaaagctctacagttctgacttgaggcacaaagaaaagatttcaaatatctaaacaattgtcactttgttctttgttttatgaaatgagaacctggtacaagataaacataaaactatatgtatatttatttttcttggctttgggcataatacaaatatgg

SEQ ID NO: 36357 - DNA, 601 bp, Human
ttctggcttattagaaaactactctttgaaaccaggcttctgcaatggaatgggctttctcccaaataagaagcattctgaaactggaaggaattatgcagacagcagatgaccacggtatgtggtgggaggtagcacaagacggtttagagttcttacaatttaagcttgagtttctaactccactgaattcaaggttctgtaaacttgcaagatggatacagataagggaaagcttgtttcctcaaatgaaaacttaggaggttgggttggaattaaaaaaaaaattactgggactctttttttttttttttccaaacaaaatcttacataggctccaattatatacaaaataattagcggtggagctggtcagagccgctctggtgaggcgtggaaggaactaggagctctgcctacgtggccctctcatactcctggggttccaggattcttgggatccttccacaacactttgaaaaccattggggtagataattcctgagtttggcaggaaagctctacagttctgacttgaggcacaaagaaaagatttcaaatatctaaacaattgtcactttgttctttgttttatgaaatg

SEQ ID NO: 36358 - DNA, 601 bp, Human
atggcaaatctccaagattgtacattgttttgcaaacatatttgaccataaaatctccttcctcccctgcagaatgctgcacaagactcacatggagagatgtcaaaaactcccagctttaaggtcattgctgtagatgtggaagatgaataatctgatagatgttgcatgttaatctttttatgggaatgtcctacaaggaaacttgtgggaaaggccagaattttcctgaaaaaatagtacaggatttttctctgggattcaggccagtgtttcattgagactctagatttccagagcytgaagcagagtacctattattatggttgttttcattaaataaatatacagagtcatggaggtgtgatgatcacaacatcctcagaggcaggatcttgtttgtcatgtctattgaattatccaaccagctatgcatgtaactgtgccccttccacagaagatactctcacaatgcaggctgactgacaagaacattccaaagtgagaggccaaactcgggggtggggggctcacaggaaggagacaagatgactgtcttcaaatatttgaaaatagagtagatttgatctgtatttgctct

SEQ ID NO: 36359 - DNA, 601 bp, Human
taaacagaaatgacagtgacatttgatcttaaagcaaactgggaagcagtgtgtgtgtggttgtcatatggcaaacctcactaaaatgcaaggacagaatatgcaaatatgttttaaaggaagctaaagtaatgaagcaaaatgtaactttgaacaatggagactatcacctatcccttggatttgcggcctcacacctggctgataatccaattagccagaaagcttcttaaacttttcttcagactcagagagtctgactcagcagctctggtgtgaggccagaaagctctgtattaaraggtgtcccgaccaagtgtgatgagcagccaggttcctgagtcatggcctcatgtcagcatttcccgtagggactagcagttctgtgggatgtcaataagtgttcttaaaaaagggaattgtggtcaaagaaagtgcttccttctagaaccctttacgatgctaatgtacatggcaaatctccaagattgtacattgttttgcaaacatatttgaccataaaatctccttcctcccctgcagaatgctgcacaagactcacatggagagatgtcaaaaactcccagctttaaggtcattg

SEQ ID NO: 36360 - DNA, 601 bp, Human
caacacaaataattctaaagccagtcaccctgagccatggttcattaacttcagttgtcaccattggtttatacttggtgagaagctccacagagaatcaccttcccttctatgaggcagagtacaaatgtgtccacagaatactcaataaatcgagtaataaagcctacctgtgcaatgaaccatctcactaagataattttctgagaataattttgaagaatcaaagatttaaaatattcagatgtcaggacagatactttattttcctttgtgcagagaagcaaggaattccttctcrgatatgtcagctactctgcctggatgacacaaattaaattcaaattcagcttagaaatccaagagatcactgatgcccggttggacattgtcatgatgatactaactttcatttaaggctgggagaaggtgagaatggccaccttcagtttaagccaagcacattaatctcgatggcataggctgaaaatccatgtcactctcctggtgttgtgacctttttctttcctcactgaattcagagttctatgtctttcctgctatatactggctcctggaagatgaaatggtatttactttc

SEQ ID NO: 36361 - DNA, 601 bp, Human
agtgttctcaacttctatgtgtcacatttctttttcgagtgctacattgacttgaaccacccagctgtctcatgtagtggctgccatttatggagtaagttgaccctgctatgccttttctgttttctgagccttggtttctttatcagaaaaatggattagtggggctgaatgacctttaaaatctcttcctactctcttctataaacctcttccttgacataaatttgaaaaccatcttggtacggggctttctctattgttctttactacttcaaagtttggctactgatattttgcyaatcatgagatattataacattgtgactttggagtcagacaacctgtgtgcaaatcctggctctcctatatattttaggcaagccacttaatcattctaatacccatggcactgagttattgtaaggatgaaatgagatcatgtaggagtgcattcagctcagcgcttggaacagtataaggactcaataaacagcagttgcattaaattctcactgcaggctcttaggagtctccccatttcacaggtgaaagtgaataatgtgatttttcatgtgccgtaggatggatcccacttcaa

SEQ ID NO: 36362 - DNA, 601 bp, Human
cagaagaatggatgtaccacaagtaaaattggggtaaaaatttggggaaaaaaaggatgttttaaaatcctttatattcctcctcaaacatgtacactgtcacgtaataattcatctatctaaaatatatatagcctcaggttcagaaaatggtgtgatttgaattcattttgtccagcagatattagtgagaagctcggccactgcttcatggccttatctaatttattctgacccagattgtctgttcctctcctattactaatgagtttgttatactaaaacaaaagaaagtgttctyaacttctatgtgtcacatttctttttcgagtgctacattgacttgaaccacccagctgtctcatgtagtggctgccatttatggagtaagttgaccctgctatgccttttctgttttctgagccttggtttctttatcagaaaaatggattagtggggctgaatgacctttaaaatctcttcctactctcttctataaacctcttccttgacataaatttgaaaaccatcttggtacggggctttctctattgttctttactacttcaaagtttggctactgatattttgctaatcatga

SEQ ID NO: 36363 - DNA, 601 bp, Human
atgcctttttaaaaaacaaaaacaaaaacaagaaaacaaaaggccaggcacggtggctcatgcctgtaatcccagcactttgggaggccaaggtgggcagatcacaagctcaggagattgagaccatcctggctaacacggtgaaaccccatctctactaaaaatacaaaaacaaaaaattagctggttgtggtggtgggcacctgtagtcccagctactcgggagaatggcgtggacccaggaagcagagcttgcagtgagccgaaatcccaccactgcactccagcctgggtgacagascaagactccgtctcaaaaaaaataaataaataaaataaaaattaaaaaaaggtatgctattcctttctccagaaggaacaaatcaaatgcaagctttggtctgaatttgcacatttttctaactgggaaaattttctagccttggaatcctgggtaaacttagggactcaagggtgtgccagatcttggtattaactttgattttgattactttgaacatatgctaagttttttgtctctaataactaaattctaagctatagctagctttaatcaggaatctatcaggtcactttccat

SEQ ID NO: 36364 - DNA, 601 bp, Human
ttaaagatgcctttttaaaaaacaaaaacaaaaacaagaaaacaaaaggccaggcacggtggctcatgcctgtaatcccagcactttgggaggccaaggtgggcagatcacaagctcaggagattgagaccatcctggctaacacggtgaaaccccatctctactaaaaatacaaaaacaaaaaattagctggttgtggtggtgggcacctgtagtcccagctactcgggagaatggcgtggacccaggaagcagagcttgcagtgagccgaaatcccaccactgcactccagcctgggtkacagagcaagactccgtctcaaaaaaaataaataaataaaataaaaattaaaaaaaggtatgctattcctttctccagaaggaacaaatcaaatgcaagctttggtctgaatttgcacatttttctaactgggaaaattttctagccttggaatcctgggtaaacttagggactcaagggtgtgccagatcttggtattaactttgattttgattactttgaacatatgctaagttttttgtctctaataactaaattctaagctatagctagctttaatcaggaatctatcaggtcact

SEQ ID NO: 36365 - DNA, 601 bp, Human
aatagtgtacaaatttatgatggggaaaattccacatctagtggttgttctgcaactgagtgtctgtgggaccatgtgattgtcatctaacttctctttttctcggcttcttcatcagaatgtagcaggagtcctgacctgcttgtacctcatgggctgtatgtgcaacagacaagatatagagacagtaaatccccatgaactgtgaggaaagacatttctttctcaagcctaggatgctttaatacagggcttcattttatagtcaacttacagagatataaaaagatgatagagttasaaaggattcctgaagatcatgaaatatgattaaattacaggaaaagaaaatggctttttcttgctttcaaagcttccaagggaaaggggagtgaggatttcccgccttcatgcccccattgtaatttgcactttctgtgccctttctatttactacatcatatcacttccagctttagtttttaaatttatgttttaaaaattgaaaaataaaattgtatgtatttattgtatacaacatgatgttttaaagtatatatatctagcctttttaaaaacagagactgtatctcatacattt

SEQ ID NO: 36366 - DNA, 601 bp, Human
ttatggtaagtatagccaaatatcagctctttttgggttgtatactttgcatgcgtatggattagttttcagccattcatctggtctcttgttattgccctctgaggtgaggagtatggtgtctggctaaagaaatgtgtattttccgacatcatggtatagaattgaacatgctcatattgaacattatggttttggcttgagtgttccattcgtaagagtggaagggtgacaaaatagtgtacaaatttatgatggggaaaattccacatctagtggttgttctgcaactgagtgtctrtgggaccatgtgattgtcatctaacttctctttttctcggcttcttcatcagaatgtagcaggagtcctgacctgcttgtacctcatgggctgtatgtgcaacagacaagatatagagacagtaaatccccatgaactgtgaggaaagacatttctttctcaagcctaggatgctttaatacagggcttcattttatagtcaacttacagagatataaaaagatgatagagttagaaaggattcctgaagatcatgaaatatgattaaattacaggaaaagaaaatggctttttcttgct

SEQ ID NO: 36367 - DNA, 601 bp, Human
aaatgactggataaataagatggcctgggtttctttccaaattccaccacttagctgctgtgtaaccaagttgcttaacctctttgaagtcttagcctactcacctgtaaaaatgtactaataatagacttcccacagggggttcttgggaagattacattttagtacttatcatagtacctgaaacagttatggtaagtatagccaaatatcagctctttttgggttgtatactttgcatgcgtatggattagttttcagccattcatctggtctcttgttattgccctctgaggtgagragtatggtgtctggctaaagaaatgtgtattttccgacatcatggtatagaattgaacatgctcatattgaacattatggttttggcttgagtgttccattcgtaagagtggaagggtgacaaaatagtgtacaaatttatgatggggaaaattccacatctagtggttgttctgcaactgagtgtctgtgggaccatgtgattgtcatctaacttctctttttctcggcttcttcatcagaatgtagcaggagtcctgacctgcttgtacctcatgggctgtatgtgcaacagacaaga

SEQ ID NO: 36368 - DNA, 601 bp, Human
acagaagatctacagaagttcccagcagagctaagctctgttggaaagatcaaagaagcccttcattgttcatgtctgagacgaagctggcagccatgttttggggaggattttggaactagcttttgatgtaatgaagacgttgtgctcttacatgccctgacactgctgttccactgtcacaggcagcaccgtgtagggtttttaaatgactggataaataagatggcctgggtttctttccaaattccaccacttagctgctgtgtaaccaagttgcttaacctctttgaagtcttakcctactcacctgtaaaaatgtactaataatagacttcccacagggggttcttgggaagattacattttagtacttatcatagtacctgaaacagttatggtaagtatagccaaatatcagctctttttgggttgtatactttgcatgcgtatggattagttttcagccattcatctggtctcttgttattgccctctgaggtgaggagtatggtgtctggctaaagaaatgtgtattttccgacatcatggtatagaattgaacatgctcatattgaacattatggttttggcttgagtg

SEQ ID NO: 36369 - DNA, 601 bp, Human
tgcataacagtgtaaaaatgtcagataagcagactaattagctagtagtttgtgtcaaacaactcctaaagtgcttgcagcgttttttcagcattaatgtgattatcaagatggctcaaaaaataaattcactctaatcatgctttatggtcttctgttactcaaagagtgggagagaaaatattgacattctttttccaagatggaaacattttattaaaatttttatttgcttcagatttttaaactgtatctagcttgcttgttcataattaatttttttgacactgcaactaactgytatttttgtttttcacaattctaatcactgctcttcttagggaagctacacaaagcacatacgtaattttaaaaatatttaattacttatttgtactcttcctacatttataagataaatgtgagacagaagtgagtggaatcacctctacacatcttgctcctcatcctggaatgaagtaacttctggattgacccattccagcaggacgttcttaggtgtggggtttctttcttacaaaatgtgaacaccactatcaccaccaccaacaataagtgcccaaggtaggcacaaattatg

SEQ ID NO: 36370 - DNA, 601 bp, Human
aaccaccgcgcccagctaagagggtagattttatgttaagagttctcatcacaaaaatgaatgaattagtgaataaataaataaatgaatagagcaggaaagaaagcttttggaggtgatggatatgtttatggctagattgtcgggatggtttcataagcatattctttaaaaaacactcatgtctttggttagagaagtgaaaatttataagttaatgtttgaagggtattcaacaaattgatcactaaaattgaatctaatcattctgcaaataaaacctgtcaaacaaaattaaatrcaaatgaatctaggttcataccgaaattcatcattggctctttcttcttgaagtccaatccaccaacttgcaccatactttgatagctattgaaagaaaaaaagtcagcatttattctacttgttttcctttttcactattaagagtaatggggttgctgctaatagctttctattcttcagtattttacccaattatctaaggaagaatacactaaggcctagcatcttgagaaaacctgaaacttcattatcctaaaatattccccccattacgaagaaaaactggaatcaaacatgg

SEQ ID NO: 36371 - DNA, 601 bp, Human
tatctttctttttctctatgagccaaaccttttttcgcttacagatactaggcatagaaactgaacactcttcactaccccagagtcctggaggagaaaatgggttagaaatggcttaggaacaatggcgattctttgaaggcattctctattgatcactatttttatgaggctatggtttttcataatttattttttaaaatctagaaactgaactaaactactgatcttagatttctctagggacaacagctaactgggcaaggccaactcagtaattttaatttaagaatgtaaaaattttgcaaattaaaaaaatctaaataaatactgcaatttgaatcatagaactgattaaaatcttaagaatatttgacttgtgtagcaaaagaatactttgtagggtaacaatttcattttaaaatgttcaatttcaatgtacagagaggaaaaagattctaaaacagtagataatttctactttataattctttagaaaatataataatttagaaaaattaactcaagaacttccaagaaaacagcatttaatactgatccttaagtaaaccagactcacatatagacatgtcttcagtaa

SEQ ID NO: 36372 - DNA, 601 bp, Human
gggtttatttattgagataaatattacattacattctataaaagatcaagataaatatatgtaacaagattttcatggtaatactctgaaagattgggtttcatgtaaatgattataaaactaggaccagtttatagcatttctgacagaaataatctttacctaaacataacaagatatgttaaggcacagctttgtaggcttagtttgggtgctgcctgggtgagggtggctctttcatgtttacaattagcatcctaaaggttggaacaagcaggggctatgactcccagagagagtsgcagctgactgatgctggtaaaagagatttccaaatgtatgcatttcatgcagtgctgtgtatcacagatttgaaaagtccttacccactaataaacctgtgaaagaaaataatgcattcaataaagtatcataacatagcataacataaaataaataagggaactccagagggactttatttcagagagcaagcatgagagttagacacatccatgctgagatcccggctccaccacttactagctgcgtgaccatgggcatgttaccttgcacttggtttctttatctataaaagaga

SEQ ID NO: 36373 - DNA, 601 bp, Human; identical to SEQ ID NO: 33121

SEQ ID NO: 36374 - DNA, 601 bp, Human; identical to SEQ ID NO: 33122

SEQ ID NO: 36375 - DNA, 601 bp, Human; identical to SEQ ID NO: 33123

SEQ ID NO: 36376 - DNA, 601 bp, Human; identical to SEQ ID NO: 33124

SEQ ID NO: 36377 - DNA, 601 bp, Human; identical to SEQ ID NO: 33125

SEQ ID NO: 36378 - DNA, 601 bp, Human; identical to SEQ ID NO: 33126

SEQ ID NO: 36379 - DNA, 601 bp, Human; identical to SEQ ID NO: 33127

SEQ ID NO: 36380 - DNA, 601 bp, Human; identical to SEQ ID NO: 33128

SEQ ID NO: 36381 - DNA, 601 bp, Human; identical to SEQ ID NO: 33129

SEQ ID NO: 36382 - DNA, 601 bp, Human; identical to SEQ ID NO: 33130

SEQ ID NO: 36383 - DNA, 601 bp, Human; identical to SEQ ID NO: 33131

SEQ ID NO: 36384 - DNA, 601 bp, Human; identical to SEQ ID NO: 33132

SEQ ID NO: 36385 - DNA, 601 bp, Human; identical to SEQ ID NO: 33133

SEQ ID NO: 36386 - DNA, 601 bp, Human; identical to SEQ ID NO: 33134

SEQ ID NO: 36387 - DNA, 601 bp, Human; identical to SEQ ID NO: 33135

SEQ ID NO: 36388 - DNA, 601 bp, Human; identical to SEQ ID NO: 33136

SEQ ID NO: 36389 - DNA, 601 bp, Human; identical to SEQ ID NO: 33137

SEQ ID NO: 36390 - DNA, 601 bp, Human; identical to SEQ ID NO: 33138

SEQ ID NO: 36391 - DNA, 601 bp, Human; identical to SEQ ID NO: 33139

SEQ ID NO: 36392 - DNA, 601 bp, Human; identical to SEQ ID NO: 33121

SEQ ID NO: 36393 - DNA, 601 bp, Human; identical to SEQ ID NO: 33122

SEQ ID NO: 36394 - DNA, 601 bp, Human; identical to SEQ ID NO: 33123

SEQ ID NO: 36395 - DNA, 601 bp, Human; identical to SEQ ID NO: 33124

SEQ ID NO: 36396 - DNA, 601 bp, Human; identical to SEQ ID NO: 33125

SEQ ID NO: 36397 - DNA, 601 bp, Human; identical to SEQ ID NO: 33126

SEQ ID NO: 36398 - DNA, 601 bp, Human; identical to SEQ ID NO: 33127

SEQ ID NO: 36399 - DNA, 601 bp, Human; identical to SEQ ID NO: 33128

SEQ ID NO: 36400 - DNA, 601 bp, Human; identical to SEQ ID NO: 33129

SEQ ID NO: 36401 - DNA, 601 bp, Human; identical to SEQ ID NO: 33130

SEQ ID NO: 36402 - DNA, 601 bp, Human; identical to SEQ ID NO: 33131

SEQ ID NO: 36403 - DNA, 601 bp, Human; identical to SEQ ID NO: 33132

SEQ ID NO: 36404 - DNA, 601 bp, Human; identical to SEQ ID NO: 33133

SEQ ID NO: 36405 - DNA, 601 bp, Human; identical to SEQ ID NO: 33134

SEQ ID NO: 36406 - DNA, 601 bp, Human; identical to SEQ ID NO: 33135

SEQ ID NO: 36407 - DNA, 601 bp, Human; identical to SEQ ID NO: 33136

SEQ ID NO: 36408 - DNA, 601 bp, Human; identical to SEQ ID NO: 33137

SEQ ID NO: 36409 - DNA, 601 bp, Human; identical to SEQ ID NO: 33138

SEQ ID NO: 36410 - DNA, 601 bp, Human; identical to SEQ ID NO: 33139

SEQ ID NO: 36411 - DNA, 601 bp, Human
aggttcaagtgagtctcctgcctcagcctctcaagtagctgggattacaggcatgcaccagcacgcctggctaattttgtatttttagtagagacagggtttctccatgttggtcaggctggtctcgaactcccgacctcaggtgatccgcccgccttggcctcccaaagtgctgagattgtacccagcccccttttttttttttttggagatggagttttgctaatgtctcccaggctggagtgcaatggtgcaatctcagctcactgcaccctccacctcccaggttcaagcaattctyctgactcagcctcctgagtagctggaactacaggcatgcactactacgcccggataattttgtatttttagtagaggcagggtttcaccatgttggccaggctggtctcgaactcctgacctcaggtgatctgcccgcctcggcctcccaaagtgctgggattacaggcgtgagccactgcacctggccaacactttccctttttcagtggaggatttgaaagttggctgcctctgtctagttaaaagaaggcactaaaaattagatgtacctctggagtacaagaagatgaagggtatg

SEQ ID NO: 36412 - DNA, 601 bp, Human
atgcaccagcacgcctggctaattttgtatttttagtagagacagggtttctccatgttggtcaggctggtctcgaactcccgacctcaggtgatccgcccgccttggcctcccaaagtgctgagattgtacccagcccccttttttttttttttggagatggagttttgctaatgtctcccaggctggagtgcaatggtgcaatctcagctcactgcaccctccacctcccaggttcaagcaattcttctgactcagcctcctgagtagctggaactacaggcatgcactactacgcccrgataattttgtatttttagtagaggcagggtttcaccatgttggccaggctggtctcgaactcctgacctcaggtgatctgcccgcctcggcctcccaaagtgctgggattacaggcgtgagccactgcacctggccaacactttccctttttcagtggaggatttgaaagttggctgcctctgtctagttaaaagaaggcactaaaaattagatgtacctctggagtacaagaagatgaagggtatgactaagttttcttattgaccagcaataaaatttgaagctatgtttggataac

SEQ ID NO: 36413 - DNA, 601 bp, Human
gttcaaataatgttattatgagcattcatatacaagattgttttttttgttttgaacaacagttttcagttctcttgagtaggtacccagaaatgggattgctggatcattgcatggtaattttatgtttatttaaaagttaaataattttagaaaaccaccaaactgttttctacagtgcctgcaccattttacattcctaccagcaatgtaggagggttccagtttttccacatcctcgccaacaattattttagtttgtgtgtatttaaaatttttttaaaaattatggccatctgartgagtgtgaaatggtatctcattgtggttttgatttgcattttcttaatgtctaatgatattgagcaccttttcatgtgcttattggccatttgtttatctttgaagaaattatatagatcctttgcccgtttttaaattggttgtctttttattagttgtaaaagttctctttctagatacaagttacttatcagatacataattggcaaatattttctcccattctgagttgttttttttttttttcactttcttgatggtgcgctttcatgcatagaagttttaaattttgatgatg

SEQ ID NO: 36414 - DNA, 601 bp, Human
agtaaatgtttcatagactagctgaaacacagagtagctttttcaccctgaatgttgaactatgaaatattattttgagttttaattatagtttaagtagcagttattgttttccaaacaaatgtatttcataaatgtgccaaacttaaattattcttgaactttttcagaaatactaacattaaaggaagtatttcagattgcaagtaatggtaagccctataatttgcacacttatttcttgcagtgatgtatttgtttatcagtgcatatctgtggccagattctttgtaataattgaaaaaaaaccaattaaaaataagtgaacattacttaaatcagtattgctacttaaattacactgtttatacagtgtaatttaagaaaaatcttaaggaaattaagtcttacaggttactatcttcataatgcctaaagaggtagtgtaatattttacccttcttgttcttttatatatcccaatttttctttaatgagtgttatatatatatatattttaagatacagggtcttgctctgttgcccaggttggagtgcagtggcttttcaagccacaatcatagcatactgtagtgatcct

SEQ ID NO: 36415 - DNA, 601 bp, Human
aggaaaagaagacacagtgcagataagagaaaaaaagaatacaaatgcagaaatggcaggtttatgaaactagcagtgtaattaaagattcttttttttgagacagagtcttgcggtgttgcccagactggagtgcagtggtgctatctcagcccactgcagcctctgcctcccgggttcaagcgattctcctgcctcagccttttgagtggctgggactacaggcctgcgccaccatgcccagccaatttttgtatttttaatagagacagggttttgccatgttggccaggctggtctygaacttccaacttcaggtgatccacctgcctcggcctcccaaagtgctgggattacaggcgtgagccaccacgcccagccaagttaaagattcttgatagagaatacaaaactgaaatgtgcatacaagtcacttaggggtcttgttaaaatgcgtaatatgattcagtatgtctggggtgatacagcgtgaattcccagttttgcaaattatattttgtgtggcaaggatatcaaaccagatgaaccctgaagtgtagacacagccacaggtgcagtccaaacatacaggtagaaccca

SEQ ID NO: 36416 - DNA, 601 bp, Human
ctgaaatgtgcatacaagtcacttaggggtcttgttaaaatgcgtaatatgattcagtatgtctggggtgatacagcgtgaattcccagttttgcaaattatattttgtgtggcaaggatatcaaaccagatgaaccctgaagtgtagacacagccacaggtgcagtccaaacatacaggtagaacccaggggtacagagaattctggaaggagtcaagtaggtactgcagtatagttggaagaggacttgactctaggacaggagctgcctgacctctgccactcttagtgggcctgtcygtgctatgggagtccaggcaactcctggctgatgatttcagctgaggctgggagggctaatttctttgggaggctctcactcttctaaattgtaatctgctgttgatgtaatggtggattagatgggaggcctagactagtttagtaactgattgatatgaaggatgaaagagatgactaaggtaaagatgacttccaggttttaaacccaagggaagagaagaagaatttgggaaagaagagttctgtttttatcttaacggctttgaggtgccagctaaggaatgcctaggaggaagt

SEQ ID NO: 36417 - DNA, 601 bp, Human
tgagtcattgtttagttgtatgatgaatattctcaccaaagcagttaaaatttttccttggctgtgattgaaggaaacatgacttaaggcaaatcatttattaagtagagtggacacctaataaactgataatatattaatttggatatacatggctgtgacccagaaaaagtcatttacatttgatcacagaaatacacttagcatttgatgtaataggacacatactaaagagattaatttcctgttatcttactgtcagtgtttttttagaaccacttagctctctgcttccaaaacytactttgttttgttttgagatggggtctcactctgttgcccaggctggagtgcagcggcatgatcatagctcactgcagctttgaccttctgggctcaagggatccacctgcctcaccctcctgagtacctgggaccacaggcgtgcgccaccacacccagctaatttttaaatttctttggtagagacgggttcttcctgtgttgccctagcagatctcaaactcccaggttcaagcagtcctcctgcctcggcctcccaaagtgctgagattacaggtgtgagccacaatgcccagcc

SEQ ID NO: 36418 - DNA, 601 bp, Human
acttagcatttgatgtaataggacacatactaaagagattaatttcctgttatcttactgtcagtgtttttttagaaccacttagctctctgcttccaaaacctactttgttttgttttgagatggggtctcactctgttgcccaggctggagtgcagcggcatgatcatagctcactgcagctttgaccttctgggctcaagggatccacctgcctcaccctcctgagtacctgggaccacaggcgtgcgccaccacacccagctaatttttaaatttctttggtagagacgggttcttyctgtgttgccctagcagatctcaaactcccaggttcaagcagtcctcctgcctcggcctcccaaagtgctgagattacaggtgtgagccacaatgcccagccctccaaaacctactttgagttgtacttttcttccttcactgtggtgtgccacaagccatgcacactaaggaggaaggtagcttccatctccagttcacttttctttttgcattgttacttacgctttaagaaatacaggtttaaaactagattataggtaacttgtaacatgtacttacagaacctaaaaagaagttt

SEQ ID NO: 36419 - DNA, 601 bp, Human
gagattaatttcctgttatcttactgtcagtgtttttttagaaccacttagctctctgcttccaaaacctactttgttttgttttgagatggggtctcactctgttgcccaggctggagtgcagcggcatgatcatagctcactgcagctttgaccttctgggctcaagggatccacctgcctcaccctcctgagtacctgggaccacaggcgtgcgccaccacacccagctaatttttaaatttctttggtagagacgggttcttcctgtgttgccctagcagatctcaaactcccaggktcaagcagtcctcctgcctcggcctcccaaagtgctgagattacaggtgtgagccacaatgcccagccctccaaaacctactttgagttgtacttttcttccttcactgtggtgtgccacaagccatgcacactaaggaggaaggtagcttccatctccagttcacttttctttttgcattgttacttacgctttaagaaatacaggtttaaaactagattataggtaacttgtaacatgtacttacagaacctaaaaagaagtttttacaattccaggacattcttggcatttttctca

SEQ ID NO: 36420 - DNA, 601 bp, Human
tcttctatgtggctcatggtaactgaccatgtgttcatattttcttctaaactttttaggcgtacaaatccatttggagaatctggaggaagtacaaaatctgaaactgaaggtaagacagatgtgcagcattcatatattttagaactgcttctcagcaaactgtgaataatttattgtttatatttgctctgctactaagctcagttttaatgctatctttacttcagaatttcctctacttacttatagtacacttgaagcaacagaacttaatctgacttaagatgttgtgattcayacaaaacgatagactctcatacttttgactttatagtcaaattcagtgcctaagatacctttcaagcttttcctaacagctgatgtttctcttctggtactggagcataaattttgtttttccgccactaactatttatttgaattctaaacttacagaaatgctgtaagaaccaccagttgttgtgtgtttgtgtgtgtgtgtgtgtgttgagacagggctccctatgttgcctaggctggtctcgaactcctgggctcaagggatcctcctgccttagcctcccaaagtgctaggatt

SEQ ID NO: 36421 - DNA, 601 bp, Human
tagtttacaaatattttctcccattctgtggcttgtttcttcactttgttgattgtttcctttgcagtgcagaaactttttaacttgatgagatcccatttgtccatttttgctttagttgcctgtgcttgtggggtattactcaagaaatttttgcccagactgatgtcctggagagtttccccaatattttcttgtagtagtttcatagttcaaggtcttagatttaaggctttaatccattttaattatatttaaaaaaatttaaaaaaaaataaaaaaaataaaaaaaaattttttwaaaaaatatttttgtatatggtgagagagaggggtctagttttattcttctacatatggatatccagttttcccggcaccatttattgaagggactgtcttttccccaatgtatattcttggtgcctttgtcaaaaatgagttcgctgtagttgtgtggatttgtttctggattctctattctgttgcactggtctatgtgtcttttttttttttttttgccagtaccatgctgttttggttactatagctctgtagcattgtaatttgaagtcaggtaatgtgatttctctaattttgt

SEQ ID NO: 36422 - DNA, 601 bp, Human
atttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcrgctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaaga

SEQ ID NO: 36423 - DNA, 601 bp, Human
tgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggaytaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaa

SEQ ID NO: 36424 - DNA, 601 bp, Human
gcagtgactagagtccagacatcagaactagttccatgttttttttttcactaccagtccctaggccccaaaccgcagatcctgctgtgtgaccattaagcccctgactgttctaggctcaacttccaaccctttctgcaggtcctattacctctgcctcatcctcccaacatgataaccagagtcttccttcacattgtactgcctacccccttatgttcccaggctctcccttggttttcttacctccttgcagtccattttcagatcctgtccattgatctccacccgcacaatgatsacctcataataccactcccgccggatgggtgtataccagagactgcctgtgtacagcgagtggtcgatacctccaatgatctagggaaaaaaagaggcaggtacccgtgtcctggcacagaaggagagtgagtcccccaaggaccaagcaataagatcagtgatttcttggggtggcaaggtcttctacaggctacccttttcatcttcctgcttctaaacaaatcatacccaaagtgatttctagtttcttaaatgtgttcaggagaaaagactttccgggatttttaattatttgttt

SEQ ID NO: 36425 - DNA, 601 bp, Human
aagactcttcattctatcaccctgtctcacaaaagacttgcccaaggctacgaagcaaggcagtgactagagtccagacatcagaactagttccatgttttttttttcactaccagtccctaggccccaaaccgcagatcctgctgtgtgaccattaagcccctgactgttctaggctcaacttccaaccctttctgcaggtcctattacctctgcctcatcctcccaacatgataaccagagtcttccttcacattgtactgcctacccccttatgttcccaggctctcccttggttttmttacctccttgcagtccattttcagatcctgtccattgatctccacccgcacaatgatcacctcataataccactcccgccggatgggtgtataccagagactgcctgtgtacagcgagtggtcgatacctccaatgatctagggaaaaaaagaggcaggtacccgtgtcctggcacagaaggagagtgagtcccccaaggaccaagcaataagatcagtgatttcttggggtggcaaggtcttctacaggctacccttttcatcttcctgcttctaaacaaatcatacccaaagtgatt

SEQ ID NO: 36426 - DNA, 601 bp, Human
gtgacagccataaaggggaagagttttttttttttttttgaaacagtgtctcactctgttgcccaggctggagtgcagtggcgcaatcatggctcaccgcaacctccaccgtcctgagttaaagtgattctcctgtctcagccccctgagtagctaggattacaggcgtgcgccaccacacccagctaatttttgtacttttagtagagatgggatttcaccctgttggtcaggctggtcttgaactcctgacctagtgatctgcccaccttggcctcccaaagtgctgggattacaggcrtgagccaccacgcctggctaggggaagagtgttttaagagctctgagtagaagggtctaagtgcagacatcttggctgttgctgaagaatgtgactctcaccgcctccctctgacactgtaccatctcttttacccccatccttagtccactcacggaggaggctgccttgatggatttgactgcagcttcaaacactttcttgggcaaacgaaggttggtggtgccactgtccacaatgctcttgtcatagttgtactaagagggaaaagagagagttaaaagagtcaaaaggtttttg

SEQ ID NO: 36427 - DNA, 601 bp, Human
atgaacttggtccccactacctagcccaagaaccagcctgggtacccacgtaccattaggagcggggaggggaagaacaggataggggaaaaagatgaccttcatcaaggagctcttgtggtggaggacataaggaagccctgaggctgccatcctttctccaggcagccttgatactgaaggcagtaatgttagagccataaagcactgtatttctcatactcttggtataatgctagtgccactgtgtgatgctttagtcaaataaatggaggggccattagagagggtaggaaggcartgaaaccactctgaattatgtaaagatcttgctacttcttatagcctaataggaagaaatccaggcaggggttatagggcatcagctgttgaatgaatgttcaacattatgcttttaaggattagatagaagaggtctcctacctattccttttagcaccttggctgcaaagctccagaggaagatttgggggaaagagtgagcctatgaccaggaagacagagcccagccctgctatagtccagttgctctcccacagggcacctggagcttagggggttaggatatttcagtgctgcc

SEQ ID NO: 36428 - DNA, 601 bp, Human
ttaaggctcatgtatgcagatttaaagcctggtgctcacccactgtccaaccagatgccttgcttaccgaaagcctccagaagcctcagtattgttttagccactctactccaaatggataaaatgagactctgattgaggaaaaaaaagtaaccctagtagtttgacttcttattgaatattttactgtgttaacgctcattatttatacagacattaggtttacagaatattctgttttacatcaccaaaattcacagtccgagaataacaacataaccaggtcccaattcctccatgyaccccacaagcttctgtccaccctattttctggacagaaattagcacaacccacaggtttttcctgggccaagtcttcctttgctgccactgtcttggcttctaatcaagctctgacaggccaacattgtgaagtcctcaccctttcccattcacttctggtctcctagtctagctaatccccctcccccagaaggttaaggcagttggttcacaaccaagttgtttggtgaccttgggtgagctccagacaggcactggggtgaggagatgtctgtgcaaaattacttgtagaatgatc

SEQ ID NO: 36429 - DNA, 601 bp, Human
aaataaatagtcacatctttctacacagttgcaatcagaatgtacatgcacagggtagttattgctgtgtctcactgcattcctgaaactatcagtaggctgttggtagaacagacccttcactgctttgtactgacttctgggcacagtagaatctaagataaaatttcttgagagaacctagctctgctctaccctcacacaccccttattcctcccaccaccccactgaggaggaaactctgtaagactatacagtatctcttgtaagccctacagtttttgatggttacagttttcyttcgtttttttttttttttttttttttgagatggagtcttgctctgtcgccaggctgtagtgcagtggtgcggtctcagcttactgcaaattccaccttccaggttcaagcgattcccctgcctcagcttctcaagtagctgggattaaaggcatgtgccaccacgcctggctaattttttgtattttagtagagacggggtttcaccatgttggccaagacagtctcgatctcctgacctcatgacccacccgcctcggcctcccaaagtgctgggattacaggtgtgagccatcgctc

SEQ ID NO: 36430 - DNA, 601 bp, Human
gctggttacagttttctttaagaggaacatgatatatttagggagtagataaagccagttcatatttgtatgaccctaaatgtgtaccaaacaaagataaggagttattcacaatgcagaatctgtacttttccttttttataatacattgttcaatgttgccagtttttagtgattgttcttatagtctatctcggatgtgtaatgtgtactttttcttttgattgctagaactttgcttgtacttgccacatgagttggaagtgtactggtagggagctttagtttgcattttaaatgygtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccaggtaagaaaacatcttagaaaaaagctccttgatagaatggtgggacagtgttttagaagcctgaggttctgggaaaattacctaaatgctctatctctttgtttattattggtgaa

SEQ ID NO: 36431 - DNA, 601 bp, Human
tatttagggagtagataaagccagttcatatttgtatgaccctaaatgtgtaccaaacaaagataaggagttattcacaatgcagaatctgtacttttccttttttataatacattgttcaatgttgccagtttttagtgattgttcttatagtctatctcggatgtgtaatgtgtactttttcttttgattgctagaactttgcttgtacttgccacatgagttggaagtgtactggtagggagctttagtttgcattttaaatgcgtgatagtgatttgttttgcttccttgctgatcrgacaatgatgatcttcccttttcacagaggagaaggccaatttggagaataagttactggggaagaatggaactggagggctttttcagggcaaaactcctttgagaaaggctaatcttcagcaagctattgtcacacctttgaaaccaggtaagaaaacatcttagaaaaaagctccttgatagaatggtgggacagtgttttagaagcctgaggttctgggaaaattacctaaatgctctatctctttgtttattattggtgaaatgggctaattcatttcatgataaatgtaaaact

SEQ ID NO: 36432 - DNA, 601 bp, Human
aatttttttttttttttttttttgagactggcgtctcaccctgttgtccaggcaggagtgcagtggtatagtctcggctcactgtaacctccaccacctgggttcaagtgattctcctgcctcagctgcccaagtagctgggattacaggcgcccaccagcatgcccggctaatttttgtatttttagtagagacagggtttcaccatattggccaggctggtctcaaactcctgaccttgtgatccgcccacctcggcctcccaaagtgctgggattacaggcgtgagccactgcacccrgtcaatatttatctttctatgcctgacttacttcacttaacataatgtccttcaggttcatccatgttgccatgaatgacagaatttcattcttttttatggctaaatagtattccattgtatatatatatgccacattttatctgttcatctgttgatggatacttcagttgattccatatcttgactattgtgaatagtgctgtaataaacataggagtgcacatagatatctcttcgatgtactgatttccttctttttggatatatacccagtagggggattgctggatcatatgg

SEQ ID NO: 36433 - DNA, 601 bp, Human
cgggttcaagtgatcctcctgccccaacctcccaagtagttgtgactacaggcgcgcaccaccacacccagctaatttttgtatttttagtagagatggggtttcgtgatgtcggtcaggctggtcttgaactcctgacttcaagtgatcctcccacctcggcctcccaaagtgctgggattagagtcatgaaccaccgccctcggcctcccctatgtttttagttgtttcatagtttaaggtcttacatattagtctttaatccattttgagttgatttttgtatatggtaagaaatagrtgtctagtttcatttttctgcatttaaatatctagtttgatcagcaccattttttgatttttcaaatttaaattttattttagagatgaggtcttactctattgcctaggcttgtctcagaattcctgggcttaaacaatcctaccacttcagcctcccaaagctagcaccatttattgaaaagactgtccctccaccaaggaatgttcttggtgctgttgtcaaaaatcagttggctataaatacgtggattttttcctgggttctctatcctattccatttgtctgtgtgtctgtttt

SEQ ID NO: 36434 - DNA, 601 bp, Human
cctaccacttcagcctcccaaagctagcaccatttattgaaaagactgtccctccaccaaggaatgttcttggtgctgttgtcaaaaatcagttggctataaatacgtggattttttcctgggttctctatcctattccatttgtctgtgtgtctgtttttatgccagtaccatgctgttatggttactatagctttgtaatgtattttgaaggctggtaatttgatgccttcagctttgttctctttgcataggattggtttggctatatggggtcttttgtggttccatgtgaattttrggttttttttcttgagacagagtctcactcttgttgcccaggctggagtgcagtggtgcgatcttggcttactgcaacctccgccccccgggttcaagtgattctcctgcctcagcctctggagtagctgggattacaggcatctgccaccacccctagataatttttgtatttttaatagagatggagtttcaccattttggccaggctggtctcgaactcctgacctcaggtgatctacctgcctcggcctctgaaagtgctgggattacaggcgtgagctactgcgcctgtcctgct

SEQ ID NO: 36435 - DNA, 601 bp, Human
ccctagataatttttgtatttttaatagagatggagtttcaccattttggccaggctggtctcgaactcctgacctcaggtgatctacctgcctcggcctctgaaagtgctgggattacaggcgtgagctactgcgcctgtcctgcttatacattatttatggctgttgtattcttactaatttttctttccatttgttccatcaattagagagagaggtagtgaaatctcagactgtaattatggatttgtctctttatctttataatttttgcttcatatagtttgaagctactattaratgcataaatgtttaggattgttatgtcacgttgatgaattggccactttaatttaatttaaatttaatttaatttaaatttaattttttttttttttttggctggacgtgatacctcatgcctgtaatcccagcactttgggaggctgaggtgggcggatcacaaggtcaggagttcgagaccagcctggccaatatggtgaaaccctgtctctactgaaaaatacaaaaattagccgggtgtggtggtgcgcacctgtagtcccagctactcgggaggctgaggtaggagaatcgctg

SEQ ID NO: 36436 - DNA, 601 bp, Human
acaaggtcaggagttcgagaccagcctggccaatatggtgaaaccctgtctctactgaaaaatacaaaaattagccgggtgtggtggtgcgcacctgtagtcccagctactcgggaggctgaggtaggagaatcgctgaaacctgggaggcggaggctgcagtgagccaagatcatgccactgtactccagcctgggcgatagagcaagactccatctcaaaaacaaaaaattatatacatatatatacacacacacatacacacatatatatacacacaagcatatatatatgtacatayatctaatatacatgtatgtgtgtatatatgtacatatacatgtatgtgtacatacatgtacacatacatgtatatgtatatatttttgagacagggtctcactctgtcacccaggctggactgcagtggagcaatcacgcctcactgcagcctctacctcctgggcacaggtgatcctcttacctcagcctcttgagtagctgggaccacagatgccactaccatgcctagctagtttttgtattttttgtagagacagaattttgccatgttgcctaggctggttttgaactcctgggc

SEQ ID NO: 36437 - DNA, 601 bp, Human
taattggaataaatgcatctattttagccttgacatgctatgctattattttgtgtgtgcgtgtgagtctctctgccccaaaaatatttctttaggagatgaaccaaatgattgttctctgaaatgaataatgcctaaactatgttttcatggcctatcttttcttccctgtcatcttgttgcagtttaattcctttatcaggagtcagttcatatgctatgtgattaagtgctgtttcttccatgaagcctttacttgtttcttattctgttttgtttttttgtttttgtttttttttttgcagacagggtctcagtgtgtcaccccatctatagagcagtggcatgatcacagctccctgcagccttgacctcctgggctcaagtgatcctcttgcctcagcctcctgagtaactgggactacaggcacattccaccatgtctggctaactttctcagtgttcccataacactttttttctatttcgttaaaaatgtttatcaaggctgggcttgtagttcatgcctgtaatcccagtactttgggaggccaaaatgagaggattgattgaggccaggagtttgagaccagcctgggca

SEQ ID NO: 36438 - DNA, 601 bp, Human
gctttttttaaaggtagtaccttaggctggcaaataggcaagccctggatacatcatttctgtttcaaccaaagtagcttttataaactggtcttctgtataagatttaactggaactaaggtttctgtggcttagacagggtgtgtgtgtgtgtgtgtgtgtgtgtgtgtgtgtgtgtgtgtctcatctccaattattttccttggcctttgagtgctgactagcttttggtcttccgcagttgacaacacttactacaaagaggcagaaaaagaaaatcttgtggaacaatccattccrtcaaatgcttgttcttccctggaagttgaggcagccatatcaagaaaaactccagcccagcctcagaggtaagactttggaatctcaaagtggtggttatgataataatgttcaaaggatagttactggacagaacatctattatgtgtctatactgtgtttatggacacctttatgttactttttttttttttttttttttgagacggagtgtttcgctcttttgcccaggctggagtgaagtggcatgatcttggctcactgcaacctctgccccaccgtgttcaagcaattctcctg

SEQ ID NO: 36439 - DNA, 601 bp, Human
ttacgatgttgcctaggctggtcacaaactcgagctcaagcaatccacccacctatgcctcccaaagtgttaggattacaggcatgagccactgcacccaggccagagtagagtttataatcagagtttagtgtttaccctctctgtggttttcttgcttctgaaattttgcctcaaaaatttcatcttttttttttttttgagagagggtcttgctctgttgcccaggctggagtgcaatggcatgatcttggctcactgcagcctcgacctctcaggtgtaagcaatccttctgccttagcctcctgagtagtggagactacaggtgcagggcaccaggtggccagctaattttcgtattttttgtagagatagtgtctttccatgttgtccaggctggtcttgatctcctgagctcaagcgatctgcccacctatgcctcctagagtgctgagattacaggcgtgagccaccatgcccgacacatgccatccttttttttttttcagacgagtctcgctctgtcgcccaggctggagtgcagtgggcgatcttggctcactgcaacctccgcctcccgggttcaagtgattctcctgc

SEQ ID NO: 36440 - DNA, 601 bp, Human
atcatgtaaaaatgaaagccaagagatgtgccactcctgtaatcatcgatgaaattctaccctctaagaaaatgaaagtgtgagtagccacaacttcttactgccaagggcagacatattgtaccttgtataccacttgtaagtttcttttctgaatttacactttagattgaatagattaaaattaaaaatggtacatctgtaatatgtttggtgtacctcaagcttgagaaatgcctaaaactgtgaccatggtgaggtgaattgttacgtgtgtcctggagggcactcacatcttagytggcataggttttacctctttttgtttttacggctaataacaagctgcatacatgatgtttgtttatatttttattagttaagaatgtattttgctgcaagtaatagtcttcaactggagtggtttaaagaataatgaattatttgtttcacagaggtctaaaagtagtttgctgctggctttggttcagtggctgatttttagctttttttttttttttttcgtacttgttcttcaagatgctgctctgtgtttcttagattttttcttttgcttgttgtctcactggcacaagatggc

SEQ ID NO: 36441 - DNA, 601 bp, Human
gggatttagtcggctttacttctgagtttcttccttctgttacatgtgttttatgtgtattaaccctaggttgtagatactttcctcattctactggtctttttttgtttttgtttttgagacagggccttgctgtgttgcctaggctggtcttgaactcttgggctcaagcaatatttttgcctcagccttccaagtagctgggattacaagggcatgccattgcactaggcttctactggtcttttagtttttcttgtggcttacaacctaatcttttttgttgttgttgctgttgttrtttttggagatggagtctcactctgttgcccaggctggagtacagtggcgtgatcttagctcactgcaacctccacctcccgggttctagcgattctcctgcctcagcctcccgagtagctaggattacaggtgcctgccactacatctggctaatttttgtatttttagtaagatggggtttcaccatgttggccaggttggtctcgaactcctgacctcaggtcatccacccgcctcggcctcccaaagtgctgggttacaggcatgagccactgcacccagtccaatctcatcgttt

SEQ ID NO: 36442 - DNA, 601 bp, Human
caagaggtggtggagatgcggaaaaagaatgaagaattcaagaaacttgctcctggctggaataggtgagcttggctgtggttgagtctgattcatgaggggtggttcttaacactccttggtagggggtttttttttttttttttttttttttttttttttgagacggagtctcgctctgtcgcccaggccggactgcggactgcagtggcgcaatctcggctcactgcaagctccgcttcccaggttcacgccattctcctgcctcagcctcccgagtagctgggactacaggcgcccrccaccgcgcccggctaattttttgtatttttagtagagacggggtttcaccttgttagccaggatggtctccatctcctgacctcatgatccacccgcctcggcctcccaaagtgctgggattacaggcgtgagccaccgcacccggccagtaggtgtttttgaagtctctgaagtaaataaaaaggctttctcatttagtagtcagcataaaaaagatgtgtttattccttagcactttctacatatattggtattttacatatattggtacttaaatatatcggtactttctttcttt

SEQ ID NO: 36443 - DNA, 601 bp, Human
taaaaatgctagtactaataatctccacttgcatttgtagtcagtatcatcattttttgaaattagttatttgcattcttaaaccctgaggttatgcttctttctttgagatacaggtccttgaagggttttgcttccaattagagaccagttttatcaaaattactggtccaaggaataggaataggcttcttcatcagtctctttaggggatgtatggagagattccactgattcaggaagctgcctgacctgatgcatacccagaggcccaatcaatttttttttttaaagtggagtkgagggtgagatttctttgcagtgctttttgtcttcaattctaagatagcttactctggattccttcaaaacattgacatggttggggggaaattacctatgtactattccagaacataagatttgttaagtgctagatcctttcttccatttttaattttttttaatgagaacagattagttataacccttgctcaaggactgacaaacttcagaataataatcttggttttacacaggccttttttattgatcctctgtgccgaatatgtggcttatggtagatgtgagctcttccgtg

SEQ ID NO: 36444 - DNA, 601 bp, Human
ccagctactttttggattttaagtagagaccaagttttgctctgttggccaggctggtcttgaactcctggcctcaagtgatccgcccgcctcaacctcccaaagtgctgtgattacaggtgtgagccactgcgcctggccaagtacagcattttttaatattattattatgttctagtggccaaaatgattttgttagattttatagtatgaaaataatgaaatattcttctttattctaatggaaatttaaatattaagcataacttttcaaataatatatgactcagagtctgatatrtcctgctttcagaatactagtcctggcaaaaggaaagagaaattatattatgcaatttttatttaaaactttgtacagttacagctaaataatggttacatgtatctttgaaacatggcttatttctaaaatagatttggttttgatctaccactgttatgtgacaagacctaaattgaaagattcattctatattagttatgaaaattgacaaggtttcactggccaggtaaattaatattttcaatgagtggtggtgatgtcttaatattgatgctttaacatagtttttaactttct

SEQ ID NO: 36445 - DNA, 601 bp, Human
ataattggcattgtcaatagaaagtataggcctggccaggcacagtggcttaacgcctataatcccagcactttgggaggctgaggtgggtggattgcttgagcccagtagttcaagaccagcctgggcaacatagtgaaaccctgtctctacaaagaatataaaaattagctgggcatggtggtgcatgcctgtaatcccagctgcttgggaggctgaggtgggaagatcacctgagtccagggaggttggatttgtagtgagcctttatgcccctgcactctagcctgggcaacagagtgagaccctgtctcaaaaaaaagaaagtcagtctaggcccgtgcagtgataaggaacctgtcagacatggatggattttcagttcagaagatgacagtagagtttacccaaaggctaccttagtcatacccctcaataaaagaggaataggggagaagtaactgaatgttggttggtttgaccaatgtaagctgagctgactgttgtgggcccaccactctgtggttggtttatccctctctgggctacataggtgaatcaccacttacaagtaaactgggtcttgcggatctagatgaac

SEQ ID NO: 36446 - DNA, 601 bp, Human
cctgatacctacttttgattgagagctttttgcgtgacttctgttcacgatgcttttttttccctgccatgatgcatatgtactatatgccaagctctgttacaataaactgttaagaaatcttcccccacccaagtgattaatctccaagggctgtgccttctttgtctttacccattgaggaaacagtgttgtgaatacaacaagggaaaagtaggttatatgcaaacctcagagttgtagagccagaagggctcaacgtttagttttacatacaagataatggagccccagataagakaaattatttcttcagggtttctataacactcttttggcaccttgcttttggttttttgttttgttttttttttttgagttggagtttagctcttgttgcccaggctggagtgcaatggcgtgatctcggctcatggcaacctccgcctcccgggtttaagcgattctcccaccttagcctcccgagtagttgggattacaggcgcatgccaccacgcctggctaattttcgtatttatagtagagacggggtttcgccttgttagcccggctggtctcgaactcctgacctcaggtgatc

SEQ ID NO: 36447 - DNA, 601 bp, Human
cacctgtactcctagctactcaggaggctgaggcaggagaattgcatgaacccaggaggtggaggttgcagtgagctgagattgcaccactgcactccatcctgggcaacagagcgagactctgtctcaaaaaaaaaaaaaaaaaaaaaagtctttgaacttctagtgttggacttttacagcagaatttaagagcccaccttccagagcctgatgcagcttgtctgtctgatgcttttgttccccatccacgtcccccccagtgctgaagctgtttcgtgtgtccttacagtgtttcctstgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgctgacctctattgggcagccggggcaccacggaggtggatgtggtgtcagtgagaccagtgagtaattttagcagagatactttagggatgacttggggagggcagcaggcttttttaaaatatatatac

SEQ ID NO: 36448 - DNA, 601 bp, Human
tgtccgcctcggcttcccgaagtgctgggattacaggtgtgagccaccacacccagctacatgttttcaactctttttttgtttggtttgagacagagtgtcgctctgtcacccaggctggagtgcagtagtgcgatctcggctcactgcaacctccgtctcccaggttcaagtgattctcccacctcagcctcccgagtagctgggattacaggcgcgtgccaccacgcccagctaatttttgtgtttttagtagagacaaggttttgccatgttggccaggctggtctcaaactcctgrtctcaagtgatctgcccaccgtggcctcccaaagtgctgggattacaagcatgagctgctgtgcccaatcaactctttaaaaatgtaaaaaccattcttagctcaagcgctgtcctaaaacaggttgcaagctggatttggcctgtaggccagagtttgctgacccctgctctaagtgatcacctgggaatgtcccctgctccaagtgatcacccggggaatgtgggaaccgacaggcttttctggagttgggagtttctttaagatcttatctattccatctattagactcattcattg

SEQ ID NO: 36449 - DNA, 601 bp, Human
gtgctgggattacaggtgtgagccaccacacccagctacatgttttcaactctttttttgtttggtttgagacagagtgtcgctctgtcacccaggctggagtgcagtagtgcgatctcggctcactgcaacctccgtctcccaggttcaagtgattctcccacctcagcctcccgagtagctgggattacaggcgcgtgccaccacgcccagctaatttttgtgtttttagtagagacaaggttttgccatgttggccaggctggtctcaaactcctgatctcaagtgatctgcccaccktggcctcccaaagtgctgggattacaagcatgagctgctgtgcccaatcaactctttaaaaatgtaaaaaccattcttagctcaagcgctgtcctaaaacaggttgcaagctggatttggcctgtaggccagagtttgctgacccctgctctaagtgatcacctgggaatgtcccctgctccaagtgatcacccggggaatgtgggaaccgacaggcttttctggagttgggagtttctttaagatcttatctattccatctattagactcattcattgtgtttattcctttctgttgat

SEQ ID NO: 36450 - DNA, 601 bp, Human
aaaatgcaaacttgggaatcttaaaagtatcttaaaaatgctttctagttctcagtgagttcaaatgttgtcagactgatctgttcattgtaaagtttgtgtgaaagatttttactagggtttatattaaatctgctatttttattgatgaagcagttcagacattagaacttaagttattgaggtagtggtcatagaaaggtgagacattgctcatctgactgactttctctctaatagctggaagaagaactgagacagcagaaagaagcagcttgtttcaaggctcgtccaaacaccrtcatctctcaggagccctttgttcccaagaaagagaagaaatcagttgctggtagtattatatgtactctgatgggactcgggcagaattgtcagacttcccagtgggatgctggaattcagtgtgtcagtacaatgctgtgtcaactagaagcatttgactttagcagatggtagcttttcttcccctagacccagttttttgcctttattgaacccagcagctatgttgagttgcaggatgtgttagggccagattcatttaacatgaaccttggcagaagcagctggcatttcaaca

SEQ ID NO: 36451 - DNA, 601 bp, Human
ttctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatgggga

SEQ ID NO: 36452 - DNA, 601 bp, Human
ttttaaaaatgatcattcttaatctaatttcttattatgttactttctttagagaccaagaagcgtcagtgtaaagttctttttgagtacattccacaaaatgaggatgaactggagctgaaagtgggagatattattgatattaatgaagaggtaaggaaaaaatgtgttacaggtaaaacagtaatggtaattgatgctatggattttagaaaaattaattgtaagaatattagtcttttgtgagaactgttgtcactttttaaaaaaaatggtatagagtttctttactcatccttgytgtatttatatatgtatttgtatttcctgcctttaggaataaaaatgcccccttaaagctaaaaattaatgaaatctaagtagttaagaacgtaaacaagccttttctttgattctgaatttaccataggcaaaaagcagtgaaatagaaggaattttgccttagaaggaatacaaagcaaaatctttttaaacgctttgccttgtttgaattatcacattcaaatattaataaaaatactttcctatattttgatatcttagaatgggattttaaaatattttaaaaatagatcatgga

SEQ ID NO: 36453 - DNA, 601 bp, Human
gggagacaccccaaatgctcagtcacagcaagatccacccaaggagagtctgagatcagaaatgcctagccccgcccgcacctaatggtcctttcctacccaccctagtaactgatgacaaagggcatatactcttgggagctctaaggccccgcctatcacctgttcctccccatactacatagctgatgctctcttgaaagtgccatctcccagcaggagaccaaccagcacaaaaatagtgcattaaacagccagagctaaggaccttcacagagttcatttcaataccccgcccgcyggtcccaaccaccacttccaccagagcaggtgctggtatccacggctaagagacccacggatggttcacatcacgggactctgtgcagacaacccccagtaccagcccggagcctggtagacttgctctgtggcagaagagagataatctctacagttcaactctcaggaagccacatccctaggaaaagagggagagtactacgtaaaggagcaccccatgggacaaaaagaaactgaacagccttgagccctacacttccctctgacagagcctacccaaatgagaaggaatcagaaa

SEQ ID NO: 36454 - DNA, 601 bp, Human
tgctgtgggaagtttcagcaatagaattgaacaagcagaagaaataacttcagagcttaaagacaaggtttttgaattaacccaatccaacaaagacaaagaataagaaaatatgaaccaagcccccaagaagtctgggattatgttaaacgaccaaacgtaagaatagttggccttcttgaggaagaagagaaatctaaaagtttaaaaaaaaaattgggggaataatcagaaaaacttacccagccttgctacagacctagacatccaaatataagaagtttaagaacacttgggaaawttatcacaaaaagattattgcctgggcacattgtcatcacgttataattggctttcctgaggaagaagagaaatctaaaagtttaaaaaacatatttgggggaataatcagaaaaacttccccggccttgccagagacctagacatccaaatataggaagttcaaaggacacctgggaaatttatcacaaaaagattatcacctgggcacattgtcatcaggttatctaaagttaagatgaaggaaagaatcttaagagctgtgaggcagaagtaccaggtaacctataaaggacagtct

SEQ ID NO: 36455 - DNA, 601 bp, Human
agcagaagaaataacttcagagcttaaagacaaggtttttgaattaacccaatccaacaaagacaaagaataagaaaatatgaaccaagcccccaagaagtctgggattatgttaaacgaccaaacgtaagaatagttggccttcttgaggaagaagagaaatctaaaagtttaaaaaaaaaattgggggaataatcagaaaaacttacccagccttgctacagacctagacatccaaatataagaagtttaagaacacttgggaaatttatcacaaaaagattattgcctgggcacattrtcatcacgttataattggctttcctgaggaagaagagaaatctaaaagtttaaaaaacatatttgggggaataatcagaaaaacttccccggccttgccagagacctagacatccaaatataggaagttcaaaggacacctgggaaatttatcacaaaaagattatcacctgggcacattgtcatcaggttatctaaagttaagatgaaggaaagaatcttaagagctgtgaggcagaagtaccaggtaacctataaaggacagtctatcaaattaacagcagatttctcagcagaaacc

SEQ ID NO: 36456 - DNA, 601 bp, Human
ttgtcatcaggttatctaaagttaagatgaaggaaagaatcttaagagctgtgaggcagaagtaccaggtaacctataaaggacagtctatcaaattaacagcagatttctcagcagaaaccatacaagctagaagggattttctatcttgagcctcctcaacaaaacaattatcagccaagaattttgtatccagcaaaacttagcttcataaatgaaggaaacatacagtctttttcagacaaacaaatgctgagagaattcactactacgaagccagtactgcaagaactgctaaaargagctctaaatcttgaagcaaatcctagaaacacatcaaaacagaacctctttgaagcataaatctcacaggacctataaaacaaaaatagaagttaaaaaacaaagacaaaaaacaaaaaaactcaggtatataggcaacaaataccatgatgaatggaatggtgtctcacatgtcaatactaatgttgagtgtaaatggcctaaatgctccatttgacatatacagaattgcagaatggacaggaattcaccaaccctctgctgccttcaagagactcacttaacacataaggaatca

SEQ ID NO: 36457 - DNA, 601 bp, Human
aaatccaaataagctcagttagaaacaaagcaggagatattacagttgacaccacagaaatacaaaaggtcattcaaggctactgtgaacttttttctgcacataaactagaaaacctagaggagatggctgaattcctgtaaagatacaatcctccttgattaaatcaggaagaattacatatgctgaacagaacaataacaggcagcgaggttgaagtggtaattaaaaaattaccaacaacaacaaaaaagatccaggaccagacgaattcacaccagaattctaccagacattcaartaattggtaccaatcctgttgacactgtttcacaagatagagagagggaaccctccctaaatcattctgtgaagctagtatcatcctaataccaagaccaggaaaggacataacaaaaaaagaaaactacagaccaatattcctgatgaatatagatgctaaaatcctaaacaaagtactagctaactgaatccaacaacatatcaaaaagataatacaccacgatcaagtgggtttcatatcagggatgcagggatagtttaacatacgcaagtcagtaaatatgatatgtcacataaa

SEQ ID NO: 36458 - DNA, 601 bp, Human
caacatgtatgttttgataccatgtattatagcacagattgattttgtgtcaaaacaccctgtaatgtaatttatcactagtgtttttatgtttatacaaacttagattgtgtttatacaaaggctgttctattttattttcacttggttgcagtaataatagttaacatttcttgagcttatgttatggttgaagcattgtgctgagagtttcacatttattatatccttgaaagttttaaaaaacctaagaagataggtatttttatccccattgtacataggaagagactaaatcaargaagataagtggtggctgttttagttactgttgttgcataccaagccatcccaaacttggtggcaaagaataacggttgtattatgcctgtgagtcaagaattcagatggggtatagcccaaatggcttgtgtggggcccttagctggaaagattcaatggtggggtgtcctggaataataggaaggttttttcactcacatatctggtgcctagaaaccttgaagactgtaactgccaattggagagccattatgttagcctttccatttgggttgactctcttacagtgtaggcatct

SEQ ID NO: 36459 - DNA, 601 bp, Human
taatagacagctgatgtttctctccgtttgttgtatttattctagtttggtctacatctagtttggatcacttccagttctttggtgcttctttaagtctgataaaaattctggtcacttcatgctttactgccttccctttctcccccaaacagcttgtattctagcacccatttttattttagctataccttccatgaataaatcatttatttttaagttactatagttttacttttattcagcctttaatatcacattgtttttgtcatttccttttgggggggagcattttttttttattctttcaagccctttctgtttgctcctaacagcattttgttcatatgttagttatagtacctcttaaattgtattgtagccatctgcttattgattttttctttaagtgttttattgaagaacagggatttctcatatgcaagtttgaatctttccctagtagttaacactgtgactaacacatattggctgttagatgactaacttagtaaaaggttgcctaccttttatgagatggaaaacaattaaaaatattttaaacaagaaataaatctttttctagctatattgtgtgtag

SEQ ID NO: 36460 - DNA, 601 bp, Human
gtctgataaaaattctggtcacttcatgctttactgccttccctttctcccccaaacagcttgtattctagcacccatttttattttagctataccttccatgaataaatcatttatttttaagttactatagttttacttttattcagcctttaatatcacattgtttttgtcatttccttttgggggggagcattttttttttattctttcaagccctttctgtttgctcctaacagcattttgttcatatgttagttatagtacctcttaaattgtattgtagccatctgcttattgwttttttctttaagtgttttattgaagaacagggatttctcatatgcaagtttgaatctttccctagtagttaacactgtgactaacacatattggctgttagatgactaacttagtaaaaggttgcctaccttttatgagatggaaaacaattaaaaatattttaaacaagaaataaatctttttctagctatattgtgtgtagtgctgctaagtaaaatttgacagtgaatagtttactcttttttaaattttgtttttttttttttgagctggagtctcactatgttgcccaggatgg

SEQ ID NO: 36461 - DNA, 601 bp, Human
gaagctatgtacttcttgctgttaatacagtatatatggttatctgatactttcatgaaaagtacttcatagattgcgattgattacaaattgtcattgtaaatgtgcgaagtactgttgatgtatgattaatcccatatatgagtaatacactaaaatttaatccacttaaaatatattttcttcattgtgttttaaattttaaagggtttatttcatagtgctaattttgtgcctgtttgcttttgcagcttaattttcccatagggtgacgattttcacttaacagaagttgtttttrcttttgaattgtgaactttttcaggtagaagaaggctggtggagtggaaccctgaataacaagttgggactgtttccctcaaattttgtgaaagaattagaggtaacagatgatggtgaaactcatgaagcccaggacgattcaggtagactattttttaaaatttttaattgatttaaataaactttatatagcatctagtgttttattttgtattttttgaaactctgttctttcttttgaactttgagtcagcttcaattagtctactttaaaaaagcaaattatgatggggaccta

SEQ ID NO: 36462 - DNA, 601 bp, Human
aggctttaaaataaaaccttaagctgttaatttggtggtaaaatagctacagtctgtagaacattttttcacagttccttctatcagtcctatctctttaactctgaagaaattatagtatttcagtatttatttgattcgtgtagctacatctcatttaaagactgtgttttggttattgagatactattaagtttcctcctaagataggtggtttcaactttttttattcctttcctaacttgctacgtattttcttatgtagcagtgaagagttgggttcaggaaagagaacttccaytttctatcctacatattcctagctctgagactatctggcattaggattgtggggtcaaattgattcttggttttaaaggtaaagtttggaattctcatggtttttggggtggtgctctatagccatgtaacagctaggaatgttggacaagcaattcttggcattgtgatagaaattagactagatgatcttgtgccccttctaactctaaagcttaggattatattgaataactttagttgattaatgattatattatcttttaatcatccttgataatgtctactactcaagagttgt

SEQ ID NO: 36463 - DNA, 601 bp, Human
gaaattgtatttttatttaatgttgttgaaaagctctagtttattttaaggtcttgtggatattgctgttatgctgttggtgcatttttttgggagggcaagagcactctgcctccttacagaatttgttatttttgtgtcacttctcagagaaaaagtgaggctgagtcattcatcagtggtcttttgccttcctacaacttggtcccttttccccatggatgaggaatataatagagtttttagaatagagggaaagagcatcaacacaagcacacaacaggatgggctaccatgttargtttaagccaatgcataactctccaactctatggaagcttaggctgtctgaggcctttgttttgttagattgcattcagtattgattcagccttcatatgctttattttatagttttactaaagaatacgtttttctgcttttattatgtttgtacattacggcttatcaattattcttaatttgtaaaaaccaagtccaccaacttagaagtgtatatcaatattttaaggtattaagtcttaaaaatgagcgaatgtttataaattgagaaaaaacatgtctttgcctttaactgttc

SEQ ID NO: 36464 - DNA, 601 bp, Human
gaagcatattattcagtttgctattttccattttttaaaattctaaaatggtaaaattggatctaatgcaaactattgatttttatcaagtatgatgtctgtaaacatttttagaaatatatgaaaattgagtgttcacatgcattagtatctgtcatttttcttaaagtacaaatggtataaaatagggatcttgaaaatgtagatactttatatgtaattttgagttaataaaattaatcaaatttaaactgttttagaaaacttaatatattgacctggccaactagttattctaccktttcaaatgaaatccatttgttaatgtctcaaataataatttatgtactcttcttttcagggaatatgctgaaggttaaacaaagtagatgattttaaacagatgaataaattatggtagacctagaagtgtcttcaagagttaaagttttgtaatctggctctttgcttccataattttcgaataattgatctttacaagtgtaataaaaatttctatttcctaaaagatttgctgtttttttagaataattcaagtctttttgtcgcccttggttttagctttatatttgctgaccta

SEQ ID NO: 36465 - DNA, 601 bp, Human
aaaatagggatcttgaaaatgtagatactttatatgtaattttgagttaataaaattaatcaaatttaaactgttttagaaaacttaatatattgacctggccaactagttattctaccgtttcaaatgaaatccatttgttaatgtctcaaataataatttatgtactcttcttttcagggaatatgctgaaggttaaacaaagtagatgattttaaacagatgaataaattatggtagacctagaagtgtcttcaagagttaaagttttgtaatctggctctttgcttccataattttygaataattgatctttacaagtgtaataaaaatttctatttcctaaaagatttgctgtttttttagaataattcaagtctttttgtcgcccttggttttagctttatatttgctgacctaatcctagagcaaagaaaacataagttaaaagtaatttttatagaagttggtgttgaaagctttttatatagctttactcttcaatgtggtagccactaaccatgtgtggcttttaaacttaagattaaataaaatttaaaaattcagtttctcagtcataggagtgccatttcaagtgttc

SEQ ID NO: 36466 - DNA, 601 bp, Human
gtgtatttattgtatacaacatgatgttttaaagcgtatatataattcattgtggaatggcttcggtaactgtgataacctcacatagttaacatttttatgatgagaacacttaacattcactcttagcatttttaaagaatgcggtacatcacattaactgcagtcactaaaatgtacaatggatttcttaaaacttattccctctatctaaccgtatgtattccttgaccacatcttcccactcccctccaactcacaaccacttcaggctctggtaatcaccattctactctatttytatgggatcaacttttttagacttcacatttgagtggagaacatgtggtatttgtctttctgtgcctggcttatttgacttaacatcctccagattcgtcgatgatgttgcaaatggcaggcttgctttctttttttatggctgaatggtattctttgtgtatatatgccacattttctttattcattcatccattgatactttaggttgcttccatattttggctgttgtgaatagtgctgtagtaaacatgggaatgcatatatttctttgacatattgattttatttcctttggata

SEQ ID NO: 36467 - DNA, 601 bp, Human
accatttgatccagcaatcccactactgggtatctacccagaggaaaataagttattatatgaaaaagataacttgcacatgcatgtttatagcagcacaattcgcaattgcaaagtatggaaccagcccagatgcccatgaatcaacgagtgaataaagaaattgtggtatatatatataccatggaatactactcagccgtaaaaaagatggaaaaaatggcattcacagcaacctggatggaattggagactcttattcaagtgaagtaacttaggaatggaaaatcaaacattgtaygttctccctaatatgtgggagctaagctgtgaggacacaaaagcatgagaatgatacagtggactttggagacttgaggggaaagggtgggaggggagtgaaggataaaagactgcacattgggtacagtgtgcactgctcgggtggtgggtgcaccagaatcttagaaatcaccactaaagagcttattcatgtaaccaaatgccacctgtttctcaaaaacctgttgaaataaaaaataatctaaaataataaaaaaaatttaaaaaaaaatacaggagcattctgtacattttgatt

SEQ ID NO: 36468 - DNA, 601 bp, Human
tagactttgattcacttacagtaaggacctccaaagaaacaggtaagtcagcatggacagcggtggtgcatttaaaaaaaaaaattgtcaaagaaactctttaagagatatatttatgcaatttgtgtgtggataaagttggataaagttgaaattacacagttgaaatttgtttaaaatttagcagccaaagtagaaataataaaagaagataagtaaaatttttatggtccttactgatcagactttatggtttcttactgatcagaggactgaaatagatgttaaaagatgacccatstattactccctctttatagtggaatgactgtactacccaacggagatatgaatacactttagttttaaaagtttaaaaatgagatgacatagactttcagtgccagcattagattatatttcataggactttaaatttctcctcttaatctagagatacttttatttccagtggaggaaaatatgctttttctaacccttttgctaatttttttttaagctttaggactggtttttcagcttactgatatctttgtctaatctgtacttcctgttttttttttaatacctattattattt

SEQ ID NO: 36469 - DNA, 601 bp, Human
ggtgaaaattatccttattaattgtttgataaacagaaaaagaatcctcatgttttaaaaaatcattcttttttattgagcttatcagtaaatagaatttgatcagttcatattgttttctgtttgatttaaaatatagctagaaatgtgtttcataggttatagttgaagaaaagcagattatttgcccaattttaactctggaaacaaaaaagttattgcaactatattttaaattttcacaaatttgggggatctttatcacataagtctttaaatgttgatggagtccctttgggarttgaaggagtaaaatctggaatccacatcttgctttgtattcatcttgaatgttttacttagtttatgtcaaagtaatggaattttttttaaaatttaggtaaattacaacattttctttttttcgaaacttttcctatatagtgtcacaacacactgccatatttctagtaaaaataatatatgtaataatttcaaactattgatgattggaaagttctgtttttacttggtttgggggaccctatttctatcttttatacatagctgttatttactccctatatagtaaacagagact

SEQ ID NO: 36470 - DNA, 601 bp, Human
gtttttctgtttctttttctttctgcaagttgcttaaatatgcatttgaaaataatctctacaggctaaaatgattggattgtacttgttaaggttttttctttgtgggttgttaatgcacacatcagtgtaaaagcaattttcacccttcaaattacgacatattttaacatcttttaaaaatactgattgctttctttgtgatatttacaaataacatgacatttaaacatatatttaaattcaaccgccttcagattatataatgcatttttcattgtcatttattattatggtttgktatatttcatgattatttacaattatcaaaagactcaaaacaaaaatcaagcatattagagtatctgttttaatgaatcagcttagttgatacaagtgagaacacacaaagaaattgatagaaaaaattatcagcaaattattctagttgttataaaatgcatattaccgaacagtgatgcctttttttctgccttacctttgtgtcctccatcccttaaaagcattttctaaataagttgatgaataagttttgtgggcagtgatgatgagtatctttagatctttttaaagaaacaaa

SEQ ID NO: 36471 - DNA, 601 bp, Human
acttaacataatgaactctagttccatccatgttgcaaatgacaggatctcattcttttttgtgactgaatagtagtccattgtctatagttaccacattttctttatccatttgtctgttgatggacacttaggttgattccaattcttggctgtattcttgtgaatagtgctacagtaaacatgggagtgcagatatccctttgatatacagatttcctttttttggtatatacctagcagtgctggatcagatggtagctctatatttagttttttgaggaacttccaaatttttctscataatgattgtactcatttacattccccccaacagtgtacgagggttccctatctccatatccttgccagtatttgctattacctatcttttggataaaaaccattttaattggggtgaggtaataactcgtagttttgatttgtatttctctgatgattgttgtgaaatattcattgtttttgtagtacttgtcctcatgtctaaatgtattaacttctttgtatgctttttctacattgcctggagtactggtggtactgtaatgttaatgtattagctcttaaacactatagtact

SEQ ID NO: 36472 - DNA, 601 bp, Human
tacagatttcctttttttggtatatacctagcagtgctggatcagatggtagctctatatttagttttttgaggaacttccaaatttttctccataatgattgtactcatttacattccccccaacagtgtacgagggttccctatctccatatccttgccagtatttgctattacctatcttttggataaaaaccattttaattggggtgaggtaataactcgtagttttgatttgtatttctctgatgattgttgtgaaatattcattgtttttgtagtacttgtcctcatgtctaaaygtattaacttctttgtatgctttttctacattgcctggagtactggtggtactgtaatgttaatgtattagctcttaaacactatagtacttttaaaattacctaaatggagaaaatccttactgctaagaggcaagctgtttttgccctcaagatatgcaaatgtgttattcagcttgaaagtatatagcatcctattaataataatgggatatcagcaacagtagcagctgaaaatccataaaagttatttgctttattatccaaagacttactaccttttcttttctttggtctatt

SEQ ID NO: 36473 - DNA, 601 bp, Human
tttttgaggaacttccaaatttttctccataatgattgtactcatttacattccccccaacagtgtacgagggttccctatctccatatccttgccagtatttgctattacctatcttttggataaaaaccattttaattggggtgaggtaataactcgtagttttgatttgtatttctctgatgattgttgtgaaatattcattgtttttgtagtacttgtcctcatgtctaaatgtattaacttctttgtatgctttttctacattgcctggagtactggtggtactgtaatgttaatrtattagctcttaaacactatagtacttttaaaattacctaaatggagaaaatccttactgctaagaggcaagctgtttttgccctcaagatatgcaaatgtgttattcagcttgaaagtatatagcatcctattaataataatgggatatcagcaacagtagcagctgaaaatccataaaagttatttgctttattatccaaagacttactaccttttcttttctttggtctattatgtctcttgacttctaaaaaatcatttagccaactcacagccccgaaaaaatcttgaagttacc

SEQ ID NO: 36474 - DNA, 601 bp, Human
catctatttcgtttctccattaaacatacattcttaaggtcaggaatgaacacttgtatagtacttacctagcttggtgcttagtacaataattaagcattcagtatatactggaattaatggcagaatactgtatgtccatggatcctttcatctgttacatgtgttaggtgtcttgtcaaaatttttaccatttttatttaacatagtttcactacaactgagacatagatttaagaaggtcatttaggtttcctcccaaattatttcttgatttcatttcagggcatttttgtcagcktttccaatttattaaatacacttaatctgattctctcagctgtcagcagtctattgaaattttattaaagtgactttctatttttttagtgaaatagttaaggggtgtcaggctatggactcattttagtgactcttcctggacctattaaattgttcacaattacttttaagtgaagctctttggacattccaaacaataagtattgaatatgaaagatcaaagtaatacctttataatgctgttacattcttgcccctgtttcactaggcaaaccatccataatatacatttgatgga

SEQ ID NO: 36475 - DNA, 601 bp, Human
tgtatagtacttacctagcttggtgcttagtacaataattaagcattcagtatatactggaattaatggcagaatactgtatgtccatggatcctttcatctgttacatgtgttaggtgtcttgtcaaaatttttaccatttttatttaacatagtttcactacaactgagacatagatttaagaaggtcatttaggtttcctcccaaattatttcttgatttcatttcagggcatttttgtcagcgtttccaatttattaaatacacttaatctgattctctcagctgtcagcagtctaytgaaattttattaaagtgactttctatttttttagtgaaatagttaaggggtgtcaggctatggactcattttagtgactcttcctggacctattaaattgttcacaattacttttaagtgaagctctttggacattccaaacaataagtattgaatatgaaagatcaaagtaatacctttataatgctgttacattcttgcccctgtttcactaggcaaaccatccataatatacatttgatggatttttctttcttccttttttcttctgttaataaaattgtcattttctacaaaaa

SEQ ID NO: 36476 - DNA, 601 bp, Human
cagaatactgtatgtccatggatcctttcatctgttacatgtgttaggtgtcttgtcaaaatttttaccatttttatttaacatagtttcactacaactgagacatagatttaagaaggtcatttaggtttcctcccaaattatttcttgatttcatttcagggcatttttgtcagcgtttccaatttattaaatacacttaatctgattctctcagctgtcagcagtctattgaaattttattaaagtgactttctatttttttagtgaaatagttaaggggtgtcaggctatggactcrttttagtgactcttcctggacctattaaattgttcacaattacttttaagtgaagctctttggacattccaaacaataagtattgaatatgaaagatcaaagtaatacctttataatgctgttacattcttgcccctgtttcactaggcaaaccatccataatatacatttgatggatttttctttcttccttttttcttctgttaataaaattgtcattttctacaaaaaccactaatgattacaaatgtattctttagttgtctggtgatttttccagttgtgaacatcaaattgctt

SEQ ID NO: 36477 - DNA, 601 bp, Human
cttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatrtatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaa

SEQ ID NO: 36478 - DNA, 601 bp, Human
tatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatrtatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatc

SEQ ID NO: 36479 - DNA, 601 bp, Human
tttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatrtatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatcta

SEQ ID NO: 36480 - DNA, 601 bp, Human
ttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatagatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaa

SEQ ID NO: 36481 - DNA, 601 bp, Human
ggtagaggctgcaatgagctgagatcatgctgctgcactccagcctgggtaacagagtgagactctgtctcaaaaaaaaaaaaaaaaaagaaaaagaaaaagaaaagaaaaaccacctactgggtactatgcttattacgtgggtgatgaaataatctgtacaccaaacccccaggttgtacaatttagctatatacgaaacccatacatataccccatgagtctacaataaaagttggaaggaaaaaaaaaaaagaaataattgctttattagccttacatgatggaatattaggggggyctcatctgacttaagccgaaactgtactaatcatttggcaaaatcaggagtctttctgcctccaaatattcagtaataacatcaaaccttaacttagctatgggtcggagctgagttaataaaatcctctatatttctttttttttttttttttgagacggagtctagctctgttgccaggctggagtgcagtggcgcaatctcggctcactgcaacctccgcctccagggttcaagcgattctcctgcctcagcctactaaatagttgggatgacaggcacgtgtcgccacacccagcc

SEQ ID NO: 36482 - DNA, 601 bp, Human
tatcttaaggaaataaaccagcaacaatgatttctacacaaggtttataaaagtgttgtttgtgatactaaaaaggttacatacaacaaaaaagattagaaagatgtgtgccagaatgccaaccataataacttctgtgatcaaactgctgtgatcccagcactttgggtggccaaagcggatggatcacttgaggtcaggagttcgagaccagcctgaccaccagggtgaagccctgtctctactaaaaacacaaaaattagccgggcatggtggtgggcacccgtaatcccagctactygggagggtaaggcaggagaatcacttgaacctgggaggtagaggctgcaatgagctgagatcatgctgctgcactccagcctgggtaacagagtgagactctgtctcaaaaaaaaaaaaaaaaaagaaaaagaaaaagaaaagaaaaaccacctactgggtactatgcttattacgtgggtgatgaaataatctgtacaccaaacccccaggttgtacaatttagctatatacgaaacccatacatataccccatgagtctacaataaaagttggaaggaaaaaaaaaaaagaaataatt

SEQ ID NO: 36483 - DNA, 601 bp, Human
ggctgggaaaggggctctaagaggcatggacgaagagtcgggggtaaccaagccactggaagctcctggagactcgaggcagagcgaatctgggaacagggcaggagtcccagaatgggatgttgaggatgggggtgtcctggggctaccacagggaaggacccggcgcagagctccctccggagcccggcactgcggcccgcgccctctactccccgcgcgccggccaacaaccctcggcgctgccccgcaatcttcagcgctgcctggtgaggagctttcagacgtggctgcggtcccrgggtggccggcgggagccagggaaatgggagaaggaaggaaggagcaggttttgcccccagctccctctccccacccccgaccgaggggccatgtctcggggaggggcgctggccgagggcagagcaggagggcccaggtgggctggggctctaagaggcgcaccttttagccggggatgtcaaaggacgctggcagagtcacttctcatctaactgaccacaaatgaacgttgtaacccttcctcacccccccaatcgccagagaacctgggagctcctgggaggacaaaggccctagt

SEQ ID NO: 36484 - DNA, 601 bp, Human
catgcctgtaatcccagtgttttgggaggccaagatgggtagatcacctgaggtcaggagttcaagaccagcctggccaacatggtgaaaccccatcgctaaaattagctgggcagagtggctcatgcctataatcccagctactcgggaggctgaggcaggagaatcacttgaacccaggaggtggagattacagtgagccgagatggcacaattgcactccaggctctgtgacagagtgagaccccatctgaaaaaacaaaaacaaaaacaaaaatttgggcccagtgccatggctcaygcctgtgatcccagcactttgggagcctcagcggggcggatcacctgaggtcaggaattggacagcctggccaacatggtgaaacaccgtctctagtaaaaatacaaaaattagctgggtgtggtggcgggcgtctgtaatcccacctactccagaggctgaggcaggaaatcacctgagcccaggagacaggttgcagtgagccaagatcaggccactgcacttcagcctgggtgacagagcgagactccgtctcgaaacaaacaaacaaacaaacaaacaaaaaaacatttcctaggc

SEQ ID NO: 36485 - DNA, 601 bp, Human
atctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcgcctcaatgcggggacaggagtgagcggaggatgcccaacacctctgtcacctgctgactcccgagctgccttctggatccccacacccactcctggaaaacctggaagatgaggagagtagccccccacctccgctacaagtgcractgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggcatgatgatgtcaatttttcaggtgaaagactcaaggcttagagagacagcaagaaagctgggactccaggactcctgttccgaagctcctggcacttctgatcccaggctgtgggcctctcccacctgtgattgccccctgcaga

SEQ ID NO: 36486 - DNA, 601 bp, Human
ccaaggtcctaaagtgttcttctgtttgcacctgttgcatctgcaatgatctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcgcctcaatgcggggacaggagtgagcggaggatgcccaacacctctgtcacctgctgactcccgagctgccttctggatccccacacccactcctggtaaacctggaagatgaggagagtagccccccacctccgctacaagtgcaactgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggcatgatgatgtcaatttttcaggtgaaagactcaaggcttagagagacagcaagaaagctgggactccaggactcctgttccgaagctcctggcactt

SEQ ID NO: 36487 - DNA, 601 bp, Human
tcctctggcgtccaaccaccctgagcctttagtggaccttaagaatgtcacgcatttctcacagggtggaaggaacactgagccagcctcccgcattccaaggtcctaaagtgttcttctgtttgcacctgttgcatctgcaatgatctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcscctcaatgcggggacaggagtgagcggaggatgcccaacacctctgtcacctgctgactcccgagctgccttctggatccccacacccactcctggaaaacctggaagatgaggagagtagccccccacctccgctacaagtgcaactgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggc

SEQ ID NO: 36488 - DNA, 601 bp, Human
agaaagctccccagggtgggaacagagctgtcctgcctgccttttgcttcaggataactcgtagagagacccttttgggttgtggagctaaagggcttgatgacggtttaggcggatgtcacaccaccaccaggcttgctgaggttgaataagtctgagtagggcatttctccaaatggctgggaactggcggggtctcctgatggatggaagcgagagagctggctccaaatcccagcactgccaatggggagctatgagacctggggcaagtgacttaacttctctgaggctcaatttscacctctgtagaatgggatttgcaatatttaacctcttagagctgttgtgatggatgctgctgcaaacacctatgaggggagggcctggggaagcattccttacacacatgcccctgttactgttactgtccctgtgctgagctacatctggagagaaagaaccccctccacctggtgagtctccccacagaggagacacccacaggccacctacccttccaatccctgtatctcccaggccatcctctggcgtccaaccaccctgagcctttagtggaccttaagaatgtcacgcattt

SEQ ID NO: 36489 - DNA, 601 bp, Human
caggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaamaaaaaaacttttgtcattaaagataaacaagtaaataaagtggacaaagaacagcaactgttgtcatcactggtggggagtgaagtgctgtaggcagcatgggctccagaaggagggtgtcctggagccctgtgggtttgcaagaagatcagttgatggggagctgggatggagcccaagaagcagagaggtgagagcagagtactgtcctggccagctgaggggactcaccaccgtccagggctgctgggagagctgcaacgctgatcacaaatccatgggagatgtctcgacatctgg

SEQ ID NO: 36490 - DNA, 601 bp, Human
cacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccaygccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctc

SEQ ID NO: 36491 - DNA, 601 bp, Human
tgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaakggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctgg

SEQ ID NO: 36492 - DNA, 601 bp, Human
gcatttttagtagagagggggtttcactatgttggccaggctggtttcgaactcctgacctcaggtgatccacccgcctcagcctctcaaaatgctgggattacaggcatgagccaccgcacccggcctggcacacatttaatttaatttagcagtaacttactccctgcgcccagaagaggtaggggcaagagttgctttccatgaagagtgcacctgatgagaaggcagctccagaagactcaaaggaaaaccgagaatcaggagagaaagaaacgtgcagtccttgcctacttcaggrgaggaccccaaactcccggttgatagtagggacctgcttccccatgcgccccagctccctctccaccatgcagtcgcctcctgggcctggcgaccacagttcggggcctgctctaaggcccagagttctcagtcaggcgatgcccagctgaagtggtctgggcctcgtggcagcaccagatccagggtgaggtcacgctgctggtccgcagagtacacaggccggtagcccagcagctgcagcgcgccggcgcacacctcctgcacgcgcaggatcttagtgaagggcaacgcgtggcgc

SEQ ID NO: 36493 - DNA, 601 bp, Human
aattcgtttttttaaattagcaacttcaagtataacaactttgaaactggaataagtgtttattttctattaataaaaatgaattgtgacaaaagtggactctggcttcccctcccccctcccccccacccctctgggataaaaattttccagcattgccaggagctttcaggtacacattaaagaataaaatgaagttaagcagctggagtataggatagtatttgattttcaagatcacccaaagctgcactatcgtcccaaagctgaccaagtagaataaaaagaaaaaaaaaaaaamcaacccatgcgcaaagatagacatttgcttgatctgctggctcagggccaaatgtttaatttgcttctccaaagtcattcatcttcaaaagtctgattctgggaaactgatgccactagcctaaaagcccactgaccatgtagtgtgcatcagtttcctcttgtccagtaagcatttatccaacagaagctaagataacatctacaggtgttctctctttacttctgacagtcacctgcatggtcactccatcggctaaggccagcctggacctcaccaataaatcatagccacctctga

SEQ ID NO: 36494 - DNA, 601 bp, Human
ctcatataatgggatgatgggacaacagcaaggcataagatgcccatctatatcctattattaagctttgcaagaaaatggaaggaaaatctgatggaagcttcttacctgccagatagagcgaatgggaattcttgttctcaggtactttatcggacctctcacatggctgcatgcccagaaatgtgatgatattgttgacagcctctgtgttgagaagatgtatgagacagtattaggaaagtaaagcacagggatctccctctgcaccagtgtatgctgggagctggggtggaagggkttgttggtgaagggggttgttggtgatgtgtagagggaggctactactggactagaaaatggctgatcaattagatgatgaagacagggtgctggccttttaagtaagagatttatgaagtttttttttttttaaaggagttcttctggagtaacaaatatgcctgttaggtgttatactgttatcaggcaatatactgatagcaaaatgggtctcaccttcaagggttttggtagaactgagggcaaaggtttcctctttctcaaaggtatctcccacctcttcccaagcagcagcaaa

SEQ ID NO: 36495 - DNA, 601 bp, Human
gaccaacctggccaacatggtgaaatccagtctctactaaaaatagaaaaattagccaggtgtggtggcgcatgcctgtaatcccagctactcggaaggctgaggaaggagactcgcttgaacccgggaggtagaggttgcagtgactagagatcgcgccactgtgctccagcctgtgcgacgggagtgagactctatctcaaaaaaaaaaaaaaaaaaaaaagagtgacaattaaatgagtattagagaaaatatgctaatattttttagttttgcaaaactacttatacacagaaaaaygaatagagtgaacctgctttctgttcaaagacaggagccatagcaagaggaattgatttcatgtcaaacggtttttctgaaggctccaacgtgtactggtgtaaggctttttccatccctggtacagagaccgtcaaacctgtgaaacatagagaaatctcagcattataacctcttgccaatcctcgaatccaaataggcccaggtttgtaatatttatctaagctttctgaaggaagagaaaaatataaccaaaagctttataacctaaatataaaaataaaggatattcttgaaatt

SEQ ID NO: 36496 - DNA, 601 bp, Human
cttgaaattaccttataaacttataaactgacttatttcattcaaggaaacatgggagcatagcatacacattttcaacaaaatgtatgtacctcccagaaaagaaagcaacttagctatatgggaacaatgatagcataagaaaacgggaaaaatgtaaacccatccaagagggagttcaaggagaaccaggaataagtgagcaacgttcctaaaaaatgtaagggcccaatctatattcttatagattgctgcataggaattatcattaccaaattagaaaatatcctataaacacagktttctctagaaatggaagtgcactcaaagacaaaaaccaagcatttgcctagtgaagttagctcatatgcaaatcataaaatatgcttccaagacaccatttgaggaacaaaagtgtacatccttggctttcactgaccattaaagatatatgtggcatttagtgccatctgcctctgctgcagcacattcagatagaaggtagctctgtctcgtacctcgtcatcagtatccatcatacacctgtccaggggaaacagaatagtcatgtcacagtaccccaaagacttccaatagctct

SEQ ID NO: 36497 - DNA, 601 bp, Human
ggggaaggaaagtatagagtcagtagctagtgaaaagctcatagacagtttacatctttaatgggagagatttggatctattcatatgctaagggaaagaaagattagggaggaaaagtcgcttaaaaatatatatatagaaacacataaacaaattctacaaacattcatgcttacggctataactgaaaaaacggatgagccatcatagtattcctatcttactgaaagcgaagggttatttgtctaatctaaggcaaaaatgagggtggaaattgagtacaaagaaagatatctgggmcctaagcatgctctaaaatcccaccatccaataaatcctgcaacttcattttccaatttcattatcactctcttaagtatttcaaaagatcagcatcgtcaatatcagtgtcccaatgactcaccagctctgacagcctcattctccaggacaaccctattaaaaataaaacggatatatttggaggggacaggcgttctagggccctctttgcccaacaagtgtagaatcttagtagccagaacagtgtgttcacagtcctcaatgaattcacaaaggtgggctaggcctgcttcttta

SEQ ID NO: 36498 - DNA, 601 bp, Human
gtaaataagagataacaccatataacctttctaaaatttaactaaaagcaaattctgagacacatctggccccaagattagagatgagggattgtagacctgtatcaactctttaaaaacaatttaggccaggcttggtggctcatacctgcaatcccagcactctgggaggccgaggtgggcagatcacctgaggtcacgagtttgagagcagcctggccaacatggcgaaaccctgtctctactaaaaatacaaaaattagccggacgtggtggcaggtgcctgtgatccctgctatttgggaggctgaggcatgagaatcgcttgaacctgggaggcggaggttgcagtgtgccaagatcgtgccactgcactctagcctgggagacaaagtgagactctgtctccaaaaaaaataaataaataaaaaaccatttaaattgttgttctataaaggtttcttccatggctgctctaaacttctcttttcttcgactgtttacacaattaatttataattatgtattgcctatgacaagtcttctattacatttaactttcatttacattttctatgcttatttaatttattctgtgttt

SEQ ID NO: 36499 - DNA, 601 bp, Human
gttccctggggaaaataaataaaaggaggtttttcatcgtaaaaaaaatttaaaaagacttacatcattagattgaaacaatcgcgtcattgcaaagaaggcttctgtagcttccgttgttccaaagtgttcaccctaagtaaaatttaaaacaatttttaaattttaaaaagtgtatattcatatatatgtacatatacacacacaggattttctatttctgcaaaaatcctttagaactcaagaaaaaagaatctctttgtaaacattctgcctctgcaatttttctggctttcaatgyataaacccacatagccatttatccccccttatttaaaataattcagtatcgcataccatgcttaaaagttctggcatagtgatctctaaacttttagtagaaagtatctgaaattttcctgaagtattgtagtttacaaggagggagaaaattacagcactcacaataggacattattattacactgcctaagagcagagatcatatctataatgcccagcacaatgcctaacatgtcatgggagcataataaatattaaaatataaggaactatctattcagaatctcagcaaaatggc

SEQ ID NO: 36500 - DNA, 601 bp, Human
tgctatgaaaagttaaacccaattgactatgctttaaatgtttctcatatgctgacacagagggattatgttgtttgtgaacagatatattttatttaaaactatgtgtttgatgatcaggcacagtagctcacacctgtaatcccaggactttgggaagctgaggtgggcggatcacctaaggtcaggagtttgagacccacctggccaatatggtgaaaccccgtctctactaaaaatataaaaattagccaggcgtggtggtgcatgcctgtaatcccagctactcaggaggctaaagtaggagaattgcttgaaccagggaggtggaggttgtagtgagccgagattgcgccactgcactccagcctggtaacagagcgagactccatctcaaaaaataaaaaaaatctatgtgcttgttgcttagtcttcatttgtaaacaagaaaactttattaaatctctgagtgaggtcttcagtcacaaaacaaagtaaagataatatattctcttagaattcaaattggaaaccatggttatcttagcaccatatgtaaaccacctgaggtatatggtatatatgtatgttttatgtgtcc

SEQ ID NO: 36501 - DNA, 601 bp, Human
ggcacataaaatggttaagctactgcccagaattattctgctagtaatggtagcatagggataataaatataaaatctgaatattaacaatcaaagctttaaaacatcattacacacataaaaaagaaaatatctggaatttgcctgatcttgcactgtattttcagaaaaacatgaagatctccaaatacatgtaaacaacatgctctaactagtactcattaaattgaaaccaaaggatttattgagaatctactatgcgcatcactggtttaggatctcatgaataaaaaggaagtayaggttaaacatctctaatctcaaaatccaaaatctgaaatgctccaaaatcagaaattttttgagtgccaatataacactcagtggagacactcatcagagcattctggatttcagatactcagattagcaatagtcagtgagtatgtattctgcaaatattccaaaatccaaaaaaatctgaaatccaaaacacttctggttccgagcattgcaaagaaggtatactcaacctgtatatgtcatagtcctcgtactcaagttttacatattattttgttaaccaaacgttgtatatgtt

SEQ ID NO: 36502 - DNA, 601 bp, Human
agtgaatttaaaataaataaatatactttccagaaagtatttcactgaatcttcagtatttctattccaggacacacttatctgaggaaaataaaaataatatacctggttcagtaagtaaagaatctttgtaagaatatgcaaacatcttcttggattgattggagtttcattgaatatacgagcctatgaaaaaacataaaaaacattgctacttttctaccttttctatcacagattatagcaaatcaactttaatacagactatttttaatcacggtatccaaagaacattgtctayagttctcaatttactaaggtatctgataaattattacacgtggccttgattttccatcctatactttctcattcccttaggttgactacttcaactttatgggctataccagttaaataaggatcacaatacttatctatatcatactaatacaatgagattaatacagataactgatttcaataaccttgcactaaacacctgttcttacatttaaaattcccaacctgtgacagtcttcatgtctttgcatttctataagctccaaattctcctgtgacaagtaacccctctttcttt

SEQ ID NO: 36503 - DNA, 601 bp, Human
ccagcctgggcgtgatatggtgagaccttgactctacattaaaaaaaaaaaaaaaaattagccgggcttggtagcatgcccctatggccctaagctactcaggatgctgaggtgggaggactgcttgagcctaggaagttgaggctgcagtgagccatgatcgggtgccactgcactccagcctgggccacagagcaataccttgtcttaaaaataaaaaaaaaagggccaggtacggtggctcacacctgcgtaatcccagaactttgggaggccgaggcgagtggatcacaaggtcaaragagaccatcctggccaacatggtgaaaccctgtctctactaaaaatacaaaaattaaatttaaaaataaagtaaattaaaattgcaaaaattagctgagcatgctggggcgcgcctgtagtcccagctactcgggaggctgacgcaggagaatcgcttgaacctgggaggcggaggttgcagtgagccgagatcacacctctgcctggcgacagagcggaactccgtctaaaaaaacccgaaaaactgaagtctattagttatggggtgtggggagcaggaggacgaaacagcattcat

SEQ ID NO: 36504 - DNA, 601 bp, Human
ccagctacttgggaggctaaggcaggaggatcgcttgagcctgggaagtagaggctgcagtgagccaagaccgtgccactgtactctagcctggttgagaccctgtcccaaaaaaaagagtgggccaaagcactcaacagatcccttacgaaaccagatacacagatggcaaacaagcatatgaaaagatactccacatcatatgtcagcagggaaatgcaaactagaacaatgagatgccacacacacctatcagaatggcaaacatccaaacactgacaacaccaaatgctggtgaggrtctggagcaatagcaacccttgttcactgctggtgagaatgcaagatgctgcagccactttggaagacagttcaccacaagcttgtccaacccaaggcccgcaggctgcatgcagcccaacacaaatttgttaagctttctcaaaacgttacgagatttttttttttaagctcatcagcaattgttagtgtattttatgcgtggcccaagacatttcttccaatgtggcccagggaagccaaaagactggatacccatggtttagcagttcttcacaaaaattaatagtcttaccacata

SEQ ID NO: 36505 - DNA, 601 bp, Human
tcgtgcctgtaatcccagcactttgggaggctaaagcaggtggatcacctgaggtcaggagttcaagaccagcctggccaacatgacgaaaccccatcactaactaaaaaatagaaaaattaggccgggcgtggtggtgggcacctgtgatcacagctacttgagaggctgaggcaggagaatcgcttgaacctgcgaggcgtaggttgcagtgagccaagatcgccccattgcactccagtctgggcgacaagaatgaaactgtctcgaggaaaacaaaaaagaaatacaaaacttagcmtggtggcatgcacctgtagtcccagctacttgggaggctaaggcaggaggatcgcttgagcctgggaagtagaggctgcagtgagccaagaccgtgccactgtactctagcctggttgagaccctgtcccaaaaaaaagagtgggccaaagcactcaacagatcccttacgaaaccagatacacagatggcaaacaagcatatgaaaagatactccacatcatatgtcagcagggaaatgcaaactagaacaatgagatgccacacacacctatcagaatggcaaacatccaaacactga

SEQ ID NO: 36506 - DNA, 601 bp, Human
accacatttcctcaaaaaatacaaaattggccgggcatggtggctcgtgcctgtaatcccagcactttgggaggctaaagcaggtggatcacctgaggtcaggagttcaagaccagcctggccaacatgacgaaaccccatcactaactaaaaaatagaaaaattaggccgggcgtggtggtgggcacctgtgatcacagctacttgagaggctgaggcaggagaatcgcttgaacctgcgaggcgtaggttgcagtgagccaagatcgccccattgcactccagtctgggcgacaagaaygaaactgtctcgaggaaaacaaaaaagaaatacaaaacttagcatggtggcatgcacctgtagtcccagctacttgggaggctaaggcaggaggatcgcttgagcctgggaagtagaggctgcagtgagccaagaccgtgccactgtactctagcctggttgagaccctgtcccaaaaaaaagagtgggccaaagcactcaacagatcccttacgaaaccagatacacagatggcaaacaagcatatgaaaagatactccacatcatatgtcagcagggaaatgcaaactagaacaatga

SEQ ID NO: 36507 - DNA, 601 bp, Human
gcgggatggatcccttgaggccaggtgtttgagaccagcctgagtaacaatagtgagaccccatctctacaaaaaatgtaaaaattagccagggatagtggcacgcacctgtagtcctagctactccagaggctgaggcaggaggatcacttgaacccaggagtttaaggctgcagtaagctgtgatcatgccacaacattccagcctgggcaacagagcaagacatttctcctaaaaaaaaataaggccaggcagggtggctcatgcctctaatcacagcactttgggaaaccaaggcargaggactgcttgggtccaggagttcaagaccagcctgggcaacaatagtgagactccatcgctacaaaaaattttacaaaaattagccaggtgtgttaacgtgcctatagttgcagctacttgggaggctgaggtgggaagatcacttgaacccgggaggtcgaggctgcagtaagctgtgattgcgcactgcactcagcctgcatgacacagagaccctgtctaaaaaaagaaaagagagaaagagagtgagaaaacagaaaaggcaaaccacagcctaggagaaaatatgtataaaag

SEQ ID NO: 36508 - DNA, 601 bp, Human
ataccacaagtccaccatcatccctacagctgccaagatcacagatgtacaaagacacggggcctgacactagtgagaagcactgctcaagacagagaaagaaaagtccgattcattcgactcagccagtctcactggggccttcaaatcacaggggcacccacataaggagtcaactggcctctgacaaagcagcagagggatgcaatggtgcaaaggcattttcctcaataaacgctgctggaacaactggacatcctcatgaaagagaataaatctagaccagaccgtataccctccrcgaacataaattcaaaatgaatcacaggcctggcacggtggctcacgcctgtaatcccagctttcaaggaggcagaggcaggaggattgcttgagcccaggagctcgagacctgcctgggcaatatagtgagaccccgttctccacaaaaagtgggggaaaaaaaagacaaaatgaatcacagacccaaatgtaaaatgcaaaactatgcaactcctagacagtaacacaggagaaaacttagatcacctggggtttggcagactgtttagatacaaaaccaaaggcacagcccatgaga

SEQ ID NO: 36509 - DNA, 601 bp, Human
ctgggtgacacagcgagactccatctcaaaaaaagaaaaagaaaattatcccaacaatacaactcagaaatctcatatgacaacaagtacagcacagtgatttgtaaccttacttttaatccaaaaaggtctggatcttctctagaagatgccatacccacacctccagcaaaacccaacatggagaagataaccttactaaatagtaacaaacacaactggtaaagttcaatgttccagaaacacggcaggggaaaggagatgcactgtcagctgtcttggtcagagaggccagctctaycctgtcgaggaagaagaaagcacaggcaaagaagagagcagaggatggtggcgggggaagcgtgggcacagccagcaggtgactcatccatgctcatgacccctagcctggactgcaaggatgttctcagccaaataccacaagtccaccatcatccctacagctgccaagatcacagatgtacaaagacacggggcctgacactagtgagaagcactgctcaagacagagaaagaaaagtccgattcattcgactcagccagtctcactggggccttcaaatcacaggggcacccacat

SEQ ID NO: 36510 - DNA, 601 bp, Human
acaccactgcattccagcctgggtgacacagcgagactccatctcaaaaaaagaaaaagaaaattatcccaacaatacaactcagaaatctcatatgacaacaagtacagcacagtgatttgtaaccttacttttaatccaaaaaggtctggatcttctctagaagatgccatacccacacctccagcaaaacccaacatggagaagataaccttactaaatagtaacaaacacaactggtaaagttcaatgttccagaaacacggcaggggaaaggagatgcactgtcagctgtcttggkcagagaggccagctctaccctgtcgaggaagaagaaagcacaggcaaagaagagagcagaggatggtggcgggggaagcgtgggcacagccagcaggtgactcatccatgctcatgacccctagcctggactgcaaggatgttctcagccaaataccacaagtccaccatcatccctacagctgccaagatcacagatgtacaaagacacggggcctgacactagtgagaagcactgctcaagacagagaaagaaaagtccgattcattcgactcagccagtctcactggggccttcaaa

SEQ ID NO: 36511 - DNA, 601 bp, Human
tcaacttttccttaattaacggcctgaaaaagaggatgctcctgagccctggtcctgtttcataggccttgaactgtcaagcttaaattatcccaacaggctgtgcgcagtggctcacccctataatcccagcgctttgggaggctgaggcgggcggatcacaaggtcaggagatcgagaccatcctggctaacatggtgaaaccctgtctctactaatacaaaatattagctggacatggtggcaggcacctgtaatcccagctactcgggaggctgaggcaggagaattgcttgaaccyaggaggtggaggttgcagtgagccgagatcacaccactgcattccagcctgggtgacacagcgagactccatctcaaaaaaagaaaaagaaaattatcccaacaatacaactcagaaatctcatatgacaacaagtacagcacagtgatttgtaaccttacttttaatccaaaaaggtctggatcttctctagaagatgccatacccacacctccagcaaaacccaacatggagaagataaccttactaaatagtaacaaacacaactggtaaagttcaatgttccagaaacacggcagg

SEQ ID NO: 36512 - DNA, 601 bp, Human
ctttgaaaatgcatctggaggctgggtgcagtggctcatgcctgtaatcctagcactttgggaggctgagatgagtggatcacttgaggtcaggagtttgagaccagcctggccaacatggtaaaaccccgtctctactaaaagtatgaaaattagctgggcacggtggtgcatgcctataatcccagatactcgggagactgaggcaggataatcgcttgaactcaggaggcagaggttgcaatgagctgagatcgtgccactgcactccagcctgggtgacagaatgagagactgtctccccaaaaaaaaaaaaaaaagcgtgtggaaaatataatccaaataccaactatggttctatctgtgaaacaatctctagctacataaatgtttgctcttcttattgataaaaccaaattaatctagcaaagagataaaaggaatataagaatcacgaaactctgcagagtaatctgaggcatgtcactcgtactcgcattcaagggcagtcctgggtccacacatctgtgctcgcctgacaggaggccaagtggcactcacctccttggcaccggtgaaggccacaccagaaaatgcgtat

SEQ ID NO: 36513 - DNA, 601 bp, Human
ctcatcccatctccctccaaatgctgtcctgtttccggaggaaaggtaggaccagaaaggctgtgactgcaggccacacatcacacaacagcacaatgagctgagggaaggcgtccacgagaacctcccacagagcctgcggctctgtcagctgatccgcacagcaggaagaagcaaaggaatcatgagtcttgtcctccttattatacaacgtaatacttcagaggggaaggactcaagctaacacatgaagaaatggcagaattaaaaagtgagggcgtggccgggcacggtggctcgmgcctgtaatcccagcactttgggaggctgaagcgggaggatcacttgggcccaagagttgttatagcgagctttgcttgttccactgtactccagcctgggcaacagagggagacgccctctttcaaaaaacgggggaaaaaagtactacaaatgaaccatctttgaaaatgcatctggaggctgggtgcagtggctcatgcctgtaatcctagcactttgggaggctgagatgagtggatcacttgaggtcaggagtttgagaccagcctggccaacatggtaaaaccccgtctctact

SEQ ID NO: 36514 - DNA, 601 bp, Human
tgccagtccccgccacccacagcccaggccccatggaggccctcccagcgcagctacaggcctgctggccaggagcaaacagtctatgtacagaacccctggagacccccggcctagaacgcctgcagcacagagcagctgggtccggacacaggcacgaggtccttggcagtgtcttttctgccacacacacgccagggtctcctctcccgtggaagagcaggaagaagacaggcactcctagagcctgttatgtgccagcctagtctcatccactggcccttcttgccagggctgtgcsagcaccctctctccctcccttactcatcccatctccctccaaatgctgtcctgtttccggaggaaaggtaggaccagaaaggctgtgactgcaggccacacatcacacaacagcacaatgagctgagggaaggcgtccacgagaacctcccacagagcctgcggctctgtcagctgatccgcacagcaggaagaagcaaaggaatcatgagtcttgtcctccttattatacaacgtaatacttcagaggggaaggactcaagctaacacatgaagaaatggcagaattaaaaagtgaggg

SEQ ID NO: 36515 - DNA, 601 bp, Human
tttcgaaagtcgtaaaaacaggaaaaaatgaggggacatttggtgaggtaccaagatgtgagactgtttatattgtggctcgtttaatttttagaacctcaaacgtgtcggtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagaacccctggagacccccggcctagracgcctgcagcacagagcagctgggtccggacacaggcacgaggtccttggcagtgtcttttctgccacacacacgccagggtctcctctcccgtggaagagcaggaagaagacaggcactcctagagcctgttatgtgccagcctagtctcatccactggcccttcttgccagggctgtgccagcaccctctctccctcccttactcatcccatctccctccaaatgctgtcctgtttccggaggaaaggtaggaccagaaaggctgtgactgcaggccacacatcacacaacagcaca

SEQ ID NO: 36516 - DNA, 601 bp, Human
gcttagtgtagtctaggtttttgtttcgaaagtcgtaaaaacaggaaaaaatgaggggacatttggtgaggtaccaagatgtgagactgtttatattgtggctcgtttaatttttagaacctcaaacgtgtcggtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagarcccctggagacccccggcctagaacgcctgcagcacagagcagctgggtccggacacaggcacgaggtccttggcagtgtcttttctgccacacacacgccagggtctcctctcccgtggaagagcaggaagaagacaggcactcctagagcctgttatgtgccagcctagtctcatccactggcccttcttgccagggctgtgccagcaccctctctccctcccttactcatcccatctccctccaaatgctgtcctgtttccggaggaaaggtaggaccagaaaggctgtgactgcag

SEQ ID NO: 36517 - DNA, 601 bp, Human
ctggaaagccccgttctcatagcgctcatggccaaacgctccccgcttggcagcatccgccagctgtaactggaggaacaggaccaggtcgggtttgggaaggcccacgtctggctgtttacaccagtctagggaaaaattctgccaagaaagaacccaacagttaaagcttagtgtagtctaggtttttgtttcgaaagtcgtaaaaacaggaaaaaatgaggggacatttggtgaggtaccaagatgtgagactgtttatattgtggctcgtttaatttttagaacctcaaacgtgtcsgtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagaacccctggagacccccggcctagaacgcctgcagcacagagcagctgggtccggacacaggcacgaggtccttggcagtgtcttttctgccacacacacgccagggtctcctctcccgtggaagagcaggaag

SEQ ID NO: 36518 - DNA, 601 bp, Human
ccgctcctggaaagccccgttctcatagcgctcatggccaaacgctccccgcttggcagcatccgccagctgtaactggaggaacaggaccaggtcgggtttgggaaggcccacgtctggctgtttacaccagtctagggaaaaattctgccaagaaagaacccaacagttaaagcttagtgtagtctaggtttttgtttcgaaagtcgtaaaaacaggaaaaaatgaggggacatttggtgaggtaccaagatgtgagactgtttatattgtggctcgtttaatttttagaacctcaaaygtgtcggtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagaacccctggagacccccggcctagaacgcctgcagcacagagcagctgggtccggacacaggcacgaggtccttggcagtgtcttttctgccacacacacgccagggtctcctctcccgtggaagagc

SEQ ID NO: 36519 - DNA, 601 bp, Human
gctggtggaaacaccggagcgcccgctcctggaaagccccgttctcatagcgctcatggccaaacgctccccgcttggcagcatccgccagctgtaactggaggaacaggaccaggtcgggtttgggaaggcccacgtctggctgtttacaccagtctagggaaaaattctgccaagaaagaacccaacagttaaagcttagtgtagtctaggtttttgtttcgaaagtcgtaaaaacaggaaaaaatgaggggacatttggtgaggtaccaagatgtgagactgtttatattgtggctcttttaatttttagaacctcaaacgtgtcggtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagaacccctggagacccccggcctagaacgcctgcagcacagagcagctgggtccggacacaggcacgaggtccttggcagtgtcttttctgccacacacacgccagg

SEQ ID NO: 36520 - DNA, 601 bp, Human
cagttcaaagtcgtgtctttcatgagctggtggaaacaccggagcgcccgctcctggaaagccccgttctcatagcgctcatggccaaacgctccccgcttggcagcatccgccagctgtaactggaggaacaggaccaggtcgggtttgggaaggcccacgtctggctgtttacaccagtctagggaaaaattctgccaagaaagaacccaacagttaaagcttagtgtagtctaggtttttgtttcgaaagtcgtaaaaacaggaaaaaatgaggggacatttggtgaggtaccaagaygtgagactgtttatattgtggctcgtttaatttttagaacctcaaacgtgtcggtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagaacccctggagacccccggcctagaacgcctgcagcacagagcagctgggtccggacacaggcacgaggtccttggcagtg

SEQ ID NO: 36521 - DNA, 601 bp, Human
tctgggaggaccagacggaaacggcagcagctttgctgacacgactgtgccagccaccacggtgtcatcctgagccacttctccacgcttcctagtgtgcaattctgggattctcaccttccagttcaaagtcgtgtctttcatgagctggtggaaacaccggagcgcccgctcctggaaagccccgttctcatagcgctcatggccaaacgctccccgcttggcagcatccgccagctgtaactggaggaacaggaccaggtcgggtttgggaaggcccacgtctggctgtttacaccartctagggaaaaattctgccaagaaagaacccaacagttaaagcttagtgtagtctaggtttttgtttcgaaagtcgtaaaaacaggaaaaaatgaggggacatttggtgaggtaccaagatgtgagactgtttatattgtggctcgtttaatttttagaacctcaaacgtgtcggtttctccagtgtcacctttgtttttcctttgtaaacagacaagtggacagaaaagtaggtagatagaacggctgccagtccccgccacccacagcccaggccccatggaggccctcccagcgcag

SEQ ID NO: 36522 - DNA, 601 bp, Human
ggcacgtgcctgtaatcccagctactcaggaggctgaggcaggagaatcacttgaacccaagaagcggaggttgcagtgagctgagatcgtgccattgcactccagcctgggttggcacccagagcaagattctgtctcaaaaaaaaaagaatttgctggcaccgagaacccctgaacgactactcccggggctccacatctgggaggaccagacggaaacggcagcagctttgctgacacgactgtgccagccaccacggtgtcatcctgagccacttctccacgcttcctagtgtgcarttctgggattctcaccttccagttcaaagtcgtgtctttcatgagctggtggaaacaccggagcgcccgctcctggaaagccccgttctcatagcgctcatggccaaacgctccccgcttggcagcatccgccagctgtaactggaggaacaggaccaggtcgggtttgggaaggcccacgtctggctgtttacaccagtctagggaaaaattctgccaagaaagaacccaacagttaaagcttagtgtagtctaggtttttgtttcgaaagtcgtaaaaacaggaaaaaatgaggggac

SEQ ID NO: 36523 - DNA, 601 bp, Human
accagcctgaccaacgtggagaaaccccatctctacaaaaaaaattagccaggcatgatggcacgtgcctgtaatcccagctactcaggaggctgaggcaggagaatcacttgaacccaagaagcggaggttgcagtgagctgagatcgtgccattgcactccagcctgggttggcacccagagcaagattctgtctcaaaaaaaaaagaatttgctggcaccgagaacccctgaacgactactcccggggctccacatctgggaggaccagacggaaacggcagcagctttgctgacacractgtgccagccaccacggtgtcatcctgagccacttctccacgcttcctagtgtgcaattctgggattctcaccttccagttcaaagtcgtgtctttcatgagctggtggaaacaccggagcgcccgctcctggaaagccccgttctcatagcgctcatggccaaacgctccccgcttggcagcatccgccagctgtaactggaggaacaggaccaggtcgggtttgggaaggcccacgtctggctgtttacaccagtctagggaaaaattctgccaagaaagaacccaacagttaaag

SEQ ID NO: 36524 - DNA, 601 bp, Human
acaggctggcgctcgtgtctgaagaggggctgaggatgtggaggattgcgcagactctcacctgacccaccagacaaagcgccaaatgtcaacatttagcaaaactcatcgggttagaatttgctggcactggccgggcgcgatggctcatgcctataatcccagcactttgggaggccgaggtgggcagatcacctgaggtcaggagttggagaccagcctgaccaacgtggagaaaccccatctctacaaaaaaaattagccaggcatgatggcacgtgcctgtaatcccagctactcrggaggctgaggcaggagaatcacttgaacccaagaagcggaggttgcagtgagctgagatcgtgccattgcactccagcctgggttggcacccagagcaagattctgtctcaaaaaaaaaagaatttgctggcaccgagaacccctgaacgactactcccggggctccacatctgggaggaccagacggaaacggcagcagctttgctgacacgactgtgccagccaccacggtgtcatcctgagccacttctccacgcttcctagtgtgcaattctgggattctcaccttccagttcaa

SEQ ID NO: 36525 - DNA, 601 bp, Human
tgcctctcactggccactgtgcagccacacagctgtcgcccagaaccgcccaagatgagcctctccgggcggaatgactgccagagagaatgccgcactgccagaaaagggcactgctatcccacctgcgttccgggaaacgaaaagctgcgtgaccagcatcatctgcaggcacagccagtcgggctggggcgagaccctcggccctgctctggaggaggagctcaagggactgaagctccgcgggccgtggccacaagcgacagtgctggcgcccgacgtgccagaagccctggctgcygcctggaaagaggccacgtgggcagcggtgggcacgggcgactggagtctgggagagaggtaggggctgcggtcgggaggagcagaggcggccagcctgcgagtccactgggaggggagagtccagcgtcctgggagcagagccagacctgggactgctgagactgaaggaggcaggactgaagggagaggcagcacacagcaccctcctgaacttagatggccaggtgctgctgcagggcccatgcccagcgagaggccgcaccagaggacacagtggcaggaacaggctggcgctcgt

SEQ ID NO: 36526 - DNA, 601 bp, Human
atgaggtgtgaccgtgacggaaggagagtgactccctacacaagggccaccttcccagatgcctctcactggccactgtgcagccacacagctgtcgcccagaaccgcccaagatgagcctctccgggcggaatgactgccagagagaatgccgcactgccagaaaagggcactgctatcccacctgcgttccgggaaacgaaaagctgcgtgaccagcatcatctgcaggcacagccagtcgggctggggcgagaccctcggccctgctctggaggaggagctcaagggactgaagctcygcgggccgtggccacaagcgacagtgctggcgcccgacgtgccagaagccctggctgccgcctggaaagaggccacgtgggcagcggtgggcacgggcgactggagtctgggagagaggtaggggctgcggtcgggaggagcagaggcggccagcctgcgagtccactgggaggggagagtccagcgtcctgggagcagagccagacctgggactgctgagactgaaggaggcaggactgaagggagaggcagcacacagcaccctcctgaacttagatggccaggtgctgctgcagggc

SEQ ID NO: 36527 - DNA, 601 bp, Human
ctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcaggcagtgagagggactcagaagcgctggcatctcagcggcatcccggcttctgctgtcgggtggcaccggacccttctcaagcttctgggacrgcaaattctagaaaatctgccaggggcgtagaaggcacttggaagaatctaaccatttcatgaggtgtgaccgtgacggaaggagagtgactccctacacaagggccaccttcccagatgcctctcactggccactgtgcagccacacagctgtcgcccagaaccgcccaagatgagcctctccgggcggaatgactgccagagagaatgccgcactgccagaaaagggcactgctatcccacctgcgttccgggaaacgaaaagctgcgtgaccagcatcatctgcaggcacagccagt

SEQ ID NO: 36528 - DNA, 601 bp, Human
cagaccctgccctgcccacgctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcaggcagtgagagggactcagaagcgctggcatctcagcggcatcccggcttctgctgtcgggtggcaccggacmcttctcaagcttctgggacagcaaattctagaaaatctgccaggggcgtagaaggcacttggaagaatctaaccatttcatgaggtgtgaccgtgacggaaggagagtgactccctacacaagggccaccttcccagatgcctctcactggccactgtgcagccacacagctgtcgcccagaaccgcccaagatgagcctctccgggcggaatgactgccagagagaatgccgcactgccagaaaagggcactgctatcccacctgcgttccgggaaacgaaaagctgcgtgaccagcat

SEQ ID NO: 36529 - DNA, 601 bp, Human
gagggcagaccctgccctgcccacgctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcaggcagtgagagggactcagaagcgctggcatctcagcggcatcccggcttctgctgtcgggtggcacyggacccttctcaagcttctgggacagcaaattctagaaaatctgccaggggcgtagaaggcacttggaagaatctaaccatttcatgaggtgtgaccgtgacggaaggagagtgactccctacacaagggccaccttcccagatgcctctcactggccactgtgcagccacacagctgtcgcccagaaccgcccaagatgagcctctccgggcggaatgactgccagagagaatgccgcactgccagaaaagggcactgctatcccacctgcgttccgggaaacgaaaagctgcgtgacc

SEQ ID NO: 36530 - DNA, 601 bp, Human
ctgtccctccagctcgcaagcggcgagtcggaagcacagagggcagaccctgccctgcccacgctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcaggcagtgagagggactcagaagcgctggcrtctcagcggcatcccggcttctgctgtcgggtggcaccggacccttctcaagcttctgggacagcaaattctagaaaatctgccaggggcgtagaaggcacttggaagaatctaaccatttcatgaggtgtgaccgtgacggaaggagagtgactccctacacaagggccaccttcccagatgcctctcactggccactgtgcagccacacagctgtcgcccagaaccgcccaagatgagcctctccgggcggaatgactgccagagagaatgccgcactgccagaaaagggcactgcta

SEQ ID NO: 36531 - DNA, 601 bp, Human
acaggccgggctctggaaggccaacctgaacctcctggcacactgtggtgacctccgggataccccacacctttctctgaacctcaaccttgacaagtgtctacggtagtcacccggcattcctgccacagccctgatgcaggagaaacatgatgtgccaactgcccactcctgctttaagccgacctcagcctcgtgaccccaaccccgctgagtgcccacttgcaggagtgaggcacagcccacagcacagccaggcccacccagcccaccaggtcgaggtgactgtccctccagctcrcaagcggcgagtcggaagcacagagggcagaccctgccctgcccacgctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcaggcagtgagagggactcagaagcgctggcatctcagcggcatccc

SEQ ID NO: 36532 - DNA, 601 bp, Human
acaccatgtttcgttctgtcctctgtgctcgtggggatttcacacaggccgggctctggaaggccaacctgaacctcctggcacactgtggtgacctccgggataccccacacctttctctgaacctcaaccttgacaagtgtctacggtagtcacccggcattcctgccacagccctgatgcaggagaaacatgatgtgccaactgcccactcctgctttaagccgacctcagcctcgtgaccccaaccccgctgagtgcccacttgcaggagtgaggcacagcccacagcacagccagrcccacccagcccaccaggtcgaggtgactgtccctccagctcgcaagcggcgagtcggaagcacagagggcagaccctgccctgcccacgctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcagg

SEQ ID NO: 36533 - DNA, 601 bp, Human
gttcaagaccagcctgggctacacagggacaccccgtctctacaaaaaatgtggcaccactctactccagcctgggtgacacagtaacaccctgtttcaaaacaacaccatgtttcgttctgtcctctgtgctcgtggggatttcacacaggccgggctctggaaggccaacctgaacctcctggcacactgtggtgacctccgggataccccacacctttctctgaacctcaaccttgacaagtgtctacggtagtcacccggcattcctgccacagccctgatgcaggagaaacatgaygtgccaactgcccactcctgctttaagccgacctcagcctcgtgaccccaaccccgctgagtgcccacttgcaggagtgaggcacagcccacagcacagccaggcccacccagcccaccaggtcgaggtgactgtccctccagctcgcaagcggcgagtcggaagcacagagggcagaccctgccctgcccacgctcctgtggctcctgggccctgcctggaaggtgaggaagttccgcagcagaagccagacagcaggaccagtgcaacactgggcctgactcgtccttgcggggaaga

SEQ ID NO: 36534 - DNA, 601 bp, Human
cgggagcccacgcctgtaatcccagcactttgggaggcccacgagggaggactgcttgtacccaggagttcaagaccagcctgggctacacagggacaccccgtctctacaaaaaatgtggcaccactctactccagcctgggtgacacagtaacaccctgtttcaaaacaacaccatgtttcgttctgtcctctgtgctcgtggggatttcacacaggccgggctctggaaggccaacctgaacctcctggcacactgtggtgacctccgggataccccacacctttctctgaacctcarccttgacaagtgtctacggtagtcacccggcattcctgccacagccctgatgcaggagaaacatgatgtgccaactgcccactcctgctttaagccgacctcagcctcgtgaccccaaccccgctgagtgcccacttgcaggagtgaggcacagcccacagcacagccaggcccacccagcccaccaggtcgaggtgactgtccctccagctcgcaagcggcgagtcggaagcacagagggcagaccctgccctgcccacgctcctgtggctcctgggccctgcctggaaggtgaggaag

SEQ ID NO: 36535 - DNA, 601 bp, Human
gtgatcacaatgaaactgctcagagttatcactgaacttcagtaagaaaatacaacagagtgccatcaggacaggggagagggcaggagactgctccatcgctctgctcatgtccacactgccaaggtccccaccacgggggtccccagtgcaccccagctccggggcagaagaggcagcctgcagatctctgctgccgggaaagagctcctgaagttgtggggtctggactccgctggggacggggccttccgcgagtctcccacctctcgggggactgcagggagaggcgtctccagtgggcagccttgggtcacttccatagctcccccagcggcttctctgtggcagtgcggatggcgtcctcagagagcacgcggatgtcctcatggacagcttcgatgcttttggaagcatccaccatctgttcccaccggggtttcaggagaaaaagaggctcatcagcacgttccaggctggtcacgggagcccacgcctgtaatcccagcactttgggaggcccacgagggaggactgcttgtacccaggagttcaagaccagcctgggctacacagggacaccccgtctctacaaaaaatg

SEQ ID NO: 36536 - DNA, 601 bp, Human
tttttttactagtgtctggaagacatttaggagaattccaactgattaccatttacagtgatcacaatgaaactgctcagagttatcactgaacttcagtaagaaaatacaacagagtgccatcaggacaggggagagggcaggagactgctccatcgctctgctcatgtccacactgccaaggtccccaccacgggggtccccagtgcaccccagctccggggcagaagaggcagcctgcagatctctgctgccgggaaagagctcctgaagttgtggggtctggactccgctggggacrgggccttccgcgagtctcccacctctcgggggactgcagggagaggcgtctccagtgggcagccttgggtcacttccatagctcccccagcggcttctctgtggcagtgcggatggcgtcctcagagagcacgcggatgtcctcatggacagcttcgatgcttttggaagcatccaccatctgttcccaccggggtttcaggagaaaaagaggctcatcagcacgttccaggctggtcacgggagcccacgcctgtaatcccagcactttgggaggcccacgagggaggactgcttgtac

SEQ ID NO: 36537 - DNA, 601 bp, Human
aagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcckggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcc

SEQ ID NO: 36538 - DNA, 601 bp, Human
gtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccaccyaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacct

SEQ ID NO: 36539 - DNA, 601 bp, Human
cgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggyatctgaatgtaccatcttgtgaatgtaccatcttttaaatgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggac

SEQ ID NO: 36540 - DNA, 601 bp, Human
tctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctytgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagt

SEQ ID NO: 36541 - DNA, 601 bp, Human
gagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcac

SEQ ID NO: 36542 - DNA, 601 bp, Human
agagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcacccccc

SEQ ID NO: 36543 - DNA, 601 bp, Human
gtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccata

SEQ ID NO: 36544 - DNA, 601 bp, Human
ctaagaataaagctgaaccaaccacttcctgagcctcaggggctagtaggtcttgaggcacccgggaaacaaaaacatcatagttacagctctgctgccctgagagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatcyttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatg

SEQ ID NO: 36545 - DNA, 601 bp, Human
gtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgaktcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctc

SEQ ID NO: 36546 - DNA, 601 bp, Human
tgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaatamttggcttgtatttagggactactttgtattaaaattggctgatttttgagtgtgagagtctttgtaagatctactttggtcctcccaatacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattga

SEQ ID NO: 36547 - DNA, 601 bp, Human
catcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttagcaatttccatctctcccagaagaaaagggtgggaagaggagcgagataagaagaaacagctgagatgtatcatcctttcttttgctaaatgttggcctcctacctttgtggagttaccattccaaraaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaatacaaaaattagctgggcatggtggcacgtgcctgtagtcccatctactt

SEQ ID NO: 36548 - DNA, 601 bp, Human
ctagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattartaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtca

SEQ ID NO: 36549 - DNA, 601 bp, Human
tgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaatwctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagtt

SEQ ID NO: 36550 - DNA, 601 bp, Human
aaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaamaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatcc

SEQ ID NO: 36551 - DNA, 601 bp, Human
tttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtkacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccaggg

SEQ ID NO: 36552 - DNA, 601 bp, Human
gtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccarggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccac

SEQ ID NO: 36553 - DNA, 601 bp, Human
caaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccarggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagca

SEQ ID NO: 36554 - DNA, 601 bp, Human
ctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagraaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagta

SEQ ID NO: 36555 - DNA, 601 bp, Human
ggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggtaaggaggctttgagtgtggggggtgtccccaaggaagactcacttccttcctccccaagaccccattcyagaaagttctgactagggctgtgccccccaagactgggggatgctaccaggcaggacagaggggagctcagcagtgaaggagagcatgggcctgggggaagatttgggtttcagccctggctgtgctcctgcccagtcagtgacctctggcaggttagacctcagagcctcagttccctcatcggaaaaccagggatagtgacagcatctgctttgcaggctgcagtggaggtgatgagataatgtacacaaggttttaggtgttatcaagcgcttaatcgcctgcagtaattacgattc

SEQ ID NO: 36556 - DNA, 601 bp, Human
acagcatctgctttgcaggctgcagtggaggtgatgagataatgtacacaaggttttaggtgttatcaagcgcttaatcgcctgcagtaattacgattcatctgcatctccagcacccagcacatagaaagtctttggtgaatgaatgactggaccaaccaaagcccaagggcatcccaagactgccaggaagaggatctgacctgggttaaacagccactaatggcccattttgctgcctgccttgtttctacttaggtaacctcctttaacccgaagacacccctgcagggtagctctyatgaaacccattctacagattaggaaaataacactcagaggtgacacagaatgaagtgatagtggtggagcttgaatttgaactcagttttctctaacatcagaaattgtgagcttttccttttcaacgatgcatttctaaaactcagagacctgcagagaggcatgtattaaatactcatgcatccatttcccagaattaaagtccacttttgttccaccgcaggaagccaaggtatagctcaaaggaaccccaactctgccccatttgagggtggcaaacaccaggcctgtttgtccc

SEQ ID NO: 36557 - DNA, 601 bp, Human
tcaagcgcttaatcgcctgcagtaattacgattcatctgcatctccagcacccagcacatagaaagtctttggtgaatgaatgactggaccaaccaaagcccaagggcatcccaagactgccaggaagaggatctgacctgggttaaacagccactaatggcccattttgctgcctgccttgtttctacttaggtaacctcctttaacccgaagacacccctgcagggtagctcttatgaaacccattctacagattaggaaaataacactcagaggtgacacagaatgaagtgatagtgrtggagcttgaatttgaactcagttttctctaacatcagaaattgtgagcttttccttttcaacgatgcatttctaaaactcagagacctgcagagaggcatgtattaaatactcatgcatccatttcccagaattaaagtccacttttgttccaccgcaggaagccaaggtatagctcaaaggaaccccaactctgccccatttgagggtggcaaacaccaggcctgtttgtccccagaagagggcaagtgtcctgtccaaggactgccatcaccctcaggctgagagacggtagcagga

SEQ ID NO: 36558 - DNA, 601 bp, Human
ggaccaaccaaagcccaagggcatcccaagactgccaggaagaggatctgacctgggttaaacagccactaatggcccattttgctgcctgccttgtttctacttaggtaacctcctttaacccgaagacacccctgcagggtagctcttatgaaacccattctacagattaggaaaataacactcagaggtgacacagaatgaagtgatagtggtggagcttgaatttgaactcagttttctctaacatcagaaattgtgagcttttccttttcaacgatgcatttctaaaactcagagrcctgcagagaggcatgtattaaatactcatgcatccatttcccagaattaaagtccacttttgttccaccgcaggaagccaaggtatagctcaaaggaaccccaactctgccccatttgagggtggcaaacaccaggcctgtttgtccccagaagagggcaagtgtcctgtccaaggactgccatcaccctcaggctgagagacggtagcaggaagagttcaggccttccctcgggaaggtacctcccagctgcaacgctcctttccatatccagtgtggatcctttctcagtgggcctg

SEQ ID NO: 36559 - DNA, 601 bp, Human
caacgatgcatttctaaaactcagagacctgcagagaggcatgtattaaatactcatgcatccatttcccagaattaaagtccacttttgttccaccgcaggaagccaaggtatagctcaaaggaaccccaactctgccccatttgagggtggcaaacaccaggcctgtttgtccccagaagagggcaagtgtcctgtccaaggactgccatcaccctcaggctgagagacggtagcaggaagagttcaggccttccctcgggaaggtacctcccagctgcaacgctcctttccatatccrgtgtggatcctttctcagtgggcctgaggaagacaggggcaatgggcccacttttcagactagaaaacaggttcttccaaagcccctcagtcagtgaggagcaaagccaggactcaagtctgtcttcagactccaagcctacggctattagggagtcccagagttttcctgagtcttcttttccttcagcattgaaagccctccaacccccaacccccaaatccctcagcatccctgctcccagttcttcatccttcttaaagagacctacattgcaaactccttaatgctcatgcctct

SEQ ID NO: 36560 - DNA, 601 bp, Human
tcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctayggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatag

SEQ ID NO: 36561 - DNA, 601 bp, Human
aacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccaggatggagaattggttgagtagccaaggaaggtcagtgtgaaaagcttgctatggcaaatatagcgaaatctctccactgccttctgtccaccarcatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaa

SEQ ID NO: 36562 - DNA, 601 bp, Human
ctattgaggaacatttgagtctaaattctgctactaaaatgaaactgttgaatattattatatatagattcatttttgcactcatatgagtatatttgtaggataaattgctaggagtgggactgttggcctaatacatttcagagttttcagatattgcaacttgtttttaaaggtaagttgtatcaacttatactcccatcaataaggcatcagagtgtgtcttcctatacctgcaccaatctaatatttcagatttttttgatctttggcattctgatcttggtctaattttaaattrtatttttctaataagtgaagttgaatatattttcgtatgtttaaaaataatgtatggaaggggcattttgagtataagaagaaaggagaaaaattgatgcacacacatataaatatgtttgtgtatatgtctggaaactcgagggtggccttgcgtactatcctctgcctttttcaatattagagctgcttcctggtaggagacaagtacggggtctggagttagaggctagtggagaaagttctacatagtctacatagtgtaggagggatagaagtaatcagggacatgaaaaagatt

SEQ ID NO: 36563 - DNA, 601 bp, Human
tctgtgcgccctgccatgtggaagatgatgctcaacattgatggtgagtggggagagctatggagccaggggcaccccaagtccagtgaccacactcccagcctcatccctcccagctctgcaaccacactcctagtctaattcctacagccctggcacccccttcccccatcccaatgccctttaaggaagagggtataaattgctgtgcctccatgtattgtggaagacagaacctgagctgagctatctttaccctgtccccacagtctcagccactgccttttataaggcacagccrgtgattgagttcatgtgtgaggtgctggacatcaggaacatagatgagcagcccaagcccctcacggactctcagcgcgttcgcttcaccaaggagatcaagggtgaggacccaacaggaggggaagggaaacagcgccactttagccctaagaggaaatccccttggggtatgctcaggggagagaccaagcctgggcacatgagcaacctattttagccctgacaagcagtgtgtgtatctcaggcctgaaggtggaagtcacccactgtggacagatgaagaggaagtaccgcgtgt

SEQ ID NO: 36564 - DNA, 601 bp, Human
caccatctcggctcactgtaacctcctcagcctcccaggttcaagcaattctcatgcctcagcctccagtagctaggattacaggtgtgcgccaccgtgcccagataagttttttttgtatttttagtagagatggggttttgccatgttggccacactgatctcctggcctcaagtgatctgcctgcctcggcctcccaaagtgctggattacgggcatgagctgccacgcctggcctaccctcttacttttatccaacagcagaagtcagatagcccagaccaaagctctagtcttctrgtgagcttctaggatttcagaactaacctgagggagttaggctgaagggagaagagatccccaaaaccaagaactctgacttggttaatagctactgatgcacatgaaggcaacatgttctctgaggtataaacagaggtctttagggacaatcttagctaagtagatagtaggtgatatttactgtaagcagagatttgttagcaaattaacattatttctatttaaacagcagtttccaaggggtataatttatgttatgacttagaccttgatttctgttgttgcttatttaacata

SEQ ID NO: 36565 - DNA, 601 bp, Human
ttaggagacatttgagctaagtcccaaattatgacatagaatcaaccttgtaacaacctgagagaagagccttccaggcaggaggaagtacaaaggttctaaagcagaagagaatttggatctttttgagggatagacagaaggctatggtggctagaatgtattgtgtgaggggaaaagcagtaggatatgattctgcagagggtcaaataatatagcctgttgaaaccacgtggcattttattactgttttttggaaaagctttatccaggttggctgtgtggctcatacctgtaatcycagcactttgggaggtcaaggcaggaggattgcttgactgcaggtgtggtgtggtcccagctacttgggaggctgaggtggaagcattgcttgaacccagtgagctgtgattgtgccgctggattctagcctgggcaacagagggagaccctgtctcaaaaaaaaataaaaaaacagctttatcgagatataattcacataccataaaattcaccattttaaaatgattaggtagttttagtatattcacagaattgtacaacagccatcaccactatctgattccagaacatatcactc

SEQ ID NO: 36566 - DNA, 601 bp, Human
gatctttttgagggatagacagaaggctatggtggctagaatgtattgtgtgaggggaaaagcagtaggatatgattctgcagagggtcaaataatatagcctgttgaaaccacgtggcattttattactgttttttggaaaagctttatccaggttggctgtgtggctcatacctgtaatcccagcactttgggaggtcaaggcaggaggattgcttgactgcaggtgtggtgtggtcccagctacttgggaggctgaggtggaagcattgcttgaacccagtgagctgtgattgtgccrctggattctagcctgggcaacagagggagaccctgtctcaaaaaaaaataaaaaaacagctttatcgagatataattcacataccataaaattcaccattttaaaatgattaggtagttttagtatattcacagaattgtacaacagccatcaccactatctgattccagaacatatcactcctgaaagaaagcctgtattcattagcagttatgcaccattcgttctctccccaacagcctgtagtaaccactaatttactttcagtctctgggtatacctattttggacatatcatat

SEQ ID NO: 36567 - DNA, 601 bp, Human
tatgtcatattttgttaattcatttatcagttaatggacatttggattgtttctactttttgggtatcatgaataatgctgctgtgaacattgatgtacacatttttgtgtgaacataagtttttatttctctggagtatacacctaagagtgatataatatataacaatgtttaacatcttttttttttttttgagacggagtatcgctctgttacccaggctggagtgcagtggcacgatctcggctcactgcaagctccgcctcctgggttcacgccattctcctgcctcagcctccsgagtagctgggaatgcaggcgccgaccaccacgcctggctaattttttgtatttttagtagagatggggtttcacggtgttagccagaatggtctcgatctcctgactcatgatccgcccgcctcagcctcccaaattgctgggattacaggcgtgagccattgcacctggccaatgtttaacatcgtgatgagctgcctgattgtttcccaaagtagctatgatattttacaatcccatcagcaaagaatgacagttgtaatttctggccaggtaggattttattctaattataatatg

SEQ ID NO: 36568 - DNA, 601 bp, Human
aacataagtttttatttctctggagtatacacctaagagtgatataatatataacaatgtttaacatcttttttttttttttgagacggagtatcgctctgttacccaggctggagtgcagtggcacgatctcggctcactgcaagctccgcctcctgggttcacgccattctcctgcctcagcctccggagtagctgggaatgcaggcgccgaccaccacgcctggctaattttttgtatttttagtagagatggggtttcacggtgttagccagaatggtctcgatctcctgactcatratccgcccgcctcagcctcccaaattgctgggattacaggcgtgagccattgcacctggccaatgtttaacatcgtgatgagctgcctgattgtttcccaaagtagctatgatattttacaatcccatcagcaaagaatgacagttgtaatttctggccaggtaggattttattctaattataatatgaatccattggaaaattttaagtagaagaacaatgtggattattgttctagtttctagttgtgaagattcaattagaaactagaagtagtgcctccagtccacctctgtgtct

SEQ ID NO: 36569 - DNA, 601 bp, Human
acccgggaggcagatgtctatgagccgagattgtgccactgcactccagcctgggtaacagagcgagactctatctcaaaaaaataaataaataaataaaatatgagacctgagcccagatctggctctggatcacaagcggttgaattgcccttttttttttttttttgagacagggtctcactctgtcacccaggctggcgttcagtggcgtgatctgggctcactgcaacctccgcctcccggttcaagcgattcttgttcctcagcctcctgagtagctgggattacaggcgcacgycaccatgcctggctaatttttgtatttttagtagagactgggttggccaggctggtcttgaactcctgacctcaagtgatctggccgccttggcctcctaaggtgctgggattgcaggcatgagccaccatgcccggcctgaatcgccttttacaatgcacacgaatattttctaatttacctatcaaatgatactcaggaggagaatacatgtatgcacaacggattttgcagttcccttccccatggctgacagccaaggtatctttccttattgtggggctctgggtacagggtgga

SEQ ID NO: 36570 - DNA, 601 bp, Human
tgatacccagagggtgagcagtattgccaagctcctgttctcctgagattgctctcttttgtcctgcagatgaagaatgccagctacaacttagatccctacatccaggaatttgggatcaaagtgaaggatgacatgacggaggtgacagggcgagtgctgccggcgcccatcttgcagtacggcggccgggtgagcagggtcagggccagacaacatctcggggcatatgggggtggttgggttgtatagccaggggcttttgctcccctacccacctgactctactgaggctcacctrggcgccccctctacctatccccagaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagtaaggagggttcgctgtaggggtggaagggtgggaaggaccctggagctgcctgccttcctgtagtccacaggggctgatattgatcagtaatgtgttctgtcttgactctgcctgcattgtgctttctggctcaaacttc

SEQ ID NO: 36571 - DNA, 601 bp, Human
acaccccccagcaggggatgggaaaaaaccttctatcacagcagtgagtgatattctgtagctgcctcataaggttctcctcttcgctctgagtcctcaaaactgcccatgatttccttccctcagctctggctcttgagccttcataagatgtccatttagctcgctattcccaattcccattcccttgatatctcataaaggtagctctgtatggtgtcttttttcagggagagtaatgagagtgtagccagagacttgactcattctgcatcactcttgctctgcatttgaatgtctytctttccccatgcctgcttttgggatgtaggggagggactatatcttctctgaaatccctttaaagggagttacttagttgcgaggactatcctttgctctgcccatcctcaccccgatctgtataatagattagatgtttctcttatctctctcctgacttttctgctctttgtctcttaggggcttccaaattgctagggattagaccttctttcccacttatatttcctaaaccctcacatttctgtaagcacactggtcttaacctcagtaagtgcagggaaaccctataatatgc

SEQ ID NO: 36572 - DNA, 601 bp, Human
ctcactgagtctcaagccctagtcattcagttgtagttttcttgctaagaagcctttccacaaacccatagcctgacagtgaaggtgaaggttctaggagctaatcctttctctctgactgtcaggtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcytgaaggccagctaccccaggtagggcccacagtaggtggagaaaaccttcacatcatggctggaaagctaggtgctactaccttttctaagctattggcactgagaggtgtgtcacttcttagtgagctttgctaaatggagtagacttgggggcaaggatcgcaactgagggatggagtgtacaagcatctgtagatttttcttctcataatagaagaccctcactgcctatttaagtagttggttcatgttggagactgattgtttagaccagtgattctcaaatgctagcttacatt

SEQ ID NO: 36573 - DNA, 601 bp, Human
catgaactgtcctaagcacttcactttcttttttttttccctaaatctgagtggaaacatatgttctatttaatgctttacaatagtcctttggaataatagtgtatttccatttaacagatgagaaaacaggcttggaaatgttacatgatctttaatgtcatcaaagataattaggagtggaaccgggattcagacacattggtctgattccatagtttatgctcttaactgttatgcccagtttctttttttcttttttttggggggaacagagtctcgctcttgcccagggtggagygcagtggtgtgatcttagctcactgcagcttctgcctcccgggctcaagcgattctctttcctcagcctcccaagtagctggggctataggtatgagtcaccacacccagcttatttttgtatttttagtagagatggggtttcactatgtcggccaggctggtctcaaactcctgacctcaaatgatccacccgccttggcctcccaaagtgctggaaatacaggcgtgagccaccgtgcccggccattatgcccaatttctaagtcatccagtattttctaaaataacagacacattt

SEQ ID NO: 36574 - DNA, 601 bp, Human
gtagagatggggtttcactatgtcggccaggctggtctcaaactcctgacctcaaatgatccacccgccttggcctcccaaagtgctggaaatacaggcgtgagccaccgtgcccggccattatgcccaatttctaagtcatccagtattttctaaaataacagacacatttatcatatcacatatctgttcagaaatgtctagtggcttcacatagctttgagttaaaattcaaactgcttagcaaagcaatcagtagttattaagccctactaggttttctatgcttttacttaattgwctatcgtagtcttcttaatagctttgtgaagcaggtcttagtaacattaacagacgtggagaaaatgagacttagtggagttgaataacttgcctgatgtaatacaactagataaagcttggatttaaatctaattgattccaaagtctatccttctctaccatacagttttgaccctctgtatctgacatccacggccacaggcaactattgcctatgattatttacttctagcttttcccttagctagcctgttttcttataatcctgctgctttgcaggactgaattcacctactct

SEQ ID NO: 36575 - DNA, 601 bp, Human
ctatacagattgggaagagtggtaacatcccagctgggaccacagtggacaccaacatcacccacccatttgagtttgacttctatctgtgcagccacgcaggcatccaggtagctgggctttatcttgtggttccaatgggtcaaagatgagttgttcattcatattgcctctagaatgtatcagtcatcactgaatgacatccaaattaggattgctctcttttctgtttgttctgttttgttttgttttgaggcggagtctcactctgtcccccaggctggagtgcagtggcacaatytcagctaactgcaacctccaccttctgggtttaagcagtcttcctgccttcccgcctcagcctcccaagtagctgggattacaagcatgcgccaccatgcccagctaatttttgtatttttagtagagacagggtttcaccattttggccctgctgttcttgaactcctgacctcaagtgatccacccaccttggcctcccaaagtgctgggattacaggcatgagccactgtgcccggccaggactgctgtcgtaataagccctgagtacacttgcaggttgcttataagaagagtgct

SEQ ID NO: 36576 - DNA, 601 bp, Human
gagtgagaatgagagagagagagagacagagagaaagagagattggacaacctctgcaaaaaccttgattatactcatgtatacttcaacaacatataacttgcggcactcaccttgtaattgcccaagcccacccttataaagataaccactgttagctaagcttaatggaaattactccagttttctctgcataaaactaatattttttacagaaataggtcatagtacaatacaacatcttgagttttcggcagaacaatatgctacagacccacctaatttaaaaaataattttttwaaaaagagacggcatcttgctatgttgcccaggctggtctcaaaactcctgggctcaagtgatccccctgcctcccaaagtgctgggattacaggtgtgagccaccgtgcccggcctcacctcgtttttcagagcagctacatagtattggattgtatggatgaaccatagttcatttaacccatccactgacagccatttggactgtttccagttttgccctgtgacggacaatgctgcattttacatcctcgcctctctctctttgggactgaggatcctttttaacattcaaccttt

SEQ ID NO: 36577 - DNA, 601 bp, Human
ctctgggactctgtccagggcctctctgctttctctttccactttcctggggttacctgtctcatccatgccaatgacctctgcctcgtcactcatgataccatctctctgcccccagatccggggttccctggcttcctggacaccttgccctaggtgccccccagcctctcactcctactatgtcccaaatggaccctggcatctcctccaagcccatcctcctcccaggcctcatctcaatgcgatcgtactgtcccccccatcagccagatgtttcctgcccccgcctccctcctcrccctcctgccacagcccttcagctccagagcatgtacgctgagcctcctaagggtctgtccaccaaccccctttccctccccggcgctccacctggtccagcctgtcctctcctccgggggtcctgccccagcctcctcccccagcctcccagcctcagtctccacctcccatccaccctgctgccctgcatgtgaggctgtctgggtcagctcgcccctctccacttcaaaggcccttctctctggcttctgcagtcttcccagacatctatggaattgccaggatgtccacaagggca

SEQ ID NO: 36578 - DNA, 601 bp, Human
cagccctgggggcctctgaataatgtcccaagtcactctgggaatgattccaatgcaaagccttggtgctcacttcaaggacctatgtgccccctgctcgaggcctcagacactctgcccacctctccagcaacctctgtctccttcctcgaagcctcccctcagcccagctccagactggcaggtctctgggactctgtccagggcctctctgctttctctttccactttcctggggttacctgtctcatccatgccaatgacctctgcctcgtcactcatgataccatctctctgcccycagatccggggttccctggcttcctggacaccttgccctaggtgccccccagcctctcactcctactatgtcccaaatggaccctggcatctcctccaagcccatcctcctcccaggcctcatctcaatgcgatcgtactgtcccccccatcagccagatgtttcctgcccccgcctccctcctcaccctcctgccacagcccttcagctccagagcatgtacgctgagcctcctaagggtctgtccaccaaccccctttccctccccggcgctccacctggtccagcctgtcctctcct

SEQ ID NO: 36579 - DNA, 601 bp, Human
tattactttatttttttttagagtcagagtctcactgtgttgcccaggctgcagtgcagtggtgccatcatagctcactgcagcctccaattcctgggctcaaacaatcctcccttctcagcctcctgagtaactgagactacaggcaacgcccccatatctgactattttttttttcttgtagagatggcgggggggtctcactatgttgcccaggctggtcttgaacgcctggcgttgagtgatcctcccacgatggcctcccaaagtgctgagattacatacatgagccactgtcccctggtcctatattaatttatttagccccgccaataaccttatgagttagatactataatcattatcctcattttatgaaacaggcctggtcaatcagagtgcagtaattcactcagcaatggagaagcgacccaggtctggccaatcagaggcatgggggcaggcatttgactcaaccgggaccaatgggagccaatctctgctgtttggtttgaactactgggaaaaggtgctctctcggtggcagctcctaggctagtggaacctgcatttgcagctgccaggagttacctttacccca

SEQ ID NO: 36580 - DNA, 601 bp, Human
attttattactttatttttttttagagtcagagtctcactgtgttgcccaggctgcagtgcagtggtgccatcatagctcactgcagcctccaattcctgggctcaaacaatcctcccttctcagcctcctgagtaactgagactacaggcaacgcccccatatctgactattttttttttcttgtagagatggcgggggggtctcactatgttgcccaggctggtcttgaacgcctggcgttgagtgatcctcccacgatggcctcccaaagtgctgagattacatacatgagccactgtcccctggtcctatattaatttatttagccccgccaataaccttatgagttagatactataatcattatcctcattttatgaaacaggcctggtcaatcagagtgcagtaattcactcagcaatggagaagcgacccaggtctggccaatcagaggcatgggggcaggcatttgactcaaccgggaccaatgggagccaatctctgctgtttggtttgaactactgggaaaaggtgctctctcggtggcagctcctaggctagtggaacctgcatttgcagctgccaggagttacctttac

SEQ ID NO: 36581 - DNA, 601 bp, Human
caagaccagcctgggcaacatggtgaaaccctgtctctactaaaatacaaaaaattagccagtcgtggtggtgtgcgtctgtaatcccagccactcgggaggctgaggcaggagaattgctggaacccgggaggtggaggttgcagtgagctgagattgtgccactgcactccagcctgggcaacagagcaagactccatctcaaaaaaaaaaaaagaaaaagaaatataaatttcatgctgactcagtaagtggacacctatccaccacatctgaaataagcctcctgtagtaataaccmcggcacaccctgccacagctctcgctatgttccaggccctgctctaagcatttgcatttttatttatcttttaaattttattactttatttttttttagagtcagagtctcactgtgttgcccaggctgcagtgcagtggtgccatcatagctcactgcagcctccaattcctgggctcaaacaatcctcccttctcagcctcctgagtaactgagactacaggcaacgcccccatatctgactattttttttttcttgtagagatggcgggggggtctcactatgttgcccaggctggt

SEQ ID NO: 36582 - DNA, 601 bp, Human
ccctacactgagtcgtgacctttttgtgcctccttttcctcctctgttcagatcacttccataatgatcttacaggtataatgtgaatatcaaataatagggcacttgtaaagtgctgagcccagtgcctggcaaatagtgaagcctcaattaagtggttaaaaagaaatttttagggccgggcccggtggctcactcctgtaatcccagcactttgggaggccgaggggggcagatcacctgaggtcaggagttcaagaccagcctggctaacatggtgaaaccccgtctctactaaaartacaaaaattagccgggcgtggtggcacgcgcctgtaatcccagctactcgggaggctgaagcaggagaatcgcttgaacccgggaggcagaggttgcagtgagccatgatagcgccactgcactccagcctgggtaacagagtgagactctgtctcaaaataataataataataaatttttagagcagtgaggtgagggttggagcctcacctttaaatttttgcagagagggggtctcgcttattgcccaggctagtcttgacctactggcctcaagcgatcctcctgctttcagcct

SEQ ID NO: 36583 - DNA, 601 bp, Human
gtgtagcagcgcaggagtagccccttgtccttcagcaggcgcatgaagtagtgacagatggttggctgcagggaagagcgacagcactgctgacgactgcagggaacagccacaggccactgccgcatgccaggaactgttctaggcactgtgactgttttacccccagggaaccgtcacagcagccgcgtcggggagagaccactgctatccccagatcacagatgaggaaactgaaggacagggaaggggattgtgttgccaaagtcacacggtgggtaagctgcagagctgagatttrcacccaggcagcccggctgcagggtcccgggctctcaacggcatcattagtcagctaagcctcgcagcagccctcttcagacagtaccattagcttcacttcacaggaggcaaatcggaggctcaaggtcgtaagatgaagacacgaggaaccaggacttgaaccgaggcagtctgggcccagcacccatgtacttaatggctacataatatttgtctgcagggccttggcggggcttctcatgcgtgccctcccccaacccttcctgtttcgccccctgcaaaacaaagatctcacctt

SEQ ID NO: 36584 - DNA, 601 bp, Human
cgtgtagcagcgcaggagtagccccttgtccttcagcaggcgcatgaagtagtgacagatggttggctgcagggaagagcgacagcactgctgacgactgcagggaacagccacaggccactgccgcatgccaggaactgttctaggcactgtgactgttttacccccagggaaccgtcacagcagccgcgtcggggagagaccactgctatccccagatcacagatgaggaaactgaaggacagggaaggggattgtgttgccaaagtcacacggtgggtaagctgcagagctgagattygcacccaggcagcccggctgcagggtcccgggctctcaacggcatcattagtcagctaagcctcgcagcagccctcttcagacagtaccattagcttcacttcacaggaggcaaatcggaggctcaaggtcgtaagatgaagacacgaggaaccaggacttgaaccgaggcagtctgggcccagcacccatgtacttaatggctacataatatttgtctgcagggccttggcggggcttctcatgcgtgccctcccccaacccttcctgtttcgccccctgcaaaacaaagatctcacct

SEQ ID NO: 36585 - DNA, 601 bp, Human
tggccccgcattgctggagtccccgcctgagctcttgggcacgcagctctgctcctctgctgaggacaccatgcccgttccacccgcccatcctcctcccaggatgctcgcatccgcctacctgcgtgtagcagcgcaggagtagccccttgtccttcagcaggcgcatgaagtagtgacagatggttggctgcagggaagagcgacagcactgctgacgactgcagggaacagccacaggccactgccgcatgccaggaactgttctaggcactgtgactgttttacccccagggaaccrtcacagcagccgcgtcggggagagaccactgctatccccagatcacagatgaggaaactgaaggacagggaaggggattgtgttgccaaagtcacacggtgggtaagctgcagagctgagatttgcacccaggcagcccggctgcagggtcccgggctctcaacggcatcattagtcagctaagcctcgcagcagccctcttcagacagtaccattagcttcacttcacaggaggcaaatcggaggctcaaggtcgtaagatgaagacacgaggaaccaggacttgaaccgaggcagtct

SEQ ID NO: 36586 - DNA, 601 bp, Human
attctcctgcctcagcctcccgagtagctggggttacaggcaccaccacacctggctaatttttgtatttttagtagagaccagatttcatgatgttggacaggctggtcttgaactcctgacctcgtgatctgcccacctcggtgtcccaaagtgctgggattacaggcgtgagccaccgcgcccggccacctgttttataattcggggttctgaggtgtgatctagagcttgaattaatactgttgtagtgcatcatgtcatttctatacatattcataaaacaggtagaggcagcaayattttgttgttgttttgatttgttttttgtttctttgaaaccaggtctcccaggctacagtacagtggcaccatcatagctcactgcagtcttgacttcctgaactcaagcaatccccctacctcagcctcctgagtagctggggctacaggcacacgccaccctgcccagctaatttttgtatttcttgtagagacagggtctccctatgttgcccaggcgggtcccaaacgcctgggctcgagctatctctcgctttggcctcccaaagtgctgggattacaggtgtgagccactgtg

SEQ ID NO: 36587 - DNA, 601 bp, Human
gtacagggagaaaacactagaacacttatttattttcaatgttaccactcttttttgtttgtttgtttgtttttttaaattgagatggagtcttgctctgtcacccaggctggagtgcagtggcacaatcttgactcactacaacctctgcctcccaggttcaagcgattctcctgcctcagcctcccgagtagctggggttacaggcaccaccacacctggctaatttttgtatttttagtagagaccagatttcatgatgttggacaggctggtcttgaactcctgacctcgtgatctkcccacctcggtgtcccaaagtgctgggattacaggcgtgagccaccgcgcccggccacctgttttataattcggggttctgaggtgtgatctagagcttgaattaatactgttgtagtgcatcatgtcatttctatacatattcataaaacaggtagaggcagcaacattttgttgttgttttgatttgttttttgtttctttgaaaccaggtctcccaggctacagtacagtggcaccatcatagctcactgcagtcttgacttcctgaactcaagcaatccccctacctcagcctcct

SEQ ID NO: 36588 - DNA, 601 bp, Human
tgcccgggctggtcttgaactcctgggctcaagtgatcctcccacttcagcctcccaaagcgttgggattacaggcgtgagacaccatgcccagccactgttttcttttcttttcttttcttttttttttttttcagatggagtttcactcttgttgcccaggctggagtacaatggcgctatctcggctcactgcaaccactgcctcctgagttcaagcaattctccctgcctccgcctctcaagtagctgagattacaggcacccgccaccatgcgtggctatttttttttttttttttgagacggagtcttgctctgttgccaggctggagtgcagtggcgcgatcttggctcactgcaagctccgcctcccaggttcaagtgattctcctgcctcagccttccaggtagctgggaacacaggcacgcgccaccatgcctagctaatttttgtatttttagtagagacggggtttcaccatgttggtcaggatggtctcgatctcctgacctcgtgatctgcccacctcagcctcccaaagtgctgggattacaggtgtgagccactgcgcccggccactgttttcttttaagacagt

SEQ ID NO: 36589 - DNA, 601 bp, Human
ctcagcctccacatctggctgatttttaaaattttctgtagagatggggtctcactatgttgcccaggctggtcagcgagccttctgcctcagcctcccaatgtgctgggattacagtgtgagtcatcatgcctggcccttccttggctttaatcactatcttcccctttagtagccagggtcctttcttactatggcctgtttcatagatggcatattcacctgtgttcttttctttttttggaggcagggtcttgctctgtcactcaggctggagtgtagtggtctgatcacagctcastgtagccttcacctcctgggctcaagccatcctcccacctcagcccactgagtagctgggactacaggcaaatgccaccatgcccggctaattttttatctttttaattatttttgtagagatggggggtggggtggtctccctatttgcccgggctggtcttgaactcctgggctcaagtgatcctcccacttcagcctcccaaagcgttgggattacaggcgtgagacaccatgcccagccactgttttcttttcttttcttttcttttttttttttttcagatggagtttcactctt

SEQ ID NO: 36590 - DNA, 601 bp, Human
ttgcctcggcctcccaaagtgctgggattatagacatgagccactgtgcctagccatgtttttttatgtatttgagacaaggtctcactctgtcgcccaggctatagtgcagtggtacaatcatagctcactgcagcctccaactcctgggctcaagcaatcctcccacctcagcctccacatctggctgatttttaaaattttctgtagagatggggtctcactatgttgcccaggctggtcagcgagccttctgcctcagcctcccaatgtgctgggattacagtgtgagtcatcatgyctggcccttccttggctttaatcactatcttcccctttagtagccagggtcctttcttactatggcctgtttcatagatggcatattcacctgtgttcttttctttttttggaggcagggtcttgctctgtcactcaggctggagtgtagtggtctgatcacagctcactgtagccttcacctcctgggctcaagccatcctcccacctcagcccactgagtagctgggactacaggcaaatgccaccatgcccggctaattttttatctttttaattatttttgtagagatggggggtg

SEQ ID NO: 36591 - DNA, 601 bp, Human
cagccactccacagcctgtgtggcttttattctgcaaattcaggccatttgctttcatttttcagaaaaaaaatgttgttttattagagccagatgctttatttccacctgtcattaattgctgaaattaacatacatttacaatgtctctgttattaatggagccccctcagatgtggcatccttgtgcagtgcgcaccctgcacagctgcatgtggcagctctaggcaagcattaacataaatgaatcaggagggcttactaggtgtggtttgtttgtttgtttgtttgttttttttttgagatggagtcttgctctgtcacccaggctggagtgcagtggcacaatctcggctcactgcaacctctgactcccaggttcaagagattttcctgcctcagtctcccaagtagctgggattacaggcacgcaccaccatgactggctaatttttgtatttttagtagagatggggtttcaccatgttggctaggctggtctcgaactctggacctcgtgatttgcttgcctcggcctcccaaagtgctgggattatagacatgagccactgtgcctagccatgtttttttatgtatttga

SEQ ID NO: 36592 - DNA, 601 bp, Human
ggcccacagccactccacagcctgtgtggcttttattctgcaaattcaggccatttgctttcatttttcagaaaaaaaatgttgttttattagagccagatgctttatttccacctgtcattaattgctgaaattaacatacatttacaatgtctctgttattaatggagccccctcagatgtggcatccttgtgcagtgcgcaccctgcacagctgcatgtggcagctctaggcaagcattaacataaatgaatcaggagggcttactaggtgtggtttgtttgtttgtttgtttgtttkttttttgagatggagtcttgctctgtcacccaggctggagtgcagtggcacaatctcggctcactgcaacctctgactcccaggttcaagagattttcctgcctcagtctcccaagtagctgggattacaggcacgcaccaccatgactggctaatttttgtatttttagtagagatggggtttcaccatgttggctaggctggtctcgaactctggacctcgtgatttgcttgcctcggcctcccaaagtgctgggattatagacatgagccactgtgcctagccatgtttttttatgt

SEQ ID NO: 36593 - DNA, 601 bp, Human
aggcccacagccactccacagcctgtgtggcttttattctgcaaattcaggccatttgctttcatttttcagaaaaaaaatgttgttttattagagccagatgctttatttccacctgtcattaattgctgaaattaacatacatttacaatgtctctgttattaatggagccccctcagatgtggcatccttgtgcagtgcgcaccctgcacagctgcatgtggcagctctaggcaagcattaacataaatgaatcaggagggcttactaggtgtggtttgtttgtttgtttgtttgttgtttttttgagatggagtcttgctctgtcacccaggctggagtgcagtggcacaatctcggctcactgcaacctctgactcccaggttcaagagattttcctgcctcagtctcccaagtagctgggattacaggcacgcaccaccatgactggctaatttttgtatttttagtagagatggggtttcaccatgttggctaggctggtctcgaactctggacctcgtgatttgcttgcctcggcctcccaaagtgctgggattatagacatgagccactgtgcctagccatgtttttttatg

SEQ ID NO: 36594 - DNA, 601 bp, Human
tgaggaccctcttgttacccctcactctggatcccggagactttctggttccttagtggcccaagatctaaccccctcccttcagagatttccctgggtgcccacagaaagaaacaggaggccagaccggattgttagttgtttttgtttttaatttgtctccaataagcaatgtcttctgcccatccagcatgggaagtgggtcccacgtgaagggggcccaccacccactttgggagctgaaggcagagactcgggagccctcccggctcagactccccctacgctgggtgtgggttakattcagaggcccacacccacactggggtaggttaggtatggtttacttagccacaggcccccgggggcaggagacagagtgggggcccgaagctccctgtcctggaagagttaaaagttctggggtagccctggccccgtgggggcagttagagatgagggaggttactccttagcccaggagtggttagagacagtggggctggtagagatgcctgtttaagccttggcctctaggaggtgttagagatttgctggggttgggggccagggttgctgggaccccagttttggggaggga

SEQ ID NO: 36595 - DNA, 601 bp, Human
gttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccaggtcgggagactctcgcagtcgctttaaaataagtttctctccccctcttactcttttagcatattgcttttgttagagctttttttttctttttctttattttttattttcattgcttttctyctctaccccccagcacacttaagtctgcaactttttggctgtcccgttggtctgcgttttcaattgctttttgcaaactgacacctgtgcagtttgctttttttggtctatatttttatgactgaaattacaatttttgaaagaggaaagctgtttctatagtcacagcttgcaaaatttaaagaacgtggctgttcctgaagacattaccattctgtaatgcagttaggagtgggtatgggagagagagtacttttagagctgttcatattacttttattctaatcttgctcttgtgcg

SEQ ID NO: 36596 - DNA, 601 bp, Human
ctggagtgcaatggcgtgatctcggctcaccgcaacctccgcttcccgggttcaagccattctcgtgcctcagcctcctgagtagttgggattacaggcatgcgccaccatgcccggctaatttttgtattattagtagagacgagatttctccatgttggtcaggctggtctcgaattctcaacctcaggtgatccgcctgcctcggcctcccaaagctctggaattagaggcgtgagccaccgctcccggctatcttttctgttttttaagtagacttaatttatttttagattttggytgaaactgagtgagcagaattcctaaagatgaagaaactgttccaatgaacagtgcaagctgaccccataggcatgctttacacacgccgtgtaaatgttaaatgctgtactcgatgaaaatgattgctctataaccgttcatacattttaggtgcatgttgttttgatagccttgactgacttggtttcttttgcagataaccttctgttcggtgatgaaattatcactaatggttttcattcctgtgaaagtgatgaggaggatagagcctcacatgcaagctctagtgactggactc

SEQ ID NO: 36597 - DNA, 601 bp, Human
gctgtgttgccctggctggagtgcagtggtgtcatcatggctcactgcagtctcagcctctcctggcctgagtcttgctctgttgcctaggctggagtgcagtggcaggatcttggctcactgcaacctctgcctcctgggttcaagcaattctcttgcctcagcctcctgagtagctgggattacaggcgcacaccaccacacctggctaatttttgtatttttagtagagatggggtttcaccatattggccaggctggtctgaaactcctgaccttgtgatccgcctgccttggcctmccaaagtgccaggattacaggcgtgatccaccgtgcctggctatacattgttttttttaatgaaaatagagaattgttgtagtattgaggtaatagaatcctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgt

SEQ ID NO: 36598 - DNA, 601 bp, Human
gaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtctaaaaagaaaaaaaacaaaaagccggrcgcggtggctcacacctgtaatcccagcactttgggaggctgaggcctgcggatcacgaggttaggagatcgagaccatcttggctaacatggtgacaccccgtctctactaaaaatacaaaaaatcagccggtcgcggtggcaggcacctgcattcccagctaatcagtaggctaaggcaggagaatggtgtgaacccaggaggcggagcttacagtgagccgagatcgcaccactgcactccagactgggcgacagtgtgagactctgtctcaaaaaaaaaaaaaacaaaaaaaaaaa

SEQ ID NO: 36599 - DNA, 601 bp, Human
tcccagctaatcagtaggctaaggcaggagaatggtgtgaacccaggaggcggagcttacagtgagccgagatcgcaccactgcactccagactgggcgacagtgtgagactctgtctcaaaaaaaaaaaaaacaaaaaaaaaaagaaaaaattcttccctacttaaaataatttgttgaaatggtttattttcttctcaagttgcatttgctttaatttgttggctaaatgcttaaaaggcttaaaattggcctgacttaaaaattccttatctgtgttaaagatggaatatgaggtatrtttaattttactcagttatttgggagttttatttctgaaataagggtagggttgtatttttatttcttaaaagaagtttcagactaaaattttctttctcaactcttacctaattatatggtaagagagctagctagttcctataaaggtagaagatttaattttacaaattatgccatgcacattttaggtgtctgtttcatgtggaatacctgacttcaggtcaagggatggtatttatgctcgccttgctgtagacttcccagatcttccagatcctcaagcgatgtttgatattga

SEQ ID NO: 36600 - DNA, 601 bp, Human
tccctacttaaaataatttgttgaaatggtttattttcttctcaagttgcatttgctttaatttgttggctaaatgcttaaaaggcttaaaattggcctgacttaaaaattccttatctgtgttaaagatggaatatgaggtatgtttaattttactcagttatttgggagttttatttctgaaataagggtagggttgtatttttatttcttaaaagaagtttcagactaaaattttctttctcaactcttacctaattatatggtaagagagctagctagttcctataaaggtagaagrtttaattttacaaattatgccatgcacattttaggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggtactatgaactcttctggttgtttctttggccttctctcatgaaaaagtattttgttcacatacagccaccttaaggttatcgttcattgtttagtaaagtgaatgctgcta

SEQ ID NO: 36601 - DNA, 601 bp, Human
cctgtcagatttggaccttaaattagttatggtaatctaaaattatttcatacatgttcattgccaaaaaatataggaaaatttggcagaaaataaaaattatccagaaatatgtcctgtgtgcttagcaatatatggaggtaatcatgtcattacgaaagaggaagaatagtatattaaaatggagtcattggtcgggtgcagtggctcatgcttgtaatcccagcactttgggaggacgaggtgggtcgatcatttgaggtcagaagtgagaccagcctggccaacatggcaaaacccygtctctcttaaaaatacaaaaattagcctggcatggtggcatatgcctttaatctcagctgcttgggaggctgaggcaggagaattatttgaactcgggaggtggaggttgtagtgagctgagatcatgccacttcactccaggctgggcaacagaacaagactccatctcaaataaataaaatggaatcattttatttgacaaatgtctatttttttttgaaaggatcaattcccatttagtgtatatacacacattatgtttttcctcttaatatatgatggactcttcaatgtcaag

SEQ ID NO: 36602 - DNA, 601 bp, Human
atttggaccttaaattagttatggtaatctaaaattatttcatacatgttcattgccaaaaaatataggaaaatttggcagaaaataaaaattatccagaaatatgtcctgtgtgcttagcaatatatggaggtaatcatgtcattacgaaagaggaagaatagtatattaaaatggagtcattggtcgggtgcagtggctcatgcttgtaatcccagcactttgggaggacgaggtgggtcgatcatttgaggtcagaagtgagaccagcctggccaacatggcaaaaccccgtctctcytaaaaatacaaaaattagcctggcatggtggcatatgcctttaatctcagctgcttgggaggctgaggcaggagaattatttgaactcgggaggtggaggttgtagtgagctgagatcatgccacttcactccaggctgggcaacagaacaagactccatctcaaataaataaaatggaatcattttatttgacaaatgtctatttttttttgaaaggatcaattcccatttagtgtatatacacacattatgtttttcctcttaatatatgatggactcttcaatgtcaagtgtttttc

SEQ ID NO: 36603 - DNA, 601 bp, Human
aacgcaagtaatgttggtggctcgtgcctgtaatctcagcactttgggaggccgaggtaggtggatcgcttgagggcagcagtttgagaccagcctggccaacatggtgaaaccctgtctctactaaaaatacaaaaattagctgggcatagtggtgtgcacatgtagtcccagctacttgggaggttggggcatgagaatcgcttgaactcaggaggcagaggttgcaatgagccgagaatgtgccactgcactccagcctgggtgacagagtgggactctgtctcaaaaaatcaaaaasaaacccagaagtaatgctaaactctacttctaatttatgtgaaaaattaagacaaaggtagagttcaacttagactttttggtggaatgtgtttttaatgttgcaagggttagcatcaattaatttatgaaatggtcctttatccttatattttttgattacagttttgatctttcaaatttaattgatttcacatttaataaattcaaatgtatagtttggtagaagtgtaacataccatgtaagatggaatttgggggctcagaatgattggttcattcttgtagtaacagccatgcc

SEQ ID NO: 36604 - DNA, 601 bp, Human
actttttggtggaatgtgtttttaatgttgcaagggttagcatcaattaatttatgaaatggtcctttatccttatattttttgattacagttttgatctttcaaatttaattgatttcacatttaataaattcaaatgtatagtttggtagaagtgtaacataccatgtaagatggaatttgggggctcagaatgattggttcattcttgtagtaacagccatgccataacggtgatatgtcgatatagtttacccaaaagggtgtgtatataaaagtgttcacataaaatttaaatccytattactctcaggaaaatttctttgtcatatatattctcatactgtctgtttcctcctctagtttagaatcagaggaggagagagagagatttcagttgcatcagatgtgtcctttcataagtgagggaaagaggagaggaaaaatattaaatccctagccagagaattgaattagaccccacatcagcagtcaaggcagccagagtaaacagttggaagaaacatggagtcaagctcttcaattttgtgtctatcccatatctcgtggctttagcagttaactcagtcttacctaatta

SEQ ID NO: 36605 - DNA, 601 bp, Human
ggtatcttaacatgatatggagaaggaagtgtttaatagtgctctgtatgttgtgtttctctaggggatggaaaaataagaatgggttattagctggcagaaatgatgacagatttgagtgcttactgtaggtcagctgctttacatatgttacctgattttaatctgaggtaggaactattactcttcttcaggtgggaaaactcaggaccatagaggttaaatacctcatgcacagtaactactaagaagtggaagaaccagattaaaatccagtctatttatgcttagagcctgcccscttaactactatgcggtgttgtctcagatgtagaacacatctttgttttctctgaggacttagaaaaaacacgcgtgattcttctccactgaatataggaatagtttctaccctgtttagaacatgcatagtctttatcaataagtgttaactgacatgtgaaatcactttctactctttggaagccgatgttttaagtccaagtagtctgtatggtggaaattcctaacttatgttaaaaaaaagaaaaccactgtaacttagctataacagtcttatataacttagaactttaagtct

SEQ ID NO: 36606 - DNA, 601 bp, Human
tgggattacaggtgtaagccactgtgccctgcctgtggtgtcttgggaaactcatgagtactatgtgtctgttgtaatagagggaaataagtggttttcacagtgatttgtagtggactgtgaaattttagggattcaggtcagagttgtcacacaggttgtagtcagggtgagaactgggtcatgatgcagtatgaaaaagttcgagagccactttggagagaacttgagataggccacctaccagtgtggtaaccaggcttttgagaattcgtctgggatacggtacaataaatactayatctattatgtgtgaagagatgttaagttagggacatactgtgaattcaaggatagaaaacttttccatcagtttttagggatcctactctttcacttaaaccccaaatggccaagctaggattgatttggtgtgctgtagaaagaacttcattggtattcatggattcacattacatcttagaggagttttcaaaagcgtcttagactgtatgtgtatatacacacacattctgaagcagtaggtgggtcttggggcctgagatctcgggtgaatctaaatttaggttcacaggtgata

SEQ ID NO: 36607 - DNA, 601 bp, Human
tgtagtggactgtgaaattttagggattcaggtcagagttgtcacacaggttgtagtcagggtgagaactgggtcatgatgcagtatgaaaaagttcgagagccactttggagagaacttgagataggccacctaccagtgtggtaaccaggcttttgagaattcgtctgggatacggtacaataaatactatatctattatgtgtgaagagatgttaagttagggacatactgtgaattcaaggatagaaaacttttccatcagtttttagggatcctactctttcacttaaaccccaartggccaagctaggattgatttggtgtgctgtagaaagaacttcattggtattcatggattcacattacatcttagaggagttttcaaaagcgtcttagactgtatgtgtatatacacacacattctgaagcagtaggtgggtcttggggcctgagatctcgggtgaatctaaatttaggttcacaggtgatactgtagattcacagtgtctacagagtacactatgaatttgtggtgactacattattgacaaaatattttaggtttataatcagaaaaaagttaaaatagttaatgaag

SEQ ID NO: 36608 - DNA, 601 bp, Human
ggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaaca

SEQ ID NO: 36609 - DNA, 601 bp, Human
gactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttwaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacac

SEQ ID NO: 36610 - DNA, 601 bp, Human
aaaaaagaaaaaagaaaaaaaatcttatgtacactataaatatatacacctactaagtgcccacagaaattgaaaacaaagaaaaaaatccatgattaaaagcttttatattaacgggggaacctctgaccagaaagagccgacagggggcgttcctggatgatctggggctgtcaattgcgagacgcggaggattgtgggacttgtggtttttctcgcatcatttaagctttctggactacatgtcccaaaatgcaaatgcaatcagacggtcccactgtggggtgtgaagtgtccgtaragctgtgagaggtaagtgtgttctgtgtgtgctgcggatttctagaagttgtggatttcttgtgagggattctatttctcctctttgccctcggtgggacctggaagagagtagttgttccactgatgcacgttttcagcgggggtttcccctgaccctttggtctcgggaaaccggactgtgtgtttgttcagctgttcacgttttgctgtggaatgtcaaggagaaagcggggtcctgatctcagatctggaaagccaaacataaaataatgtttacatacggggtgcatgtcactag

SEQ ID NO: 36611 - DNA, 601 bp, Human
cggcgcctgacagagctccacggatgcatggacaggtgcaggagctgtacacggtttgaacgcaaacccgtgtgttgttttgggagagtagggaccttggctgtcttgatcaccacagtcttagaccttgagaaaaggatttcagagcaagttgtttattttgcagttgattccagtaaattcattgacggagcaaggatgtaaaacaggaaagagaggaaagccaagaaagtgtgtgttaatgagtgggttactgccttgggcactggggttcagtcctgtgagggaccctccaactgtytaggacatgcctgaggattgtctcaatgaaacttgaggactggggccgggcgcagtggctcacgcctgtaatcccagcattttgggaggctgaggtgggcagatcacatgagctcaggagttcgagaccagcctggccaacatggtgaaaccccatttctactaaaaatacaaaaattagccggtcgtggtggcacatgcctgtaatcccagctgcttgggaggctgaggcaggaaaatctcttgggaggcagaggttgctgcagtgagccgagattgcaccactacactccagcctggg

SEQ ID NO: 36612 - DNA, 601 bp, Human
attgacggagcaaggatgtaaaacaggaaagagaggaaagccaagaaagtgtgtgttaatgagtgggttactgccttgggcactggggttcagtcctgtgagggaccctccaactgtctaggacatgcctgaggattgtctcaatgaaacttgaggactggggccgggcgcagtggctcacgcctgtaatcccagcattttgggaggctgaggtgggcagatcacatgagctcaggagttcgagaccagcctggccaacatggtgaaaccccatttctactaaaaatacaaaaattagccrgtcgtggtggcacatgcctgtaatcccagctgcttgggaggctgaggcaggaaaatctcttgggaggcagaggttgctgcagtgagccgagattgcaccactacactccagcctgggcaacagtgcaaaaaaaaagaaaaaaagaaaaaaaaaagttgaggatggtgcacagtggctcatacctgtaatcctagcactttggaaggctgaggcaggaagattgcttgaggctaacagttcaggaccaacctggcaaacacagtgagactctgtctctatataagtaaagtaaattttata

SEQ ID NO: 36613 - DNA, 601 bp, Human
tcatgagctgagatcatgccaccacaccccagcctgggcaacagagcaaaactccgtctcaaaaagaaaaaaaaaaaagaaagttgagcaagctagggtgattttcttttattttcttttgtgtttgtgtgtgcacgtgtgtgtgtgtgtgtgtgtgtgtgtatgacaggctttcactctgtcacacagactgggatgtggtggtgtgattatagctcacttcagcctcaatctcttgggctcaagtgatcctttcaccccagcctcctaagtagctgggactacaggcaaacgccaccgygcccagctaatttttaatttaatttttattttttgtagagacgaagtcttactatgttgcccaggctggtctcgaactcctgggctcatgtgatcctcctgccttggcatctcaaagtgctgggatgactagtgtgagccactgtgcttggccttgaagctagggtatttattcaccatctctcatccctcatgggtccaggatcactctaggggaattaattccctaacattttgactctgctcctcccaaggaggcttccgtgggcagagaacatctgaggcaagagagacacaggaa

SEQ ID NO: 36614 - DNA, 601 bp, Human
ccatctctcatccctcatgggtccaggatcactctaggggaattaattccctaacattttgactctgctcctcccaaggaggcttccgtgggcagagaacatctgaggcaagagagacacaggaaactgcttgtaagaaaattgtgtaggctgggcgcggcggctcacgcctgtaatcccaacactttgggaggctgaggcaggcggatcacgaggtcagttgatcgagaccatcctggctaacatggtgaaaccccgtctctactaaaaatacaaaaaattagctgggcgcggtggcggrcgcctgtagtcccagctactcgggaggctgaggcaggagaatggcgtgaacctgggaggtggagcttgtggtgagccgagatcgcgccactgcactccagcctgggtgacagagcgagactccgtctcaaaaaaaaaaaaaaaagaaagaaagaaaattgtgtccaccagggtgctgtggttcatatctgtcatcccagcaactcaggaggctgaagcaggaggattacttgaggccaggagatcaagacctgcctgggtaacacagccagactccgtctctacaaaaaatttttttaag

SEQ ID NO: 36615 - DNA, 601 bp, Human
gtaggctgggcgcggcggctcacgcctgtaatcccaacactttgggaggctgaggcaggcggatcacgaggtcagttgatcgagaccatcctggctaacatggtgaaaccccgtctctactaaaaatacaaaaaattagctgggcgcggtggcggacgcctgtagtcccagctactcgggaggctgaggcaggagaatggcgtgaacctgggaggtggagcttgtggtgagccgagatcgcgccactgcactccagcctgggtgacagagcgagactccgtctcaaaaaaaaaaaaaaaaraaagaaagaaaattgtgtccaccagggtgctgtggttcatatctgtcatcccagcaactcaggaggctgaagcaggaggattacttgaggccaggagatcaagacctgcctgggtaacacagccagactccgtctctacaaaaaatttttttaagaaaggaaattggctgggcacggtggctcgcgcctgtaatcccagcactttgggaggctgagttgggcggatcacctgaggtcaggagttcgagaccagcctgaccaacatggagaaaccctgtctctactaaaaatacaaaatta

SEQ ID NO: 36616 - DNA, 601 bp, Human
catgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccacyacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatag

SEQ ID NO: 36617 - DNA, 601 bp, Human
ctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctcygcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctac

SEQ ID NO: 36618 - DNA, 601 bp, Human
ggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgygaatgacagaaatgacatgggaaagatgagccagctggcgtgcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctc

SEQ ID NO: 36619 - DNA, 601 bp, Human
atcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctrtggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaac

SEQ ID NO: 36620 - DNA, 601 bp, Human
caggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtrctcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaaggg

SEQ ID NO: 36621 - DNA, 601 bp, Human
ggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcrgcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttca

SEQ ID NO: 36622 - DNA, 601 bp, Human
ccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcmttcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcc

SEQ ID NO: 36623 - DNA, 601 bp, Human
ttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccraagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacac

SEQ ID NO: 36624 - DNA, 601 bp, Human
gtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcrtgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattcagcacg

SEQ ID NO: 36625 - DNA, 601 bp, Human
ttggaaaatagctgtgttgcttgtgcctagatgaattcgtacacagataccagcgtattttgtgaagacaactgattttgctttagtccatgctttacgatttacaaagcatgtatctttgtatatatgtttgcatattttaaattgttccccaaaggaacttgtgccaaatcaatcttttgccattctcatctttagggatctgctaagctagaaaaagccgagatcctgcagatgaccgtggatcacctgaaaatgctgcatacggcaggagggaaaggtacatctcctagacctagtkggggctctgaatggttggcaaagagtgagcagcggctgaaggccaggattggtgcagtagctgcctgatttttctttgggggtggggagagaacggtgtgtggtgtgtgcagttccctgtcagtacattttcgaatgcacatagaatcttctccagtgaattcaccaccccagctctctgcggattgagctagtgcatcttttggaaaaatacctattatttgtgaggtcttcaaaagttgtgacagccctgattcagatcaggtagctttcacatttgtccattgctattttgagaaaa

SEQ ID NO: 36626 - DNA, 601 bp, Human
ggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttwtcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatatt

SEQ ID NO: 36627 - DNA, 601 bp, Human
tgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaamctgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtattctgtggtgtatgtc

SEQ ID NO: 36628 - DNA, 601 bp, Human
gctgtcacagttggacgcgcgaacggcagcgtctgggcgacaggcgatgtcccagccactgaaaccgtatttgggggcactttcaaaatagatcaggagaaaataaaaacaatttgatttttgatttttagagataccaaaatcacaacttgatttttggaggaattaaagcaacctgcgatgtcaaggctacgtaggttgaactttgcaggttgaccgtgtgtgacttggctaacgcaagagtgagtgacagatgtaagcatcggaaagggcatcatttctttgactgcttgttctcaastctggaagagatcggcgtcgtaatcacagaagccagacctccactttcctgtgacagagggagattaccgaggcattttagagccaaggcgggtcaaatgataattgcttctaattggcatccccagaagcaccttaattatttatctgcagctgtcactcaaagagggaaattcttcctacctttggaaaactggttttctttcatattgttattctaatacatacaaagcaaagcacaaaatctgcaagagcaaagatatttacacgaaagcaaaggtttaagtatctgatcattaaa

SEQ ID NO: 36629 - DNA, 601 bp, Human
attattttgttcagtgtgcctgacaggagggagaaggaaagctatttgagattagttgactttaaaatatatgagtggaactaggaaatgctaatatctaacttctcagcccaactgccggtaattatttcactgggagactttcaagtaaaaattgtgggacattttggccaatgggttagcatctggattacaaattaaggcgtaatttttacctgaaaagagacagccgggctgaaagcaaagtccgttaagagtgaaacaagaactaagaataaaataacacagacttgaactgtgsaatcactctgaatatttaatgggtgccacaagtacccagaagaaactattgttatgttaatgcagcacctgacatactcttcttatttcataggcaaagtactagctctgtgattagattgaattctccaacaacaacatctcagattatggcaagaaagaaaaggagaggggtatgtgatttttccccctttttatttcatgtaacttatactattgtgtaacagttacattttttcatttgagtaattttatcatttgtgaattcataaacttttgttgtttgcttcttttggataga

SEQ ID NO: 36630 - DNA, 601 bp, Human
gtggttttagaagtcatggctctccccctgccgcagtggttaatgacacagatttctaagagtatctttcaaaggatatggcagcatgtccttgttgaaaatactttcagtttaattccaataagacaacagttgtttgtttattccattttgtttgtttacttcatgaatctgcaaacattataaaacaagccctacaaagtccttggaaattatccagaaagtgcagtttcaattattagtgactttactgaatctgcttgtaccattttcatggaaaaattaaacgctgaccaaatayaaaacataatatgctactgattatacatttttaagacaaaaagcacacccaatctatatgcagagactgtgtttgataaactaaaaataatgtggaaattgtagttttgattagtagcattttcagtgccaaataggcttcaagtgaaaatgtcagtaatcaatgatgtttttaaaatttggaagtactgaaatgtctgcagttatgaggcgaagtctgtttgattttttttcttggtttgttagattttttttttcttaaatgttgacttaaaccttaaaagcaaacatcagttgtttg

SEQ ID NO: 36631 - DNA, 601 bp, Human
catttgtatttcaattggttaccagaggtttccttattctgaaagcagggacataaaaatatatttgcaagacaattttattaagaactattttaaaaggttcaaaaatccttaagcatttatgatgcttcctaggtaagcagtaaattattgcttcttgtttgtgagcttagaaattcacagtgacacctgctggtaattattggggaaaaaaaccttaaaagtcgtcctttttaaaatttttggatctgcttgaaatgcagatccaattatatggttctagtgtgaataccttatttcrggacttagtaggcctgtgaaaggacttattggagttttctattttaaaaatatttaacaatcaattgctaaaatcctatctccttatcttctggagttgttatgcaactcctctagactttggctttatagaagactattgatgccccatagtaaaacatattattaaccaagacacagattgaatgcaaagtttgagatttttacaactgaaatcattttgctgtggtgatcttaggagaataattattcttatgatttaaaaaagtcattctagtttcttttagtctttaaaagttaa

SEQ ID NO: 36632 - DNA, 601 bp, Human
aaaaaccttaaaagtcgtcctttttaaaatttttggatctgcttgaaatgcagatccaattatatggttctagtgtgaataccttatttcaggacttagtaggcctgtgaaaggacttattggagttttctattttaaaaatatttaacaatcaattgctaaaatcctatctccttatcttctggagttgttatgcaactcctctagactttggctttatagaagactattgatgccccatagtaaaacatattattaaccaagacacagattgaatgcaaagtttgagatttttacaacygaaatcattttgctgtggtgatcttaggagaataattattcttatgatttaaaaaagtcattctagtttcttttagtctttaaaagttaaaatggcaaatacttgtcattaggtatgacattaattagtgctttcatgtaaagtttggaaagaattcgaagttttctgtgaaaaaataaaagttgggattgtctagtgagagggaaattgaagccataatgctaaattcagtgtataatgtttcagattagtttctgtaggacataggattatttatttatttatttatttatgaaggga

SEQ ID NO: 36633 - DNA, 601 bp, Human
aggtatgacattaattagtgctttcatgtaaagtttggaaagaattcgaagttttctgtgaaaaaataaaagttgggattgtctagtgagagggaaattgaagccataatgctaaattcagtgtataatgtttcagattagtttctgtaggacataggattatttatttatttatttatttatgaagggatctgcaaagttagaaaaagctgaaatattgcaaatgacagtggatcatttgaagatgcttcaggcaacagggggtaaaggtaagtagatgacttcatttttttttttttttgccttttttacctttctcttttcatgttattccccctaatattgtaaggaagtcatagctgaacagttctttaacaagctgagataggaggccccagattaaagccatggaaatcaatgctaatggcaggattgaactcgtgggaaagaacttttggaacaaaagaagcacttgaccctgggcttgtgtttgctttcataatactgtgggagtaaagcttcattcacagcagcctggtcagagatttgtttaggacttaagaagcgcatgctggaatctgtacagaaagaacaaaaaaca

SEQ ID NO: 36634 - DNA, 601 bp, Human
actgctacctcaggatgttaggatactgattgaattagtcatgctacaagaaaatttgtttgattgctttacttcccttagcattgttagccacaaggctaagttttctcattagggtttcaaatatttggcatgagctgtacttctaaagagtaatattgttcttaggctttattataaaaactaagttccatcttggttgctattcttggccacctagacagtcctaaaatttgtcccagaatagtttgtgaacagatatttccaagtaggctccatacacgtcacctgactgtcaggycattgaagaggtcattgcactggagaatggccttcaagaagggagctggcggctgggtgtggtggctcatgcctgtaatcccagcactttgggaggccgaggtgggcggatcacctgaggtccagagtttcagaccagcctgaccaacatggagaaatcccgtttctactaaaaatacaaaattagctgggcatggtggtgcatgcctgtaatcccagctactcaggaggctgaggcaggagaattgcttgaacccgggaggcagaggttgtggtgagccgagatcgcgccattgcactc

SEQ ID NO: 36635 - DNA, 601 bp, Human
gaagaggtcattgcactggagaatggccttcaagaagggagctggcggctgggtgtggtggctcatgcctgtaatcccagcactttgggaggccgaggtgggcggatcacctgaggtccagagtttcagaccagcctgaccaacatggagaaatcccgtttctactaaaaatacaaaattagctgggcatggtggtgcatgcctgtaatcccagctactcaggaggctgaggcaggagaattgcttgaacccgggaggcagaggttgtggtgagccgagatcgcgccattgcactccagcstgggcaataagagtgaaactccatctcaaaaaaaatagaaaaaataaaaagaagggagctggctgtttgggttaacattgtaaaagaataccaactgcctcatagtgcagtggtgaagggcatcgtatctgtagctggattgcctgatttcaaatcctggttctgccactgattagctctgtgactttgggcaaattaccccctgcgagctggtccagttttatcatctgtaaaaagaggacagttgtagtgtccatactatataactcataaggctgttacaagttaattcacttaagg

SEQ ID NO: 36636 - DNA, 601 bp, Human
aagggagctacttatcatcatttccctctgaagtccacaataggataggaattgcataatttatattcctttaagatataacagagagctcagccatatatgacaacatagcaggcaaaccacaaatttcaattacttcatgaccagtaatgaaaattcttagaagctcttggggctccaattctgttagttcattctttatagtctgtcttggtatgacaatagtatctagagaggatttagtagaataacctaagtttcgaaatccctctggatttctggactctgtctattctattcrttacccccgtctttctctcatgggagtcagaagtctgcaaagccctacagaaccctgaggaccaaaatgtgaaatctttccatgaatacctcttcttcaggaatagcttttcatcctaatccaagaggctctgtttgttaactatgtcagagtcctgggatgataactgtttttgctgctgatcttccgtatttcatgatattctcttggtatcagctttgtactgctgttgtttctgttttagtagtgtatatatttgccacaaatatcttttgggaacttccaaatcgttggaatttt

SEQ ID NO: 36637 - DNA, 601 bp, Human
ttggggctccaattctgttagttcattctttatagtctgtcttggtatgacaatagtatctagagaggatttagtagaataacctaagtttcgaaatccctctggatttctggactctgtctattctattcgttacccccgtctttctctcatgggagtcagaagtctgcaaagccctacagaaccctgaggaccaaaatgtgaaatctttccatgaatacctcttcttcaggaatagcttttcatcctaatccaagaggctctgtttgttaactatgtcagagtcctgggatgataactrtttttgctgctgatcttccgtatttcatgatattctcttggtatcagctttgtactgctgttgtttctgttttagtagtgtatatatttgccacaaatatcttttgggaacttccaaatcgttggaattttagctttaggactcttaatatatgtgactactatctccaaagttctttgattacagattaagatagccaaatttttaataggtgatgaataaacaggtaatgctttgatcagcaaaaacatagataatgtaaatgttttagataaaaataactgctgggtgtggtggctc

SEQ ID NO: 36638 - DNA, 601 bp, Human
atgtaaatgttttagataaaaataactgctgggtgtggtggctcacgcctgtaatcccagcactttgggaagccgaggcaggagaatggcttgagttcaggaggtctagaccagtctgagcaacatagcgagatcttgtctgtactaaaaatcacacagattagccaagtgtggtggcacatgcctatagtcccagctactcaggaggctgaggcaggaagatcacttaaccccaggagatggagcctgcagtgagctgtgattgggccactgcactccagcctgggtgacagagtgaaaycctgtctcaaagataaataaattaataaataaccttatttgaatgtgatatttcttattcatgtatatacacatccccaaaatgaatagaccaaacttttgatttggaaattactttttaaaaagttgtaaatgaaaaataatctgtttttatataccagacgtcactcattcaaagtgggcaacatttctccatatgtctgattattattgtgccctacatgccctacatgggcactccaataattagacattattattttctattctaatgtattatcttcagacagagactcagata

SEQ ID NO: 36639 - DNA, 601 bp, Human
cctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatakagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgca

SEQ ID NO: 36640 - DNA, 601 bp, Human
tccttaaaggcaaggactacatcttattcattttgttttctggacatggggtctggtgctccatgaatgtttgttgaattgcatttcctgcccctgaatagaagctaggtctctacatatgcttctatatctcaatttatttataggcctctttgagacctttaagtgatacactttacaaatagtcatatataataataatatctatttattatttgagtctttttcctcaaaactatgactaacagaaaattaaatctctccacaggtcttctagagtgcactaaagcagaagataacrtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacaga

SEQ ID NO: 36641 - DNA, 601 bp, Human
catcttattcattttgttttctggacatggggtctggtgctccatgaatgtttgttgaattgcatttcctgcccctgaatagaagctaggtctctacatatgcttctatatctcaatttatttataggcctctttgagacctttaagtgatacactttacaaatagtcatatataataataatatctatttattatttgagtctttttcctcaaaactatgactaacagaaaattaaatctctccacaggtcttctagagtgcactaaagcagaagataacgtaacatttttatcttaccrtgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggt

SEQ ID NO: 36642 - DNA, 601 bp, Human
gaaactgaattttgattatcttactcattattattctcttaaggaacaaagtaaggtgagaaagggttaaagtagataccagcaacgactacatttcctgcacaccaactttaactgtactcacttacaatcgggcattttggaaggttattgaaatgatcggcagtgagcaggttagacaatcaaaaaggatgttttgaaatggagtgtttgctcatacatgtggaagcagaattgtctagccacttaaacaaaaaaattctagggaaagtagtgggtattttaatctttgttttgtttgttttttttcttcaagatggagttttttgttcttgtcacctaggctggagtgtaatgatgcaatctcggctcactgcaccccccacctcctgggttcaagcgattctcctgcctcagcctcccaagtagctgggtttacaggtgctcacccccccccacccagctaatttttgtacttttagtaaagacggggtttcaccatgttggacaggctggccttgaactcctgacctcaggtgatccaccctcctcggcctcccaaagtgctgagattacaggcatgagccaccgtgcccagcct

SEQ ID NO: 36643 - DNA, 601 bp, Human
aattttgattatcttactcattattattctcttaaggaacaaagtaaggtgagaaagggttaaagtagataccagcaacgactacatttcctgcacaccaactttaactgtactcacttacaatcgggcattttggaaggttattgaaatgatcggcagtgagcaggttagacaatcaaaaaggatgttttgaaatggagtgtttgctcatacatgtggaagcagaattgtctagccacttaaacaaaaaaattctagggaaagtagtgggtattttaatctttgttttgttttttttttytcttcaagatggagttttttgttcttgtcacctaggctggagtgtaatgatgcaatctcggctcactgcaccccccacctcctgggttcaagcgattctcctgcctcagcctcccaagtagctgggtttacaggtgctcacccccccccacccagctaatttttgtacttttagtaaagacggggtttcaccatgttggacaggctggccttgaactcctgacctcaggtgatccaccctcctcggcctcccaaagtgctgagattacaggcatgagccaccgtgcccagcctaatcttt

SEQ ID NO: 36644 - DNA, 601 bp, Human
ggttattgaaatgatcggcagtgagcaggttagacaatcaaaaaggatgttttgaaatggagtgtttgctcatacatgtggaagcagaattgtctagccacttaaacaaaaaaattctagggaaagtagtgggtattttaatctttgttttgttttttttttttcttcaagatggagttttttgttcttgtcacctaggctggagtgtaatgatgcaatctcggctcactgcaccccccacctcctgggttcaagcgattctcctgcctcagcctcccaagtagctgggtttacaggtgcycacccccccccacccagctaatttttgtacttttagtaaagacggggtttcaccatgttggacaggctggccttgaactcctgacctcaggtgatccaccctcctcggcctcccaaagtgctgagattacaggcatgagccaccgtgcccagcctaatctttggatttggataattttgtgtaacctttctacattgagaagactcaggacttgtggagggcttcacatgtgtgatgcagtgatgttttaaggtattgctggataccagtggtttaatatattttaacagaggcattttt

SEQ ID NO: 36645 - DNA, 601 bp, Human
ttgaaatgatcggcagtgagcaggttagacaatcaaaaaggatgttttgaaatggagtgtttgctcatacatgtggaagcagaattgtctagccacttaaacaaaaaaattctagggaaagtagtgggtattttaatctttgttttgttttttttttttcttcaagatggagttttttgttcttgtcacctaggctggagtgtaatgatgcaatctcggctcactgcaccccccacctcctgggttcaagcgattctcctgcctcagcctcccaagtagctgggtttacaggtgctcacccccccccacccagctaatttttgtacttttagtaaagacggggtttcaccatgttggacaggctggccttgaactcctgacctcaggtgatccaccctcctcggcctcccaaagtgctgagattacaggcatgagccaccgtgcccagcctaatctttggatttggataattttgtgtaacctttctacattgagaagactcaggacttgtggagggcttcacatgtgtgatgcagtgatgttttaaggtattgctggataccagtggtttaatatattttaacagaggcatttttccttt

SEQ ID NO: 36646 - DNA, 601 bp, Human
tgataataaattgacttttggaagaaacaataaactctgagggacaaaacgttcatttcaaaagatgaatttagactactgggacattctgcacattctgtgaacctggtataagcttctttttctatagctacagccacggaaatgctttctttcctcaggaaaaaaggagcaacagtttgggtttcatctcattctgcactctttttttccgagtggcaagctatttccaagtgttttaaactataagtgtacccaccattgtaccctattgactttaaaaatctgcccatgatttttwtttttttttttagatggagtttccctctgtctcccaggctggagtgcagtggcgcgatttcggctcactgtgacctctgcctcccgggttcaagtgattctcctgcctcagcctccaagtagctgaggttacactgcatgcgccgccatgcccagctaatttttgtgtttttagtagagacggggttttgccgtgttggccaggctggtttcgaactcctgacctcaagagatccacccgccttggcctcccaaagcgctgggattttaggtgtgagccactgcgcccggccccgcccat

SEQ ID NO: 36647 - DNA, 601 bp, Human
atgcaacctagacataacctgatgctgtgcttttaaaacatttattatttattattagtttttcatttttatacatttacagggtgcaagtgcagttttgttacatggacatattgagtagtggtgaattctgggcttctagtgtacccatcacccgaaaaatgtatattttacccaacaggtcatttcttatccctcactctcctcccacccttgcaccttttggagtctccaatgtctattattgcactctgtatggccatatttacccatcgtttagctcctacttatcagtaaaaaygtgatattttactttctgtttctgagttatttcacttaaggtaatggcctcctgttccatctgtgagatgtgcttttaaaaattaacaacaggagtttccttgcctatagatttaaagatatttatccttgttattaattcatgctgtctccggtaaggcacaaaggcagctcattagtaatgctccagctccccacagtgggcacgttgcttacatgcactttgataagcgtcagggactgacaccgaagtgttgagtgaatcccctgagtagccctaccctctacttctgaaaccttg

SEQ ID NO: 36648 - DNA, 601 bp, Human
gcagactcagcagagtctgcagtcttggtactgcagggatggctcctcctctgtccctgttcatcgtgccattgacaattttcaaaatcctttcatttatactatctcatttgagcctctcaaaacctcctctccttcctttcatgtcagctatgacctgttcaacagatattataatcatagggaatgaaaatggatgttaacctgaaagggaaattagtttaaaccaaaatctctttccttgttgaaagtcacaagacaattgcccagaaaaaaaaaaaaaaactttaaaaactgataytgtaaaacctttttttgagtgttagacaataaaagtgtcagataaagagacttatctctcaagtattaatattaagtgcccaatggcaaaatagcatttacagttctgcttttattttccaccaaatcacctaataacattttctagcgtttaattggtagaaattcacccttggagtaaaaggtgaatgcttagtatcctaaagagtggggtgagggaatgtgttgtaatttaataaactaggaaaccaactacatacattcaaatcttaatttgctccagaaaacggcctagatccct

SEQ ID NO: 36649 - DNA, 601 bp, Human
gcagagtctgcagtcttggtactgcagggatggctcctcctctgtccctgttcatcgtgccattgacaattttcaaaatcctttcatttatactatctcatttgagcctctcaaaacctcctctccttcctttcatgtcagctatgacctgttcaacagatattataatcatagggaatgaaaatggatgttaacctgaaagggaaattagtttaaaccaaaatctctttccttgttgaaagtcacaagacaattgcccagaaaaaaaaaaaaaaactttaaaaactgatattgtaaaacstttttttgagtgttagacaataaaagtgtcagataaagagacttatctctcaagtattaatattaagtgcccaatggcaaaatagcatttacagttctgcttttattttccaccaaatcacctaataacattttctagcgtttaattggtagaaattcacccttggagtaaaaggtgaatgcttagtatcctaaagagtggggtgagggaatgtgttgtaatttaataaactaggaaaccaactacatacattcaaatcttaatttgctccagaaaacggcctagatccctgttaatctt

SEQ ID NO: 36650 - DNA, 601 bp, Human
ctctcaagtattaatattaagtgcccaatggcaaaatagcatttacagttctgcttttattttccaccaaatcacctaataacattttctagcgtttaattggtagaaattcacccttggagtaaaaggtgaatgcttagtatcctaaagagtggggtgagggaatgtgttgtaatttaataaactaggaaaccaactacatacattcaaatcttaatttgctccagaaaacggcctagatccctgttaatctttaaacattaaaacaataaccctttaagattataaaatcaaaattctstctgctaaaaccttacctttgtctgtcttaaccatattgcagaaaattccagcgactttaccatgactggatgagtcataaataaaacccattaggtcaggtacttagaaattaaacacacataatttcagggacaaatataaaagctggaccaaatcagagcctgcaagcccttaacgttgcttctttgcctggccttggaattgaaatgactatggggatgaagtgtcactggggcatgttgcaaaatggaaaaggaacctggttaacaggatcgcatttggagaaggaaaacttttg

SEQ ID NO: 36651 - DNA, 601 bp, Human
ttaaaataagatttatggcggggcacggtggctcatgcctgtaattcctgcattttgggaggtgggatcacttcaggccaggagttcgagaccagcctgactgacatgaagaaagccagtctctactagaaatataaaaattaggcgagtgtgatgacacatgcctgtaatcccagctgctcgggaggctgaggcaggagaatcacttgaagctgggaggcagaggttgcagtgagccaagatgacaccactgcactcgagcctggttcaaagagtgagactccatctcaaaaaaaaaaaraaaagaaaaaaaaaagatttatatggctcttcaaatttctctcagctgagatttttttttactccaggaaagattcctagttttccccaatccacattaatcacaatctcttccatatttccagatgcggtttgtttatatttctataatgtaatgcattttaccttgaatactggcacccttgacactttttgctaaattgaatttttttgcaagtccatgatgatctgatattattctcagaatttcacagtctcaatttgttgctactgagatagtgttcatgaaactgtttatgcc

SEQ ID NO: 36652 - DNA, 601 bp, Human
atgaaactgtttatgcctatgcccacatatgagaattaggtagaaactgagaggattaattcctgactttccaggtgtgatatttccaccccagtcccttggtggctcgtcagaagagcttcatcaggaaggtgggtgcacacaggtggcctctgtttagaacacgtaataggaaccatatacacaaaagttacttagccatataggttttcatgtgtttgaattgtattagaagtacaggacccaggacagttgatggaaattaacaggaaaatccagaaggctataatacttggtagartggtggcataagatgatttgacaataaatgatggactatgattcaggctctaacacaaccaaggaaggccccacatacctgaatggtagctgagggcagcagttctggtacattcctaatttgggtttgttccttttccttttatacccattaacttgggagctagaaggaagaaaaaaagaatgtaaattgcagaaaggcaaggtctcatgtgctgattctgggggctatttgcaagttcagttgcttagcctgattataacatagtatccatctcctgcccctcagacctctcccctt

SEQ ID NO: 36653 - DNA, 601 bp, Human
tgagcagcaagtgcttctggcgacttagggtgatgtgaaatcacgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcattgctcttagagttttcccagcctttttcaaataggggcaggactggggcaggccatctcac

SEQ ID NO: 36654 - DNA, 601 bp, Human
cgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcaytgctcttagagttttcccagcctttttcaaataggggcaggactggggcaggccatctcacaaggggtccctgatgctgagggggacaagtgaacctcccagtctagagctccagccaagtctatccaaggtgggaacgggggccaggatccctgctcagagctccgccattgtcccccatcacagtgaatggatgtaagctcacccactctgtgcccctacctccctgctactctttggggataataataaaacaaaaaccattaccatcagtcagtctgtccacccactggcatgtac

SEQ ID NO: 36655 - DNA, 601 bp, Human
ctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcattgctcttagagttttcccagcctttttcaaataggggcaggactggggcaggccatctcacaaggggtccctgatgctgagggggayaagtgaacctcccagtctagagctccagccaagtctatccaaggtgggaacgggggccaggatccctgctcagagctccgccattgtcccccatcacagtgaatggatgtaagctcacccactctgtgcccctacctccctgctactctttggggataataataaaacaaaaaccattaccatcagtcagtctgtccacccactggcatgtaccaagccagacactctgccgtgttctgggcttaacaacagaggatgagagtggtcctttctctcagtctaataaagcacttcccacga

SEQ ID NO: 36656 - DNA, 601 bp, Human
gacccgttgtccagctctgagcaggagggaggaagggaggggctgccattgcagctgggaaattgtgaccagcacctcattgctcttagagttttcccagcctttttcaaataggggcaggactggggcaggccatctcacaaggggtccctgatgctgagggggacaagtgaacctcccagtctagagctccagccaagtctatccaaggtgggaacgggggccaggatccctgctcagagctccgccattgtcccccatcacagtgaatggatgtaagctcacccactctgtgcccctrcctccctgctactctttggggataataataaaacaaaaaccattaccatcagtcagtctgtccacccactggcatgtaccaagccagacactctgccgtgttctgggcttaacaacagaggatgagagtggtcctttctctcagtctaataaagcacttcccacgatgtgttctatgggactcgattagaggagtcccacagaggcatccaggagatgctttacacagtggagctctctgatcaagtaaatgcagggaattctgctttctacatcctctcataagagaaccacagcccag

SEQ ID NO: 36657 - DNA, 601 bp, Human
taggggcaggactggggcaggccatctcacaaggggtccctgatgctgagggggacaagtgaacctcccagtctagagctccagccaagtctatccaaggtgggaacgggggccaggatccctgctcagagctccgccattgtcccccatcacagtgaatggatgtaagctcacccactctgtgcccctacctccctgctactctttggggataataataaaacaaaaaccattaccatcagtcagtctgtccacccactggcatgtaccaagccagacactctgccgtgttctgggcttwacaacagaggatgagagtggtcctttctctcagtctaataaagcacttcccacgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactgaggttttctgaagtaaggcaacttgttgaatcgtatttagctatgcatcgacccaatttttacactgcatccttttcccccatataactttt

SEQ ID NO: 36658 - DNA, 601 bp, Human
gacaagtgaacctcccagtctagagctccagccaagtctatccaaggtgggaacgggggccaggatccctgctcagagctccgccattgtcccccatcacagtgaatggatgtaagctcacccactctgtgcccctacctccctgctactctttggggataataataaaacaaaaaccattaccatcagtcagtctgtccacccactggcatgtaccaagccagacactctgccgtgttctgggcttaacaacagaggatgagagtggtcctttctctcagtctaataaagcacttcccaygatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactgaggttttctgaagtaaggcaacttgttgaatcgtatttagctatgcatcgacccaatttttacactgcatccttttcccccatataacttttggagaaacccactttaggatacatcttccacctcataggatgccaggaaatca

SEQ ID NO: 36659 - DNA, 601 bp, Human
agtcagtctgtccacccactggcatgtaccaagccagacactctgccgtgttctgggcttaacaacagaggatgagagtggtcctttctctcagtctaataaagcacttcccacgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactgaggttttctgaagtaaggcaacttgttgaatygtatttagctatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaat

SEQ ID NO: 36660 - DNA, 601 bp, Human
tccacccactggcatgtaccaagccagacactctgccgtgttctgggcttaacaacagaggatgagagtggtcctttctctcagtctaataaagcacttcccacgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactgaggttttctgaagtaaggcaacttgttgaatcgtatttagcyatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctc

SEQ ID NO: 36661 - DNA, 601 bp, Human
aaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcakagatggggcaagaacctagggctctgactcaccgtgcagcttctcttccaacaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctga

SEQ ID NO: 36662 - DNA, 601 bp, Human
tgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcatagatggggcaagaacctagggctctgactcaccgtgcagcttctcttccarcaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataac

SEQ ID NO: 36663 - DNA, 601 bp, Human
acaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattrgggcagcacaaaccaggctctaagcaaaggcaaataaaatactacacctctcagcaaagtgaagacacacgctctggggccacctgaagcttctgtgcagaagtgggaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcactta

SEQ ID NO: 36664 - DNA, 601 bp, Human
gaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagaygcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgt

SEQ ID NO: 36665 - DNA, 601 bp, Human
ccaaattaagcaattgtaaagtcacatacctgttaagttggagatccaccattccatccaagccattctggctcccaggttcatatacacaaacactatgataaagtgcctctcagaaaagctatgtaaatgttagcatacttcccttccccaatctttgtcaaaatagtcaccttgagaggcagggcccttgttgcttagaaataatcttggaaatctcttttgtagtttcctttggacttatggcactgtatttccagtgttcttcatggtcattatatctttgtcctttaaggatagwttcattttttaaaaaatatccaaaaccattcataatcatgactaaagtagatgcacaacctaggtgatgtgttataactacaaaatatcatgagagactttgatatagttattcactggctttgtaggtaattccagaacgggatcttaagcacgcatatgaacaatgtcagcctcttaagtaaagtatacaatctcataaagtaagtctttggaaagttctagttaatcactgtggccacacagcatatttgtccagagaactaatttatgcccactgtcaaagatcttcttcctttag

SEQ ID NO: 36666 - DNA, 601 bp, Human
aacttgctcatgctcacaaacctagtgattaaagtccaaggcaaaaaaattctagtattatttgaactatgaatattttaggatattcctatagataattctaaatgcagtgagaagtttagaatcaatgagccaatgtatagtgtaatatttttaaatttcacattgacttagaaagacactacccatatgtagtctgccatttatcacaccctgctagggtggttttcaaactttagattcattagaatcatctggaaagcttacacacacacacacacacacacacacacacacacacacacaaacaaaaaaaaaaaaaacaaaacaaaaaacagattgttgagccctactcccaaatcatcagactctgtagttttgggttagaacctgaaattttgctaataaattcccaggtgatgctgatattgctgtttggaagaccacattttgagaaccactgcctagtacattcagcaatgtcaaaatcaaagatttttatttaagtagaataatgaaaaagcaagaaataactacttgctagaacctgagaatgatctcttaggttatctactgttaaaaacaaaattacccagctcct

SEQ ID NO: 36667 - DNA, 601 bp, Human
cttgctcatgctcacaaacctagtgattaaagtccaaggcaaaaaaattctagtattatttgaactatgaatattttaggatattcctatagataattctaaatgcagtgagaagtttagaatcaatgagccaatgtatagtgtaatatttttaaatttcacattgacttagaaagacactacccatatgtagtctgccatttatcacaccctgctagggtggttttcaaactttagattcattagaatcatctggaaagcttacacacacacacacacacacacacacacacacacacacacaaacaaaaaaaaaaaaaacaaaacaaaaaacagattgttgagccctactcccaaatcatcagactctgtagttttgggttagaacctgaaattttgctaataaattcccaggtgatgctgatattgctgtttggaagaccacattttgagaaccactgcctagtacattcagcaatgtcaaaatcaaagatttttatttaagtagaataatgaaaaagcaagaaataactacttgctagaacctgagaatgatctcttaggttatctactgttaaaaacaaaattacccagctcctaa

SEQ ID NO: 36668 - DNA, 601 bp, Human
catgctcacaaacctagtgattaaagtccaaggcaaaaaaattctagtattatttgaactatgaatattttaggatattcctatagataattctaaatgcagtgagaagtttagaatcaatgagccaatgtatagtgtaatatttttaaatttcacattgacttagaaagacactacccatatgtagtctgccatttatcacaccctgctagggtggttttcaaactttagattcattagaatcatctggaaagcttacacacacacacacacacacacacacacacacacacacacaaacaaaaaaaaaaaaaacaaaacaaaaaacagattgttgagccctactcccaaatcatcagactctgtagttttgggttagaacctgaaattttgctaataaattcccaggtgatgctgatattgctgtttggaagaccacattttgagaaccactgcctagtacattcagcaatgtcaaaatcaaagatttttatttaagtagaataatgaaaaagcaagaaataactacttgctagaacctgagaatgatctcttaggttatctactgttaaaaacaaaattacccagctcctaattccac

SEQ ID NO: 36669 - DNA, 601 bp, Human
tttcaatagttgcatttgaaaagctggcttacttttaaaaatatgtaggctgacaataggattatacaagggttcattcactgttttaaggaaacgatttataaatgttaatgggatgtttattttttctcctatagaaagctagactggccaggatccgggcagccaaaagcggaagcgcaaatgcttacatgcagagcaaacggaatggtttactcagtaatcagctgcaggtacaatcaattacatctctttttttaatgttcaatttcttggtttaatattgatttagttctacttycctataattttattatggctaattatgacaatggctatccaaacaacaaaagtgtgtttgtttgtgtttttttaataacttcaccctgtacatccttgttggctgtagaaggttagaaacttcactatgaaatactgccagtgaatcatgatgcctattcatcattgggcaatatttctacactgtctcttattaacatggtaaaggtaaaaaaaaatgcttaataattcaaatgcctaattctttttcatttcaaatttatcttccttaacgttcatttgggtcaggggttggggtggg

SEQ ID NO: 36670 - DNA, 601 bp, Human
ttcttggtttaatattgatttagttctactttcctataattttattatggctaattatgacaatggctatccaaacaacaaaagtgtgtttgtttgtgtttttttaataacttcaccctgtacatccttgttggctgtagaaggttagaaacttcactatgaaatactgccagtgaatcatgatgcctattcatcattgggcaatatttctacactgtctcttattaacatggtaaaggtaaaaaaaaatgcttaataattcaaatgcctaattctttttcatttcaaatttatcttccttaacgttcatttgggtcaggggttggggtgggtggctaacatgatgtcttgttttacttcataacgaagagggaatactattcagtgttaggaagatcatatggcataaactacaatttgagaaaatttatttttactccagaattttcctttaatatttaggactccaatctttacttacaaaatagcttttatttacgtgcacatgatcgtggtttcaaaattttctaagcactatgctaaatttgatcatcaaaacataacagattcccatcttacaaacatagttgctagttgaatg

SEQ ID NO: 36671 - DNA, 601 bp, Human
acttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaaygtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctc

SEQ ID NO: 36672 - DNA, 601 bp, Human
tttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttcwagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaacc

SEQ ID NO: 36673 - DNA, 601 bp, Human
caagttccacggatgaagcagacactgcaataacaactgaatcaatagaggagaggcatttggaagtactggggtgatacacccagtaatggtaatcctcagcagaagatggcatagctaccaaaaatcaggcgttaccactgggatgaaaactggggaggcaagaaaatcatacggttggagtcatagatcatttccctccccgttgagcactcctcccccttccgtcccccattaagttcattctatcccacagactggtcctagtgtcctgctagctccctgctgaaagagagagggwgggaaaagatgtctgaggtctcttcatttcctttgtctctgtccctaaggcaactggaagctggagctgctgcagtcggcctggcaagcccgttggctctgcagagtgagcagtccctggcagcccctggagcagctgccagttagacggcccagagttctgatagaatgcattgcttcagttcagtgccaagtgttggacgtgttggattcagttcccagagggctggagcgtgctgtcagggctgtctgaagacaagagagcagaggcagtttagtgcagttggatgtgcggggtagg

SEQ ID NO: 36674 - DNA, 601 bp, Human
tccatatggtactgggtcttaaggctggaatctctgagagaagagtcttgcgttattgtttaaacaacctttattacctgcctctgacattccccagggttacagagcagggggcatctgagcctcaagttccacggatgaagcagacactgcaataacaactgaatcaatagaggagaggcatttggaagtactggggtgatacacccagtaatggtaatcctcagcagaagatggcatagctaccaaaaatcaggcgttaccactgggatgaaaactggggaggcaagaaaatcatacrgttggagtcatagatcatttccctccccgttgagcactcctcccccttccgtcccccattaagttcattctatcccacagactggtcctagtgtcctgctagctccctgctgaaagagagagggagggaaaagatgtctgaggtctcttcatttcctttgtctctgtccctaaggcaactggaagctggagctgctgcagtcggcctggcaagcccgttggctctgcagagtgagcagtccctggcagcccctggagcagctgccagttagacggcccagagttctgatagaatgcattg

SEQ ID NO: 36675 - DNA, 601 bp, Human
gtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacayctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttgga

SEQ ID NO: 36676 - DNA, 601 bp, Human
gaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagaygtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaac

SEQ ID NO: 36677 - DNA, 601 bp, Human
gcacatgctccctttttcacggcgtgcccacatatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggctgtgtccactgtttaatggtgatgtttgtaattctgtgtgcctagcaaggtctgtaggatcaaactacaaactkctggtagtatgtgtagcactatgcaaatacaaggtagtaataatgctgttactgtcactgtccttgagacatatcttgtgaatttcaggggattaagacagatgactgaaaagttgataatctgttgaataaatctttaatttagagcttgctctgtgctatgtaatgaaaaaaagacaacgaagatatagggggtccttggtttagtctgagtattattttagtggagccacatcttaagtaagttcagctatagagatttagttaatagaaataagatggtggttgaaagagaagtct

SEQ ID NO: 36678 - DNA, 601 bp, Human
tgacatgaggatattttctttccattttacatagaagggttggtgaactctgtgctgatgcttgttgtattccagtgttgcattcatcaaaagacttcatctttaacccctcaaagtcagccagagggcatctctgcccagctttagcttctgcctgaggtctgtgagcttttgaagaaggaataggacaaggaggtggctggcttgcccagcatctgtagtatgtggccactgataggtgatgagtgccacaaactgctcttagccagaagcaacccatgtcctcactccaccccacctsctattgcttggatccctcagcttcagttgctgcctccattttatcagggcccggggcatgcccggaaaagcaggcacatgctccctttttcacggcgtgcccacatatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggc

SEQ ID NO: 36679 - DNA, 601 bp, Human
ctgtgttcaagtcccagatgagggttacggaaggcaagaaccacaactcttatgggggagagtgtgattggggtctgaggaggcttccttccctgagagggtgaccagaattagctgctttggatggtcggtgttgtagaacttcaacagtcgaggttgggagggattgtggtcttgaagaggcttataactctgttgcatgtccatcggtgctggggaacattgagaggctaagtttgcagaggctgaaggtcactaaccaggtgctttgttgatcctggaaggctgggatcaaatgctyatacccagctggttcaaccctgacatagaagtactgtgtttggcctgcacagagttttatttatttatttatttatttattaaatataaaggatttgtctccaggttgtcaaagtccttcccttacctgttaccacctctcttggctcatttacattatctggcccctcctgaaagtttttgcatttgcagccctttgtaaatatggaaaatggagccacgtgggcttgtcaggctgtgggaaaaacagtgtatctgcacacactaccttgtggtattcgtatccttgggagatctgcaa

SEQ ID NO: 36680 - DNA, 601 bp, Human
tttttatttttatttttttgacacggaatctcactctgtcgcccaggctggagtgcagtggcgcgatctttgctcactgcaagctccgcctcctgggttcacgccattctcctgcttcggcctccccagtagctgggactacaggcacccgccaccacgcctggctaagtttttgtatttttagtagagacgaggtttcaccgtgttagccaggatggtctcgatcttctggccttgtgatccatctgcctcagcctcctaaagtgctagcattacaggcgtgagccacagtgcccagccrtagctaacattttaaaagtgcttatgtcatgcacagtgtaagcacttaatttcactttcgcagcaaccctgtgaggttttacacataaggataataaggcttggagaggttaaataacttgagctaggatttgaacccaggtatacctgtctccagaacctagatcagtcagtccctgctgaatggggaattgaggaagaggttatttgatttatctaaggtatacagatgtttcttttccttgcacccacctttggaaactgtaagtactcaccagataatgactctgggcaaattgct

SEQ ID NO: 36681 - DNA, 601 bp, Human
cagttaacttctatctggacaagtcagcctctctgaacttactgcctcacgtgtgaagtggggctgacacttgctcacagcagttgagcagattatatgagctgaatgttaagtgcctggaatggtgtttgttgccaataccactgggataaatgtcagtggataaaagactgtgatgattatggttcttgttcatggtcttgatagagtagaataatgttctttaaaagttcacaggaaccagtttttttttttggcttgtgtgaaataatatgcgtaaatggtcataacaaaagtagcyaacattttatttatttatttatttatttttatttttatttttttgacacggaatctcactctgtcgcccaggctggagtgcagtggcgcgatctttgctcactgcaagctccgcctcctgggttcacgccattctcctgcttcggcctccccagtagctgggactacaggcacccgccaccacgcctggctaagtttttgtatttttagtagagacgaggtttcaccgtgttagccaggatggtctcgatcttctggccttgtgatccatctgcctcagcctcctaaagtgctagcatta

SEQ ID NO: 36682 - DNA, 601 bp, Human
gggagcagtgggcacctggcaacagccgagactgtgtgctcatgtctagcgtgaagtttgcctttgctctacgaagctggatttggtttgtagatgtgttaactaaatcttagctgttgtaaccaacatgaaacaacctgtttgtggatttggtcagagctgggttaaggtggatcatctctgtgcaccagaatgactgtacccctttcagatggtagtcctgttcaccgcagtggagaaaagacctcactgaaggacttattcccagcatgaaacatcatgacagaaattggtacttaaytctgctgccaggatagaaaccactcagtaggcaaatgtgggagcgttgtcttgcatgcgggggctctctagcattggttcccttcactgaacacctgtgcaaggcagatggtcacagcttctccatgttgtcttgtggattttttgtttgtttgggctggaattactccttttcaaaaacctgtgctctctttttcagctccccagaggcccatctcaacacagagaaccgctgcggctcctaaggctggccctggtgtggtgcgaaagaaccctggtgtgggcaacggagacgacgagg

SEQ ID NO: 36683 - DNA, 601 bp, Human
ggtttatccttttaagccatttttggggggataactttttttttttatggcaaaggtagtaacacccccaattatcttgctggtgtctggtttttatttattttgaaatcagggtttttttttaattttagttttgtctctacaatatataaaataggcatttatagtataagaatatcacttaactttccaggcatagtttaaatagagttcatatacagtaattttgcattcattattatggaattttattttttgaatatggaaaatgtctaaagtatataaaagtaataatagtgtrtaaacaataaatagtaaatagtgtaatgatccctcatgtaactcaatggttagcatggccaattttgttttatatctaattctatcctatcctatgtattctgggttattgaagtgagtacagaggtaatatttgtgaatgtttcagtatcaagcaaagtaacttttaaaaattatatttgtcagaggggtggatatattattggatatattctttttataatacattgcaactggaatctttggagattaaaagatagttaaaagccaggcatggtggctcatgcctgtagtcctagct

SEQ ID NO: 36684 - DNA, 601 bp, Human
gctcacacccgtaatcccagcactttggaggctgaggtggagaagattctagaaatacttgctttttatagaaggttacaaggaggctccgtggtgggtgctggaaaactcctttctgcccccaaaggtttttgaaggtaacagaaacatggtccaccaggcatggtttagcacaaacatttaatgtttagcacaaatattacctctgttttagtagataatagattaagtagtttatcccttcccccacccttgtgaagggtttatccttttaagccatttttggggggataactttttktttttatggcaaaggtagtaacacccccaattatcttgctggtgtctggtttttatttattttgaaatcagggtttttttttaattttagttttgtctctacaatatataaaataggcatttatagtataagaatatcacttaactttccaggcatagtttaaatagagttcatatacagtaattttgcattcattattatggaattttattttttgaatatggaaaatgtctaaagtatataaaagtaataatagtgtataaacaataaatagtaaatagtgtaatgatccctcatgta

SEQ ID NO: 36685 - DNA, 601 bp, Human
attttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagtagtctggaatctaactctcttaatctggatttacttctgtaaaagcatactgtatgtagaatagttccagtagagaagattctaggccaggcstggtggctcacacccgtaatcccagcactttggaggctgaggtggagaagattctagaaatacttgctttttatagaaggttacaaggaggctccgtggtgggtgctggaaaactcctttctgcccccaaaggtttttgaaggtaacagaaacatggtccaccaggcatggtttagcacaaacatttaatgtttagcacaaatattacctctgttttagtagataatagattaagtagtttatcccttcccccacccttgtgaagggtttatccttttaagccatttttggggggataac

SEQ ID NO: 36686 - DNA, 601 bp, Human
atcttttgaggctaattcacagttttatttgtcttctgaaagagcttctagatccagccccttctcagattgctcactgctgctgcagtggcctcctgactgaacactaagttccctctaagttcccagcccccaccttcccttttgttatattgcataagtctgcagcctttctgagggactggttttatcaagtcacatttctgatcaaggaagtatctcttcaaactttttttttttttttgaggcggagtctcgctctgttgcccaggctggagatctccgctcactgcaagctccrcctcccaggttctcaccattctccgcctcagcctcccaagtagctgggactacaggcgcccgccaccacacccggctaatttttttgtatttttagtagagacggggtttcaccgtgtttgccaggatggtctcgatctcctgacctcgtgatccgcctgcgtcggcctcccaaagtgctgggattacaggtgtgagccaccgcgcccagcctcttcaaacatttttgcctaagtcttcaagcacctccttgatttttcccttgctttacataaagcaaaccaaaacagaagataggaag

SEQ ID NO: 36687 - DNA, 601 bp, Human
ttccatctttcttccagtgtcccaggcctgagaagcatcttttgaggctaattcacagttttatttgtcttctgaaagagcttctagatccagccccttctcagattgctcactgctgctgcagtggcctcctgactgaacactaagttccctctaagttcccagcccccaccttcccttttgttatattgcataagtctgcagcctttctgagggactggttttatcaagtcacatttctgatcaaggaagtatctcttcaaactttttttttttttttgaggcggagtctcgctctgtygcccaggctggagatctccgctcactgcaagctccacctcccaggttctcaccattctccgcctcagcctcccaagtagctgggactacaggcgcccgccaccacacccggctaatttttttgtatttttagtagagacggggtttcaccgtgtttgccaggatggtctcgatctcctgacctcgtgatccgcctgcgtcggcctcccaaagtgctgggattacaggtgtgagccaccgcgcccagcctcttcaaacatttttgcctaagtcttcaagcacctccttgatttttcccttg

SEQ ID NO: 36688 - DNA, 601 bp, Human
acctgggaggtggaggttgcagtgagccgagatcatgccactgcactccagcctgggtgacagagcgaggctctgtctcaaaaaaaaaaaaaatttattgccgttgcttataggattttttcttttttttttttgagttcagcttctgcccttccttattttatagctgggtcctagtctcggtcttagtttcattgacttgtcttgttatttccttggtgaggtgtatttaatcttggttttacggatggtcagatggaggctacgtgtgaagctgtacagtaacacagtggtgcccaaragttgtgtttattcagcattaattactttgctgatcatagacaacaggctgttagccttagatctgtgctgtgtcccccccaccattttctattagtttcctcattattcatttccctatccccatttgtgtgaggcttttaaagcacttgtttgacctgtgttctgtgactaatgtgaggatgaggtcatcctagttttcactggagccagctttttaccagcaattccctctaaaatttacctttttctgtaaatatattccaaagtctatttcacttagttaattggaaaatgtgat

SEQ ID NO: 36689 - DNA, 601 bp, Human
attgcttggccgggtgtggtggctcgtgcctgtaatctcagcactttgggaggccgaggcgggtggatcatgaggtcaggagtttgagaccagcctggccaacatagtgaagccccgtctctgctaaaaatacaaaaaattagccaggcttggtggcacgcacctgtagtccagctacccgggaggctgaggcaggagaatcgcttgaacctgggaggtggaggttgcagtgagccgagatcatgccactgcactccagcctgggtgacagagcgaggctctgtctcaaaaaaaaaaaaaatttattgccgttgcttataggattttttcttttttttttttgagttcagcttctgcccttccttattttatagctgggtcctagtctcggtcttagtttcattgacttgtcttgttatttccttggtgaggtgtatttaatcttggttttacggatggtcagatggaggctacgtgtgaagctgtacagtaacacagtggtgcccaagagttgtgtttattcagcattaattactttgctgatcatagacaacaggctgttagccttagatctgtgctgtgtcccccccaccattttcta

SEQ ID NO: 36690 - DNA, 601 bp, Human
ggaggcctaggtgggtggatcacctgaggtcaggagttctagaccagcctggctaacatgctgaaatcctgtctctactaaaaatacaaaaattagccaggcatggtggcatgcgcctgtaatcccaggtacttgagaagctgaggcaggaaaatcacttgaacctgggaggcggaggttgcagtgagttgagatcgtgccattgcactccagtctgggcaccagagcaagactgtctcaaaaaaaaaaaaaaaagaaagaaacaaacaaacaaaaaaccattatctgaagaaaattgtaacattttgatatctttatgggtaactttgggctgatgttttctaaacagaaagcattctcgtttatgcatctgcctcccatcataaaagcacttactcatccctttatttagtgcctcttatagtttagaattgtatattaatcacattaaaatggggcctcaattttagtctggctggtgttgggcagttcatttcaggtcatgtttgtatgtggaaatccagattctgtggctggaatcttagtgtctctcgtttggcctcatggggaagaaggtgaggcttaaaaagtcaatgtacct

SEQ ID NO: 36691 - DNA, 601 bp, Human
tcttgtcctcacctgtaaaatgagggacatgaagtgaaccttgcagagggctgtcagggttaaacaacaagtgtctgtgaagtatctggcacttaggcccacagatgccctaccattgccaggtagctctgcagagaattaactacaaggattcttcacctgtaaggtcatttgatactgcctttttaatatctaggtattgaaaagctgatttactttttcaattatgaaagaatttatagttttttttttttttttggaaataggatctcactgcctcaacctcttggactcaggcgckcctcccacgtcagcctcccaaagtgctggtattacaggcatgtgccagtgtgcctggcctaggtatagtctttaaggaaaatttgggaagtagtgaaaactataaataggaattaataaaaacccatcgggccaggcgtggtggctcacgcctgtaatcccagcactttgggaggcctaggtgggtggatcacctgaggtcaggagttctagaccagcctggctaacatgctgaaatcctgtctctactaaaaatacaaaaattagccaggcatggtggcatgcgcctgtaatcccaggt

SEQ ID NO: 36692 - DNA, 601 bp, Human
gaggctggggctgggcaggcttgcctgccaaccccagggcctctcttgtcctcacctgtaaaatgagggacatgaagtgaaccttgcagagggctgtcagggttaaacaacaagtgtctgtgaagtatctggcacttaggcccacagatgccctaccattgccaggtagctctgcagagaattaactacaaggattcttcacctgtaaggtcatttgatactgcctttttaatatctaggtattgaaaagctgatttactttttcaattatgaaagaatttatagttttttttttttttttggaaataggatctcactgcctcaacctcttggactcaggcgctcctcccacgtcagcctcccaaagtgctggtattacaggcatgtgccagtgtgcctggcctaggtatagtctttaaggaaaatttgggaagtagtgaaaactataaataggaattaataaaaacccatcgggccaggcgtggtggctcacgcctgtaatcccagcactttgggaggcctaggtgggtggatcacctgaggtcaggagttctagaccagcctggctaacatgctgaaatcctgtctctactaaaaatac

SEQ ID NO: 36693 - DNA, 601 bp, Human
gatgagtcaagaggatggcttgagcctgggaagtcagggctgcagtgagccgtgattgtggcattgcactccagcctgggtgacagagtgacaccctgcctcaaaaaacaaacccgacagtggatttcttaatagaataaaatcctaactccttctgttcccacctcaggctctgctctccttgctcactgggctggagagccctatctctagagcttcatgtggttgcttctttctctgatccttaagctcaactgttcatctcagagaggcttcctctgaccacattccgtaaaccccrttgcataagtggttggtatgaaatgatgtttgttggtgtatttggtcagtgtcagactttgcaccactagaatgtgaactccctgtggacaggcaccttgtctcttgcttttctgtatcctggtccctagaacagtgcctagcacgcggtagagctagtaaacatttgtagaatgagtgacggttgactacactggtgctcatagacaataacgcccacatttactagcatttgaaaattagactcattgctgtgtgtttattgttttgaatttgaaagcctagcagaaaagggagggaa

SEQ ID NO: 36694 - DNA, 601 bp, Human
tctctacaaaaaattaaaaaattagctgggcttggtggtgaccatctgtagtcccagctacttgggaagatgagtcaagaggatggcttgagcctgggaagtcagggctgcagtgagccgtgattgtggcattgcactccagcctgggtgacagagtgacaccctgcctcaaaaaacaaacccgacagtggatttcttaatagaataaaatcctaactccttctgttcccacctcaggctctgctctccttgctcactgggctggagagccctatctctagagcttcatgtggttgcttcyttctctgatccttaagctcaactgttcatctcagagaggcttcctctgaccacattccgtaaaccccgttgcataagtggttggtatgaaatgatgtttgttggtgtatttggtcagtgtcagactttgcaccactagaatgtgaactccctgtggacaggcaccttgtctcttgcttttctgtatcctggtccctagaacagtgcctagcacgcggtagagctagtaaacatttgtagaatgagtgacggttgactacactggtgctcatagacaataacgcccacatttactagcatt

SEQ ID NO: 36695 - DNA, 601 bp, Human
gtggtcaggagacacacatggctttaccagctgcttagattttatagcagcatgatgcacacgatacagtatatataggaatgtcgccataatagattacaattgctcagctgggaccatgtcttttttgtttgaatgtctctggtacctgattttgcgcacagtattttgttcattcaaggattttaaacaagggaggcacttgctgtgatttgtgattcaggaaattctctctggtttgctgtgtaagaacagattgacacagacaaatttgaagactgttgcagtgcatctccgtgcragatggtgctggcaggtctcaggcgcactgtttttggcattggagataggaggatgagtgagacaaggtccctaccctacatcttgtttgttaaatacctcttaaatttgatgccatgccaaatattttatgtaccttatctaatttaaacccttctatgacccttttcagataggtggctttaacttgtaagggaactgaggtacattgagtttaagtaacttgcctaagatcacacaactaatgagtgactgcctcacattcaaacccatgtcctcctggcttgaaatcctcagctgt

SEQ ID NO: 36696 - DNA, 601 bp, Human
ttttgagctggggtgtggtcaggagacacacatggctttaccagctgcttagattttatagcagcatgatgcacacgatacagtatatataggaatgtcgccataatagattacaattgctcagctgggaccatgtcttttttgtttgaatgtctctggtacctgattttgcgcacagtattttgttcattcaaggattttaaacaagggaggcacttgctgtgatttgtgattcaggaaattctctctggtttgctgtgtaagaacagattgacacagacaaatttgaagactgttgcaktgcatctccgtgcgagatggtgctggcaggtctcaggcgcactgtttttggcattggagataggaggatgagtgagacaaggtccctaccctacatcttgtttgttaaatacctcttaaatttgatgccatgccaaatattttatgtaccttatctaatttaaacccttctatgacccttttcagataggtggctttaacttgtaagggaactgaggtacattgagtttaagtaacttgcctaagatcacacaactaatgagtgactgcctcacattcaaacccatgtcctcctggcttg

SEQ ID NO: 36697 - DNA, 601 bp, Human
tcaactataccaagatagaacagctttgttcaggtaggaggctgggaatatgggaagtggccctgctggaaggaaaggaaagaaaggtcggaaggcagagcagccacaacagggaatatacagtcatgcatggctgaatgactgatgtggccagagaaatgcatccttaggcgatgttgttgttgtgtgaacatcacagagtgtatttacacaaacctggatggtgtagcctactacacacctcggctatatggtatagcctactactcctaggctaaaaacatggacagcatgtttctgyactaaatactgcagacagttttaacacatggtaagtatttgcacatctaaacatacctaaacatagaaaaggtgataataaaataaaaacatggtattataatcctgtaggaccaccatcatatatgtggttcatcgttgaccaaaccatcgttatgcagcccatagctgtagcttgtgattagattaaggaggagagctggaggccctgaactagtcagactgtctggagctgaagtcaagaaatggaagcagggaaagagaagagcaggagaggcaccatgaaggactgcagggaaag

SEQ ID NO: 36698 - DNA, 601 bp, Human
ggtgtggtgctggttcataatacgcatcaataaatagtcattgcttttattcttggaaagctggggggattctggccatgtctatcctgaaagtaggactggtccctggcccagaacaaggagagagaagaggagacggggtttggggaagtgagagagagcagctcacagaaggagagcagcaagacccctcagccagccatccttctccacaggggcagcctactgccagttcatggacatgctcttccccggctgtgtgcacttgaggaaagtgaagttccaggccaaactagagcaygaatacatccacaacttcaaggtgctgcaagcagctttcaagaagatgggtgttgacaaagtaggtgcctgcgctctggggggccctgaggagcagtgtgaccctggggaagaagaggacccaccagcccaggcaactggggctgctggggtcattccggtgctcgtgcctccctccacctcccgactctccagagggaattttccccctgctcaaggcacaatggaaaagcccacaacacttgccatgccatcatgacaacattcctttcccttcctcctctctggaccctgcccaccc

SEQ ID NO: 36699 - DNA, 601 bp, Human
cagccccttcttgccccctgccccctggatggccaggggcaggagttgccaagctggatcacacctttccccactctaaaggcccaatagtcctaagtcctcaaaagatgagtctctagaaacgaggctttgtctgggtcctggaggggaagggagaaaagcaatagggcctttgggaagcagcagcgttgggaggggaagggagaggagcagccccagcccgcgtcggaccccgtcatagcagagccacctcctctgtctgcactgctgttctgcctgggcctgccccactcgcccgccygcttgctttgcactagaagcagcccgctctgtctagggaggtgcagtcgctagtgagcaagtcgccacggcatgctggctgcgctggggaggagctggggtccctgatttggccaccactgtgcagatacctggtccagcccagcagagggcaaaagagcccatcctgacacagggcccctggaggggcagccacccagggacaatggctttgggctggggcttctgttaggaaagaccctgtgccagctgcctttcctctagctatgagtacgagagggtcccgcacccttccaactct

SEQ ID NO: 36700 - DNA, 601 bp, Human
ccctaagaccagaagcgcgatagggccagaagggaccgtggagaacatttactgatgagagagaggtgaagtcactagcccagggtcacccattagcagggctcctggactcctgaccccttgctcttcagctacttacagaacctgagaagccctgcctggcctgcctggcccaccactttcctctctctcccaccctccaggaaggattcgcaccccctgaggacgatgagattgaagagcatcaacaagaagaccaggacgagtactgagggcggccgcagccctggctgactgcacrgcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtg

SEQ ID NO: 36701 - DNA, 601 bp, Human
ggtcccgtattcaaaaaacaggatccatcccttcgttttgaatctcaagtcattgaatacatattgtcaagaattctaagttaacatttctttaatggtttaaaggtaaaagaaatattttaactactgagtttgtgaaagtaagaatctgccttaaccacagtacaaactatcaaagttcatttttctggcagctttagcagaaatcttaaattctgttcatcatgagttttaaacaatatttagccatgcttcctggttaaacatttgggatcttacatttgggaaaaagacaacattmtattgtattgtcagtattagtattgtgatattaagattctctatttgcagtccttggctcacctgctgaaatgaaagctgaatttttggagcgagattaataatactaatttagatatactgggctatttaccttggtgcgccaccttttttttttaatgttttttttttctgtgaagttaaatacattattactttcaggatatgaagtcttgaaaggaaagttgggatcttatattatttggttttctttttttttcttacaatgcttgcatatgatgaatcttcaatataaactggt

SEQ ID NO: 36702 - DNA, 601 bp, Human
ttgggatcttatattatttggttttctttttttttcttacaatgcttgcatatgatgaatcttcaatataaactggttaaaagtcagttattgataattttctatctcctctgtgtatggccagagtattagtagacagacaaagccaagaattatttttgttctcaataaggttaagccagtttgagagttataaaactaaaagtgaaattacatgtggacaggtaatagatactgtatgcttactattttgatactgcattaggtttaccttgtgttggatttcttttaaaagaaaaamgttttaagattagctccatccataacatttttttttcttttctgttttaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaaggtaaataaatgacaatctctgaa

SEQ ID NO: 36703 - DNA, 601 bp, Human
aaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctargagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaattttgggctgaggattatctgtagcctattttaaaaaaaatcaagttttgagacattccagtaatatataaagcagaagagtgtggcttgggagat

SEQ ID NO: 36704 - DNA, 601 bp, Human
aatgaacacagttgattgtcttgaaaaggcgattcatttcattctaggggtgacagtcttcataaataggtgtctttggtttttctataactagggtacatactattattattcctttaaagaatatcttgttggagaaagcgaatccaggacagagctgactgtaggttagaacacacaaagcattctacatgcttacatagtttctggtgacacgacccagaactgatttcctggtagataaggtcacagatgggtaaatccaactaattgtgctgaggttactagagataactacccmttcctcccaccaaagccccgtggaaaggatggcaatggtggaaaacttgtactcactgcgtgtgtgtaacagttagcagcatgttcatagcaagttggcttgtagcggccattggctggagctcgatggttcatgaacctgtaaaaacaaaaagaacacatgtaagaaaaactcaaagtgtgtgaagaacaatgaggaaacccaccagtgggtatgtggtctattctacgcaaagaagtgactggtggaaatacccagttgcggtaataaagccaaagccactaaagaggagtaaactga

SEQ ID NO: 36705 - DNA, 601 bp, Human
tgttctaaaaaaattaatatgggggttttgtcaggtctccctttacttaagtttacacaagtgttccttaacctgtgacacactcagaagagacaagttaaggtttattcaggttcatccgagtaaatattattcctaaaggtaagctgtgtgtttcaatatctgaaccattgtattgtaccaacagtgactaccacagttaaactagcctgttccaaacactcattgttaaagaagcaaactggtcttttctctatttcttgttttcagactgtatcccagccactatttttccctcaaygtcactaaatgcaagggaataatgaaaccacaggtaaagtaaaaaatttataatgacataagaaatgccattaatgtcacattaacaggaaaactgaaaatacatacatattcacaaacacccccaacacagagacacacatatacacacacacatacacacaaacacacacacaaagaaatgcaccgaagtgttaacagtttatttctggttagttttgtttttcttatatatttttcagtatttttaaagtttcttataataagcatgttttgcttttacaaagcagaaaaaaattaa

SEQ ID NO: 36706 - DNA, 601 bp, Human
atggtggcaaacacctgtagtcccagctatttggcaggctgaggtgggaagactgcttgggcctgaaaggttgaggctacagtgagccatgattgtaccactgaactccaacctgggaggcagagtgagaccccatttcaaaaaacagccaagcatatactcagatttttcagggaggtcctcattttaaaatatctgtcctattgcaattgaaatctcaatatttcaggacaggataattgaacaaatcaagtaataggtattataatgtacatagcaacacacacatacaaaaagtcarttgttgaagttatataccctgattttcagtttggatctgtacattccaccaatttgagagctactgcagaatgtaagagttttggggtcacttcatttttaacagagccttttaagtaagcaagagcaaaccatttccaaggcccacctattcaaaaaatcttgagaattttagagagatttgctttctgcatcatatttcatagtccacatggtcacaaactttaatgtctagtcatatgtgtatgactatgactagtaaacatcttacaatgacagaagctcccaggagaataaacta

SEQ ID NO: 36707 - DNA, 601 bp, Human
agtatttctttaaattgctcatagtctgctctgaaacttccttttttgaaaagaagttttgccctttagggttgtgcagaatccatttcacaagcaaaccattcccacctaaatggtgtggtgctccaaaatcaatccttcactcagaggaggaaagcgtttacgttcttctcattggcaggccaagagctatagtattgttttgaaagtgcttgactattaatagcaaaatacgtgaactctgtttgaataatatacacaagacttaattctgaaagctaaactttgcaaaatggtaaaygcaaactataagtataccttcatacctcacacactcatagggtcttttgtaattttcaagttattttcaagtaccttatctcattcacctatcacactgactgtgtgactcaggtattattattctcattttagtgatacagatactgaggctccacaaggtcaagtgatttacccaaaattaaagagcagggctgggcctcaaagcctgcctgctgactccaagctcagtgtgctttgtcactaccccatagctgctgctctcatcatatccttagtgtgcttgatagtactggaaaat

SEQ ID NO: 36708 - DNA, 601 bp, Human
aagaagccagatgtggtggcaggcacctataatcccagctactcgagaggctgaggcaggagaatcgcttgaacctgggaggtggaggttgcatgagctgagaccacgggccactgccactgtactccagcctgggcaacatagtgagactctgtctcaaaacaaacaaacaaacaaacaaacaaaaatggccaagcatggtggctcatgcctgtaatctcaacactttgggaggcagaggcgggcagatcacttggggtcggagttcgataccaacctggtatcaacaacatggtgaaaycctatctccaccaaaaaatacaaaaattagctcggtgtggtggcacacgcctgtagtcccagctacttgggagaaagaggtgggagaatcacttgaatctgagaggtggaggttgcagtgagctgcatggccaacacagtgaaatcccgtctccccccaaaaatacaaaaattagctgggtgtggtggcacatgtctgtagtcccagctacttgggagaatgaggtgtgagaatcacttgaacccaggaggcagagattgtagtgagctgagatcacgccactgcattccagcctgggag

SEQ ID NO: 36709 - DNA, 601 bp, Human
aaaaaccaacaaacaaagaagccagatgtggtggcaggcacctataatcccagctactcgagaggctgaggcaggagaatcgcttgaacctgggaggtggaggttgcatgagctgagaccacgggccactgccactgtactccagcctgggcaacatagtgagactctgtctcaaaacaaacaaacaaacaaacaaacaaaaatggccaagcatggtggctcatgcctgtaatctcaacactttgggaggcagaggcgggcagatcacttggggtcggagttcgataccaacctggtatcracaacatggtgaaatcctatctccaccaaaaaatacaaaaattagctcggtgtggtggcacacgcctgtagtcccagctacttgggagaaagaggtgggagaatcacttgaatctgagaggtggaggttgcagtgagctgcatggccaacacagtgaaatcccgtctccccccaaaaatacaaaaattagctgggtgtggtggcacatgtctgtagtcccagctacttgggagaatgaggtgtgagaatcacttgaacccaggaggcagagattgtagtgagctgagatcacgccactgc

SEQ ID NO: 36710 - DNA, 601 bp, Human
ggttgcagtgagctgagatcacacctctgtaccccaggcttggtgacagagtgagactctgtctcaaaaaaccaacaaacaaagaagccagatgtggtggcaggcacctataatcccagctactcgagaggctgaggcaggagaatcgcttgaacctgggaggtggaggttgcatgagctgagaccacgggccactgccactgtactccagcctgggcaacatagtgagactctgtctcaaaacaaacaaacaaacaaacaaacaaaaatggccaagcatggtggctcatgcctgtaatcycaacactttgggaggcagaggcgggcagatcacttggggtcggagttcgataccaacctggtatcaacaacatggtgaaatcctatctccaccaaaaaatacaaaaattagctcggtgtggtggcacacgcctgtagtcccagctacttgggagaaagaggtgggagaatcacttgaatctgagaggtggaggttgcagtgagctgcatggccaacacagtgaaatcccgtctccccccaaaaatacaaaaattagctgggtgtggtggcacatgtctgtagtcccagctacttgggaga

SEQ ID NO: 36711 - DNA, 601 bp, Human
gtcacatttccaaatggaaaaagtacagcctacatatctaaaactacaggtaaacaaattgcctactatgatatttaactcctcagctcacatttaaattaattttattcatttacttattttaaattaaagaatttaaaataactaagtaaggaatcctgtttggaacaccctgtaggttcctactgaaataagcattgttctgggcatttaatgtccattcataaaagcctttcagtgttcttccaacatgaagccgacctataatttagtcagatgctgggcaaagatagcacttacwttttactccttcagataatcaggtttcttttgaatcattgatgctgcattagtcagaatctagaggcatactgtttctaatgactacaatagatgattgcaaaatataagcttctgagtttttaaaactggattatgtcttgtagaagaaagctaatgtttctttaattaagagtttcaaagcaacaaaagattatatttgatcagcaccaaaaaggcagaaagatcaaaggcaatgaacaggatactaggtattttaaatggttctcttactcagcaaaagaaatgataaacacacttg

SEQ ID NO: 36712 - DNA, 601 bp, Human
gtggtggctcacacctgtaatcccagcactttaggaagctgacatgggtggatcacctgaggtcaggggttggagaccagcctgactaacatggtgaaaccccatctctactaaaaatacaaaaaaattagctgggcatggtggcacgtgcctgtaatcccagctacttggaaggctgacgcaggagaatctcttgaacccaggaggcagaggttgcggtgagccaagatcgcgccattgcagtccagtccagcctgggcaacaagagcaaaactccgtctcaaagaaaaaaaaaaaaaaagaataaatgaggaagaaacaaatgttgtcctgattatctataactacaaaagtcacatttccaaatggaaaaagtacagcctacatatctaaaactacaggtaaacaaattgcctactatgatatttaactcctcagctcacatttaaattaattttattcatttacttattttaaattaaagaatttaaaataactaagtaaggaatcctgtttggaacaccctgtaggttcctactgaaataagcattgttctgggcatttaatgtccattcataaaagcctttcagtgttcttccaa

SEQ ID NO: 36713 - DNA, 601 bp, Human
acacggtgaaacccgtccctactaaaaatacaaaaaattagctgggcgtggcgagcgcctgtagtcccagctactcggggagatgaggcaggagaatggcgtgaacccgaatggcgtgaacccgggaggcggggcttgcagtgagccgagatcgcaccactgcactccatccagtctgggtgacagagcgagactcagtctcaaaaaaaaaaaaaaaaagaaaagaaaaaaaaaagaaaatgttttctgccaaaagtagttatcgtttaacccactccaccttgtaaaatatttcctcttytgatcctagagtgtctgctttcattaccattccaatccagagctagaagtgaaattctgaagatgaatggagatgcagcctggagcctagtttatcagcaaaaaggaacagcaagccctaaggaaaggacgtgtaattttgtttgtctctttattttgcacctgcacaaactgtaattttaaggctcatcacgttagactacaaaagatctaaaaaccctaagaaatacattgtattgaaattcaaattacatttcagcctaatcaaaccagacgataagctcctcaaaggcaggaacca

SEQ ID NO: 36714 - DNA, 601 bp, Human
aaagggatttgaaaaatacctctctgaacctattctggttctgattcaggaaagtaccataaagacagaaacatacctgaatttatagctttcccaaactgtacacggtacctagtgcaagcttacgagttgctggcacacttcattatttttattatttttttgagacagggtctcgctctgttcctcaggctgtagggcatgaacacagctcaccacagcctcaacctcctgggctcaagcaatcctcctgcctcagcctcccatgtagctgggaccacaggcacatgccaccatgccragctaaacacttcattatttataagttctttttcttttgagcctctatttaatggacataactttataaagaaaagctacatatcatatccataatcatgttaagttccagcagcttaaaagaaaataactaaaattctgaagccatgtcttaccattgatgtcaccaccaaggctggagagaatcccattgtgagatagaaaaagagttcaaccaccttatatctgcaggaacaaaaatgcagttaatttaacttataaatttctataacacctaacaatttacataccagcctttcct

SEQ ID NO: 36715 - DNA, 601 bp, Human
aggcgtgatggcttacgcatataatctcagcactttgggaggccgaggcaggtggatcacctgagctcaggagttcaagaacagactagccaacttggtgaaaccccatctctactaaaaatacaaaaaatcagccaagggttgcagcccgcatctgtaatctcagctacttaggaggctgaggtgggagaatcacttgaactcaggaggcggaggttgcagtgagccaagatcgctctactgcactccagctgggcaacagagcaagactttgtctcaaaaaaaagaaaaaaaaaaaaaaggttcttacaatgtgcctatgagattaggagtgaaatcctaagtacagttcttctgaacaatgtaggctcagaagggttcaaacgaaacaccttgggacctccttagttaatatagtgcctagagcctaagatactgcaatatataagctaaagggctggtaaccaggtggatggaaccatgaagtcgtaataatatattttcatttcaaaaagacagacacacacagacttctcaacagtaattcaatttgaaagggaattcaaatatatacatgcaactgcctattacaggtaatgtt

SEQ ID NO: 36716 - DNA, 601 bp, Human
ggtaattattaaagccatcataaacctcgtatctcaaagaaatatattttgttatattctcatgaagacatcccctgaaaaaacagaaccagatttgaaacttttaaaccttttataggtgtttctgtgaccaggaaaaaaactatcacagaattatgttcttacagccaggcgtgatggcttacgcatataatctcagcactttgggaggccgaggcaggtggatcacctgagctcaggagttcaagaacagactagccaacttggtgaaaccccatctctactaaaaatacaaaaaatyagccaagggttgcagcccgcatctgtaatctcagctacttaggaggctgaggtgggagaatcacttgaactcaggaggcggaggttgcagtgagccaagatcgctctactgcactccagctgggcaacagagcaagactttgtctcaaaaaaaagaaaaaaaaaaaaaaggttcttacaatgtgcctatgagattaggagtgaaatcctaagtacagttcttctgaacaatgtaggctcagaagggttcaaacgaaacaccttgggacctccttagttaatatagtgcctagagcctaag

SEQ ID NO: 36717 - DNA, 601 bp, Human
tttgcttgaaattctactctattaagctgcacaaaccttgcttatattgcttggggtgtcctgaaatgccttctaactatatggccttcaaggctgattttctcatttctgtcctttaactcctcctccttaccattccctgttgcttttaccatctatatgtattttgggtgctaggtaattattaaagccatcataaacctcgtatctcaaagaaatatattttgttatattctcatgaagacatcccctgaaaaaacagaaccagatttgaaacttttaaaccttttataggtgtttytgtgaccaggaaaaaaactatcacagaattatgttcttacagccaggcgtgatggcttacgcatataatctcagcactttgggaggccgaggcaggtggatcacctgagctcaggagttcaagaacagactagccaacttggtgaaaccccatctctactaaaaatacaaaaaatcagccaagggttgcagcccgcatctgtaatctcagctacttaggaggctgaggtgggagaatcacttgaactcaggaggcggaggttgcagtgagccaagatcgctctactgcactccagctggg

SEQ ID NO: 36718 - DNA, 601 bp, Human
cttttgaggtcctttgtgatctggactcttgtctagctctccagctttattacaagacttgtgctacctgcatacctgcccccaccatgcatatgtacataactcaagctggtacatgtattttatgttacaaacaatgagctattttcatttctccaaagatgctggtgcttcccccttctctgggcttccttcatgctgtattctctacctgtaacacttgcctcacccctaccatctctcagcttctacatgtttttccaaatcagctgaaatatcacttcctctggtacttctgtcrtgttcgcatagcagcctgaactttcccccatcaaatattttatcaaatttcatgatctctttttctttaataggaactgcatttgcctgcttgactctaagttctatgaaggcagtgtgggggatcatcctgcttgattatcacaaacattagtcacctgctattgtaccacttatggaaatgtcaatttcaaatttaggctagtaaaattactggataaacctgctcttatgatacccagagggaatttgcttgaaattctactctattaagctgcacaaaccttgcttatattgcttg

SEQ ID NO: 36719 - DNA, 601 bp, Human
tagagacagcatcttgctccgttgcccaggctggagtgcagtggcacgatcttggctcactgtaacctctgcctcccgtgttccagtgattctcctgcctcagcctcccaagtagctgggactacaggtgcccaccaccacgcccagctaatttttgtatttttagtagagacgggttttgccatgtcggctaggctggtctcgaactcctgacctcaagtgatctgcctgccttggcctccctggttaaatttttgacattaatattactaaactgtgctaacttcaacttgaagttgayagggtttttttgttttttcctttccgcattttatttatttatttattttattttatttatttttgagatggagtctcatgttgttgcctaggctggagtgcagtggcccgacctcagctcactacaacctcctacaacctccacctcttgggttcaggcgattttcctgcctcagcctcagcctctcgagtagctgggattacaggagttctgccatcacattcagctaatttttgtatttttagtagagacagggtttcaccatgttggccaggctggtcttgaactcctgacttcaca

SEQ ID NO: 36720 - DNA, 601 bp, Human
tatctccattatacagatgagaaaacttttttatccagtctgacaatctctgccttttagttggagtgttcagtccattgtgatgtaattgttattatatatgaggtacctaattactgatatggttgtattgaagcctcccgtcttgctctctgttttctatttggtttcatccatcctttgtttccgttttccaattttcccacctgctttagactaaattgaataactttgggattccattttatcttttctcttgactacttaactataacatttattttgcttttgttgttgttgktggtggtggtggttattcttttttttttctgagatggagtcttgttctgttgcccaggctggagtgcagtgcatgatctcagctcactgcaaactccgcctcccaggttcaagtggattctcctgcctcagcctcccaagtagatgggattacaggcgtgtgccaccacacctggctaatttttgtatttttagtagagatggggtttcatcatgtcggtcaggctggtctcgaactcctgacctcgtgatccacccacctcggcctcccaaagtgctgggattacaggcgtgagccacc

SEQ ID NO: 36721 - DNA, 601 bp, Human
tttcctagccttctagatgtctccaggcctttttgtattcgagcctggccattgcttagcttagcaataagttaatattcttgtgtgtcttagggcagaagggagaattttttaggctgttcttggttttcaaagaccaaggcccatctacaagattaaaatggcttgtatgaatgaggagagagaatagaggcaatgcttagaagctgatgaagaaacaagttagtcccctggatttctgaggactaggaatagaaaggagacaggttctgcagagtgaatggaaacctaaggcagatcmcggcagggccttggaaggggataggtgtgtgggtgtcctagaggcctgggcactgggcagcagccttgtgtgccccgcaagagtaaagggaagctctaactcaggcacctgattagaatgggccccaaggccctcggctaaaagcaaggcaacaatagaccatcatgagctaaggaccaggtgtgaggatctagggccagctgtgagcttcagtcctttttcaaagttcacagaagcccccatgttttgtgtgggatcaaaagatggggaaggagccaatccaaatggactgacattgga

SEQ ID NO: 36722 - DNA, 601 bp, Human
ccagcagatggccatcacaacaatactgtcataatacagaaaaaacatttatccactgtggaaagagaccctgaagagaatgtggcaaaggcatagagaaaaagttggatcttttgaaaaagttaatgatatcaaaatacttttccatcactggtaaaccaagctaggtcaagtatatgtcccaaagcagcactgaattcagagtaagaggttggcagaaaagtttggaaaactgcagtttttaaaaattggcaatttctccatgcttaataaaactatcagaagaggtataatgtttgtkcgtttgtggaatgttgactgcttgctgcaaaaatttacaacatgaatgaggacctgcagagatgcatatcaatgaaatatttttttaaaaatttacaaaaaactaaagtttctatttaaaaaagaaccatgttatgccaagatgaaacatggtaaaaagtagtgtaagttctgtccatgattctttacctagtgaatgggaaagtaatagaaacaattttcttcttaaaaaggaaggtttgttattgcactgacttttacaacctgacatagtaatttagaaaaatcatgtagtaaaatc

SEQ ID NO: 36723 - DNA, 601 bp, Human
ttatcatcaaaccaagaattccactgatcatttgatcagcccattactaggaaacaggcaatatcagcacccgatctaaaggcaagcctatttcatttattaaaacaccaacaagagagattaatcaacaaagcaactattaacaacatgttaatcttaatataagacactgagagaaaagtaaaaataatacataaatatcactccactgagccaggatataactcatggactacagatacatgagtttctacctgtcaaacaatgctttaaatattttttctaggaaaaaaaaaaaaaacacaatatatgagaagatgcaaaggaaaggcagaaatgtgaatttatgcatctagttccacaatttaaaataaatatcaaactgacaatataaagctaagtgacaatgacttaaccattgggcaccaaacaggcaatacaactgctcactgtaatacataatgctcttcaggagtttccagcagatggccatcacaacaatactgtcataatacagaaaaaacatttatccactgtggaaagagaccctgaagagaatgtggcaaaggcatagagaaaaagttggatcttttgaaaaagt

SEQ ID NO: 36724 - DNA, 601 bp, Human
cattaggtcctgactagtgtattttaaactgaaaatgtctgttgattaatgtttgagctgactctggcatttcaattattaaaaagtagactagaaagttctaagtgacagggtgtattcatttttcttcacagtcatctaatttagagacagtggaacaaatccaagtaacaactttattgtagtatacagcacaatttttacatacatattagtggttttgacagtgttacttttgagtagaccttaaatgaatccacaaagttaatatattaaaaataaaatatacacagtaaaacarcaggcatccagatgttcagaatcatgcagataggagtggtttggttggtgttatcactgggtaccttgcctatttaactcgccagcaaataccacttcttctgtttctcattcccatataattcatcaaaatcagagagttctaaacatatacaaaataaacctcttttaaagccacatcagtaaaaaatttcaattaataaggttatcatcaaaccaagaattccactgatcatttgatcagcccattactaggaaacaggcaatatcagcacccgatctaaaggcaagcctatttcat

SEQ ID NO: 36725 - DNA, 601 bp, Human
ggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgygatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttct

SEQ ID NO: 36726 - DNA, 601 bp, Human
cacgctaagcccccttttacacagtggctgggggctgacatttctgctgctaacaaggcctccagaaaactagtcaagtttattcttctccataaactccaatacaagtgccttatctgatgcaggtgcttcaaaaacacatgaagctggagtcaaaggctctgcagacagccattgggcgccactcagtccccatctcagacctggcctgacgatgaaggggcaggaggcagaaggagttgttgctgggttcatgagatattactatgtgcatggcaagaccttttcttaaggaattgtraaagagaagtcaagaaaaagagaaacgcgaccaactaattttaactcttctttaaataagccataccataaggaaagtgaatcctattagttggaaacaagaaaatcaataaatacctgctttcaagaatagctcgttcaacacaggatgtcttctcctttaaggacaattccaaagactgttgactgatgactgacagaaacttgaggatcaatttagtgctttcggttttacctgccccactttcaccactgaaagacaaaacggaaaagtttgtgcttctaactataatttttaaaa

SEQ ID NO: 36727 - DNA, 601 bp, Human
aaagctatgtgccatgctcaactagtctttcattttctattctttggtgctcaaataattacagttccctgttcctttgacatagaagcttccagtgccaacagacaagcaaacaaagtatagactatttcatctaaatctaattccaggcctgacacatggtaccctgtcaggtaccaaactaactgacacagttgatttcaaacaaatacctgaagtttaatgatgaagtcaatgtttcagattatggaaattatatcagagatttataaaacaaatacggttctttatttcacagaattttttttttttttttttaacacagtgtctcgctctctcgcccaggctggagtgcagtggcacgatctcggctcactgcaacctctgctacctgggttcaagcgattctcctgtctcagcctcccaagtagctgggaatacaggcacacgccaccaagcctggctaatttttgtatttttagtatcggtggggtttcaccatgttggccgggctggtctcaaactcctgacctcaagtgatctgaccaccttggcctcccacagtgctgggattacaggcatgagccactgcgcctggccg

SEQ ID NO: 36728 - DNA, 601 bp, Human
atctgcttttttcactctaattctctcaccagtatacagaagagtattccaaaggctacacatgaggtacctcaacaaattaaaggcagaagagatatgacaacccaactgtcttttttttttttttttttttgagatagagtcttgctttgtctcccaggctggagtgcagtggcatgatctcggctcactgcaacctccgcgtcctgggttcaagcgattctcttgcctcagcttcccaagtagctaggattacaggtgcccgccaccaagcccggctaatttttgtatttttagtagmgacgggtttcaccgtatcggcctggctggtctccaactcctgacctcacgtgatccacctaccttggcctcctaaagaaagttctgggattacaggtagaagccactgcgcccagcccccaactgtctttcaatatgccagacattaaagaaatttgcaaaaagataagacaatgtgactatccttcctgttttctgatttggaaaacagtcttttaaataaaaatagaacatttattttagtatgcaatgggtttattattgttctttttaaattaataaagaatattttttaaacatc

SEQ ID NO: 36729 - DNA, 601 bp, Human
cttgaacctgggagacggaggttgcagtgagccaagtctgtgtcactatactccagcctgggcgacagagtgagactccgtctcaggggaaaaaaaaaaaaaaaaaaaagttgaatgtgtgcgtcccaaactatttgagagctcttctctactctctaacaaatgagtggttaaaagaaaaggcatggtaatttctcgattggaaaatccataatgatacactatagagaaaaccaattaagttcttatataaatcttaaaaaaaaattgaacccgttgcaattttggggataaaactttyacaactggcaaatctatattggtactggcaaggctttgcttctgacttaaaatctaagggaagccaattcacacactgttgattctaaaatactgagttcaatgagacaataggtttgaagcagccaagtatttaaattcaaccttgcacatttacatttatgtttccaaatggtccattgtgttctaaacattcacatcgttgatgtgcgtgttcgtgcacgttattttgttcccataaatatgaatcagtccagctggacccccttgggactgtaaccattcttcaaaaatacattac

SEQ ID NO: 36730 - DNA, 601 bp, Human
aaattgctttgacagcatgctatggtgttttttaaacacccatcatttttacaggtctgaaaactcacctaaaaataaaatagctaacaatgttgtatatagtgaaccctcacatagaagagttaaaataagtttgaagatcaaatgtttcaaattctgagtttctaggctgatactaccttatatgggctccctttgtcccaattcattcctatctaagtgacaggtggccatctagtatttacatttctaaaagtattacagcttttaaacttttttgctactttccttccttagatattaaacatgtgtttttgttacagattcccaccagatccaacacaggtgctgaaagctttcaggaaagggttttttccctaaactctttctctcttacaaagcctcctaaaaatagtacacttccgccgggcatggtggctcacgcctgtaatcccagcactttgggaggccgaggtgggcggatcatgaggtcaggagatggagaccatcctggctgacatggcgaaaccctgtctctactaaagatacaaaaaaaaaaaaaaaaatagccaggcgtggtggcgggcacctgtagtcccag

SEQ ID NO: 36731 - DNA, 601 bp, Human
aacactaattacagggtgaggcaggcgatggttcaaatcctgtctccccacttcccagctgtgttgcttgggcaagatgtttcatctctctctaagcctcagttttttcatctggaaaatggagataattttttaatttatcccctaatgccaggtgagaatgaaaggagaacatgcatgtaaaaggcagaaagcatgctacctggcatatcatatatattgatattagttattatttaaaaagttctgtaaaatccattgctactattaacaaggtaaaagtgaaaagcttcccaataattttttttttttagacagagtttcgctctttcacccaggctggagtgcagtggtgcgatctcggctcactgcaacctctgcctcccgggttcaagcgattctcctgcttcagccttctgagtagctgggattataggcgcctgccatcacgcctggctaatttttatattttgtagtagagacagggtttcaccatgttggccaggctggtcttgaactcctgacttcaggtgatccacccgcctcggcctcccaaagtgttaggattataggcgtgagccaccgcgcccgcccagccttc

SEQ ID NO: 36732 - DNA, 601 bp, Human
ggtgggtgcagtggctcacgtctgtaattccagcactttgggaggctgaggcaggaggatcgctggaggccagaattttgagatcagcctgggcaacataataagaccccatctcagtaaaacatctaaaaattagccgggtatgaaaaattagccatgcgtaatggcgcatgcctctagtcccagctacttgggaggctgaggcagaagaatctcttgaatctgggaggtagaggttgcagtgagctgagatcgtgccattgcattccagcctgggtgacagagcgagactctgcctttaaaaaaaaaaaaaaaaaaaaaaaagtcgggtgtagtggcttacacctgtagtgccagctactcaggaggctgaggggggagaatcacttgcgcctgggagtttgaggctgcagtgaggcgtgattacaccactgcactccagtctgggtgacagaacaagaccctgtctcacacacacacaaacacacacacacacacacacacacacacacacacacacacggaaaaaaaaaaagctttctcagagaagtcctggcaaaccgaccttctagaaaaagaaaactgaaaacctctgctggaa

SEQ ID NO: 36733 - DNA, 601 bp, Human
agtttaaagtctcaaacatttcaaaaacccaagggtgggtgcagtggctcacgtctgtaattccagcactttgggaggctgaggcaggaggatcgctggaggccagaattttgagatcagcctgggcaacataataagaccccatctcagtaaaacatctaaaaattagccgggtatgaaaaattagccatgcgtaatggcgcatgcctctagtcccagctacttgggaggctgaggcagaagaatctcttgaatctgggaggtagaggttgcagtgagctgagatcgtgccattgcattycagcctgggtgacagagcgagactctgcctttaaaaaaaaaaaaaaaaaaaaaaaagtcgggtgtagtggcttacacctgtagtgccagctactcaggaggctgaggggggagaatcacttgcgcctgggagtttgaggctgcagtgaggcgtgattacaccactgcactccagtctgggtgacagaacaagaccctgtctcacacacacacaaacacacacacacacacacacacacacacacacacacacacggaaaaaaaaaaagctttctcagagaagtcctggcaaaccgacctt

SEQ ID NO: 36734 - DNA, 601 bp, Human
ccatactctgctcctatctggaaaagggggttaaggagcctctgccccaacagcatcttcaaacgtagattttcctttttgctttctggactgagtttttgacaaccagaaggatttcagaccggctactgatctctcgctcagtcgctgctctggttgcagggataaaagccagtatttgaattagagaaagttagaagggtcttggggtatcgctttgtagacactgggggctgcctcctacttccaaagtactgttattcgtctgccaacatttgttactgcctgaacaaatacccayacacaaacaattaggatgagatgtttcaatgtgttctctaatgaaacagagtccctgacaagtcaaggacttcacttcaaataaaatagtaactgtttgggagacaaaaggttatggtaggcatggcaacaggagtatcttcccaatgtgaaagaacaattgtatagcggtgtcatagagccctaaaccctgtgagcatcaccccgagatctgtcagggattcggtgggagttgctctttctccgcatcgtaccttggtcttccccagctgccactcgctgttggaggcatcatagagct

SEQ ID NO: 36735 - DNA, 601 bp, Human
gttcttggcagttccctgatccagaaagaagaagtcatacaacaaattttgtgactaattttttatgttcaggcccgactgcccatactctgctcctatctggaaaagggggttaaggagcctctgccccaacagcatcttcaaacgtagattttcctttttgctttctggactgagtttttgacaaccagaaggatttcagaccggctactgatctctcgctcagtcgctgctctggttgcagggataaaagccagtatttgaattagagaaagttagaagggtcttggggtatcgcttygtagacactgggggctgcctcctacttccaaagtactgttattcgtctgccaacatttgttactgcctgaacaaatacccacacacaaacaattaggatgagatgtttcaatgtgttctctaatgaaacagagtccctgacaagtcaaggacttcacttcaaataaaatagtaactgtttgggagacaaaaggttatggtaggcatggcaacaggagtatcttcccaatgtgaaagaacaattgtatagcggtgtcatagagccctaaaccctgtgagcatcaccccgagatctgtcagg

SEQ ID NO: 36736 - DNA, 601 bp, Human
acacatgtgtcctcagctgcctgcatttctgtgtcaagtcacattgctgtctttcccatgtgacaagtcattgaaggtgggtggggaatgagagtggaagccaaacgaggttcttggcagttccctgatccagaaagaagaagtcatacaacaaattttgtgactaattttttatgttcaggcccgactgcccatactctgctcctatctggaaaagggggttaaggagcctctgccccaacagcatcttcaaacgtagattttcctttttgctttctggactgagtttttgacaaccagraggatttcagaccggctactgatctctcgctcagtcgctgctctggttgcagggataaaagccagtatttgaattagagaaagttagaagggtcttggggtatcgctttgtagacactgggggctgcctcctacttccaaagtactgttattcgtctgccaacatttgttactgcctgaacaaatacccacacacaaacaattaggatgagatgtttcaatgtgttctctaatgaaacagagtccctgacaagtcaaggacttcacttcaaataaaatagtaactgtttgggagacaaaa

SEQ ID NO: 36737 - DNA, 601 bp, Human
aggcttgggggaccctgatcagaggacccagctcagctgtgccccagctctgacccttagatactatgagataatcaatgtgtgttgttaaagccatgaagtttgcagtaatgtattacaaagcaatagctagctcatgtgattatctctgcatgctatctctaccctgttttgtgtttatatctcaaatccgtcagcagtaaaaaatttccctagagcagggaggtagtaggtccatcatgactttcccttgctgaatgtccaggaggtgaagcctaagtacttttcatcaatctcacaytggtcaaactgcaagacatacgtctctctcttcccccgctttctccctctttcctttcctctttttataaagcaagaaacttctagattaaaaacagcatattatgagtggaagctttaaaatacttctctgacattgcactgctgtgtgtaagggcagaaggagcgggaatgaggattcactcttcgaggacacatgtgtcctcagctgcctgcatttctgtgtcaagtcacattgctgtctttcccatgtgacaagtcattgaaggtgggtggggaatgagagtggaagccaaacgag

SEQ ID NO: 36738 - DNA, 601 bp, Human
gacggtcccttctttttaaccatccacgtaaaactcctgcccaaaattggtgatgattatggtttcttattatccctgtcactgagttacgagtcagagtcaagaacaggaacaaagcataaatatgaggtcccaattaaataattaaataattttctggctaggcatggtggctcatgcctgcaattcctgcactttgggaggccaaggtgggaggactgcttgaggccaagagttggagaccagcctgggcaacatagtgagattccatctctataaaaaattagcctggcatgatggygtgcgcctgcagtcctagctcctatgaaggctgcggcaggaagatggcttgaacctgagttcaaggctgcagtgagccatgaccacaccactgccctctagcttgggtaacagagcaagaccctgtcttaaataaatacctaaataaatagataaataaatagtaaataattttccaaaaggagtgtgcctcaaggcccctaagtgttaaggttcagcaaagtatactcaaatgttagtaacaatcaaagcatacaatgcaaatgctcatcatgaagtaggtatggtgagcagttcaagc

SEQ ID NO: 36739 - DNA, 601 bp, Human
cgtaaagaagctaacagaaaagagaagcacagaaagaaagaagggaaaatggaataaaagggttttcatggctgggcgcggtggctcactcctgtaatcccagcactttgggaggccaaggcgggcagatcacaaggtcaggagttcgagaccagcctggccgacatggtgaaaccctgtctctactaaaaatacaaaaattagctgggcattggcgtgtgcctgtaatcccagctactcaggaggctaaggcaggagaatcacttgaaccccgggggcggaggctgcagtgagccacgaytgtgccattgcactccagcctgggcaacagagcaagatcctgtctcaaaaaaaaaaaaaggttttcatggtggtgaagacaaaaaaaagaaaatgtaaatgtaaatgaagaaagacggcaataaaaaggaaagtgaagaaaaaggaagaagacaaatttaaaaatcaaatatgggagaaagcaggaagaggagacctggggaggaaggttctcatatccctgcccatctccaccttctcgactctctcccctctccagtctaggtccatgcgagaaacaggacggtcccttctttttaac

SEQ ID NO: 36740 - DNA, 601 bp, Human
agaaaagacatggaaaaaaacgtaaagaagctaacagaaaagagaagcacagaaagaaagaagggaaaatggaataaaagggttttcatggctgggcgcggtggctcactcctgtaatcccagcactttgggaggccaaggcgggcagatcacaaggtcaggagttcgagaccagcctggccgacatggtgaaaccctgtctctactaaaaatacaaaaattagctgggcattggcgtgtgcctgtaatcccagctactcaggaggctaaggcaggagaatcacttgaaccccgggggcgraggctgcagtgagccacgactgtgccattgcactccagcctgggcaacagagcaagatcctgtctcaaaaaaaaaaaaaggttttcatggtggtgaagacaaaaaaaagaaaatgtaaatgtaaatgaagaaagacggcaataaaaaggaaagtgaagaaaaaggaagaagacaaatttaaaaatcaaatatgggagaaagcaggaagaggagacctggggaggaaggttctcatatccctgcccatctccaccttctcgactctctcccctctccagtctaggtccatgcgagaaacag

SEQ ID NO: 36741 - DNA, 601 bp, Human
aaagaaaagacatggaaaaaaacgtaaagaagctaacagaaaagagaagcacagaaagaaagaagggaaaatggaataaaagggttttcatggctgggcgcggtggctcactcctgtaatcccagcactttgggaggccaaggcgggcagatcacaaggtcaggagttcgagaccagcctggccgacatggtgaaaccctgtctctactaaaaatacaaaaattagctgggcattggcgtgtgcctgtaatcccagctactcaggaggctaaggcaggagaatcacttgaaccccgggggyggaggctgcagtgagccacgactgtgccattgcactccagcctgggcaacagagcaagatcctgtctcaaaaaaaaaaaaaggttttcatggtggtgaagacaaaaaaaagaaaatgtaaatgtaaatgaagaaagacggcaataaaaaggaaagtgaagaaaaaggaagaagacaaatttaaaaatcaaatatgggagaaagcaggaagaggagacctggggaggaaggttctcatatccctgcccatctccaccttctcgactctctcccctctccagtctaggtccatgcgagaaac

SEQ ID NO: 36742 - DNA, 601 bp, Human
gatggcagaactctgaaaggcaaatgactgacagtcgtcactagacccatgttttctaagaggagcaggtgaagcaaaaaaggaatccagcaaacaaagccacaagtgaagaaaacagaaaaaaaatattgaagataacaaaagaaaagacatggaaaaaaacgtaaagaagctaacagaaaagagaagcacagaaagaaagaagggaaaatggaataaaagggttttcatggctgggcgcggtggctcactcctgtaatcccagcactttgggaggccaaggcgggcagatcacaaggtyaggagttcgagaccagcctggccgacatggtgaaaccctgtctctactaaaaatacaaaaattagctgggcattggcgtgtgcctgtaatcccagctactcaggaggctaaggcaggagaatcacttgaaccccgggggcggaggctgcagtgagccacgactgtgccattgcactccagcctgggcaacagagcaagatcctgtctcaaaaaaaaaaaaaggttttcatggtggtgaagacaaaaaaaagaaaatgtaaatgtaaatgaagaaagacggcaataaaaaggaaagtgaag

SEQ ID NO: 36743 - DNA, 601 bp, Human
ggggctccaaagctgaggatggcagaactctgaaaggcaaatgactgacagtcgtcactagacccatgttttctaagaggagcaggtgaagcaaaaaaggaatccagcaaacaaagccacaagtgaagaaaacagaaaaaaaatattgaagataacaaaagaaaagacatggaaaaaaacgtaaagaagctaacagaaaagagaagcacagaaagaaagaagggaaaatggaataaaagggttttcatggctgggcgcggtggctcactcctgtaatcccagcactttgggaggccaaggmgggcagatcacaaggtcaggagttcgagaccagcctggccgacatggtgaaaccctgtctctactaaaaatacaaaaattagctgggcattggcgtgtgcctgtaatcccagctactcaggaggctaaggcaggagaatcacttgaaccccgggggcggaggctgcagtgagccacgactgtgccattgcactccagcctgggcaacagagcaagatcctgtctcaaaaaaaaaaaaaggttttcatggtggtgaagacaaaaaaaagaaaatgtaaatgtaaatgaagaaagacggcaa

SEQ ID NO: 36744 - DNA, 601 bp, Human
cctactaaaagtctcccctaaaccaaaccttctaggggtttcatgagcactgtggggctccaaagctgaggatggcagaactctgaaaggcaaatgactgacagtcgtcactagacccatgttttctaagaggagcaggtgaagcaaaaaaggaatccagcaaacaaagccacaagtgaagaaaacagaaaaaaaatattgaagataacaaaagaaaagacatggaaaaaaacgtaaagaagctaacagaaaagagaagcacagaaagaaagaagggaaaatggaataaaagggttttcayggctgggcgcggtggctcactcctgtaatcccagcactttgggaggccaaggcgggcagatcacaaggtcaggagttcgagaccagcctggccgacatggtgaaaccctgtctctactaaaaatacaaaaattagctgggcattggcgtgtgcctgtaatcccagctactcaggaggctaaggcaggagaatcacttgaaccccgggggcggaggctgcagtgagccacgactgtgccattgcactccagcctgggcaacagagcaagatcctgtctcaaaaaaaaaaaaaggttttcat

SEQ ID NO: 36745 - DNA, 601 bp, Human
actgtataataaatcaatgctgccgggcgtggtgtctcacgcctgtaatcccagcactttgggaggctgaggcgggtggatcacaaggtcaagagttcaagaccagcctggccaacatggtgaaaccccgtctctactcaaaatacaaaaattagtcaggcgtggtggcgcacgcctgtaatcccagctactcaggaggctgagccagaagaatagctcaaacttgggaggcggcagttgtggtgagccgagttcgcaccactgcactccagcctgggtgacagagcgagactctgtctcaaaaaaaaaaaaaaaaaaatcaatgtcatacattaagaggaatattgaagagaattttcaaattaacttagggaattaaaaattgaggaatgggaattatatattagtaaaaacagttaagatgatttctaactgagaaaatcttaagatgctatgattaaatacttattggatcaaaggttctgatttgcaatgacattttttcctttgtcaggtgttccagtgctggctacctcacccttgatgtttttcattccaacagtcctactaaaagtctcccctaaaccaaaccttctagggg

SEQ ID NO: 36746 - DNA, 601 bp, Human
ttttaatccagtaactgtataataaatcaatgctgccgggcgtggtgtctcacgcctgtaatcccagcactttgggaggctgaggcgggtggatcacaaggtcaagagttcaagaccagcctggccaacatggtgaaaccccgtctctactcaaaatacaaaaattagtcaggcgtggtggcgcacgcctgtaatcccagctactcaggaggctgagccagaagaatagctcaaacttgggaggcggcagttgtggtgagccgagttcgcaccactgcactccagcctgggtgacagagcragactctgtctcaaaaaaaaaaaaaaaaaaatcaatgtcatacattaagaggaatattgaagagaattttcaaattaacttagggaattaaaaattgaggaatgggaattatatattagtaaaaacagttaagatgatttctaactgagaaaatcttaagatgctatgattaaatacttattggatcaaaggttctgatttgcaatgacattttttcctttgtcaggtgttccagtgctggctacctcacccttgatgtttttcattccaacagtcctactaaaagtctcccctaaacca

SEQ ID NO: 36747 - DNA, 601 bp, Human
agatgccgaaaactcacccatttaacttctttgaccctgattttaatactttgaatgtgtctttacttttttcctactcttactggttttaatccagtaactgtataataaatcaatgctgccgggcgtggtgtctcacgcctgtaatcccagcactttgggaggctgaggcgggtggatcacaaggtcaagagttcaagaccagcctggccaacatggtgaaaccccgtctctactcaaaatacaaaaattagtcaggcgtggtggcgcacgcctgtaatcccagctactcaggaggctkagccagaagaatagctcaaacttgggaggcggcagttgtggtgagccgagttcgcaccactgcactccagcctgggtgacagagcgagactctgtctcaaaaaaaaaaaaaaaaaaatcaatgtcatacattaagaggaatattgaagagaattttcaaattaacttagggaattaaaaattgaggaatgggaattatatattagtaaaaacagttaagatgatttctaactgagaaaatcttaagatgctatgattaaatacttattggatcaaaggttctgatttgcaatgacatttt

SEQ ID NO: 36748 - DNA, 601 bp, Human
attagatttatttatttatttattgatagcactcactcttggccctccctttgcaatttcaggccctctcttgataattcatcatttagagaatcacttaatgctataatttcctaattgcaaacatctttagtaggttatttggttgtaaaaatttatttatgcccataaaatataaattggtgattagattttctttttcattcattcgttgctctgaaactttttggctctgctttaattaaagttttattaagtattaaatgaggctgcatttacacaatagctttaagagatgccraaaactcacccatttaacttctttgaccctgattttaatactttgaatgtgtctttacttttttcctactcttactggttttaatccagtaactgtataataaatcaatgctgccgggcgtggtgtctcacgcctgtaatcccagcactttgggaggctgaggcgggtggatcacaaggtcaagagttcaagaccagcctggccaacatggtgaaaccccgtctctactcaaaatacaaaaattagtcaggcgtggtggcgcacgcctgtaatcccagctactcaggaggctgagccaga

SEQ ID NO: 36749 - DNA, 601 bp, Human
gggtctaagcaggtgttttagtttgttcccatgggaagaattattttctggtgtctttacccttaatgttgctatcatggtactgtatcaactcagaaagattcaaagggcaaggggtagtgaggggtcctgagaacatactagaaggtcctaatgatcttggggctgagaattgaagaattcggctattggatgttaccctcgtaaattaaaagacgttctcagccaggaagaggctcacgcctgtaatcccagcactttgggaggctgagatgggcagatcatctgagatcgggagttygagaccagcctgaccaacatggagaaaccccatctctataaaaaatacaacatttgccaggcgtggtggtgcatgcctgtaatcccagccacttgggaggctgaggcaggagaattgcttgaacctggaaggtggaggctgcggtgagccaagattgcaccagtgcactccagcctgggcaacaagagagaaactctgtctcaaaaaaaaagaaaaaaaaaaaaaagatgttctctggcattgctcagacacctccagcataaccctgcagactcacaaactcacaagctgcaggaatag

SEQ ID NO: 36750 - DNA, 601 bp, Human
ggaatttgagaccagcctgggaaatttactgaggcccagtctctacgaaaaataaaaaattagctgggtgtagtggtacatgcttatagtcccagctactcgggaggctgaggcaggaggatcacctgagcccagaaggccaaggctgcaatgagccacgattattccactgcactccagcctgggtgacagagcaaaactctgcctcacaaaaaaaacaaatacaaaacgaaacaaaacatgtcaacttaagaaaaatcaagcagaacaaagcatcaggaaaatgactatgaacagacaygcatccatctagcatttactgaccaactacaaaatgtgagcgctatcaaatatgaaagagacgctagggtatccttctcctgctgggggcttataagacacaaaatatatatatactcctactgtttaaggcagaggggaagtacttggtatccaatggcatgtttaagttaaaaaaatgacaccatatgtaaaggtaggctgtgcaaacgatttacagcaaagcactaaaatctatctcgcgtgcttcctaagggagaaaaatgtgactacaagcttgaaaatattcaacatatacaag

SEQ ID NO: 36751 - DNA, 601 bp, Human
aacctcatcacaatcagaaaataaaggaaaacgtgtctgggcatggtggctcacacctgtgattccagcactttgggaggccaaggtgggaggatggcttgagcccaggaatttgagaccagcctgggaaatttactgaggcccagtctctacgaaaaataaaaaattagctgggtgtagtggtacatgcttatagtcccagctactcgggaggctgaggcaggaggatcacctgagcccagaaggccaaggctgcaatgagccacgattattccactgcactccagcctgggtgacagarcaaaactctgcctcacaaaaaaaacaaatacaaaacgaaacaaaacatgtcaacttaagaaaaatcaagcagaacaaagcatcaggaaaatgactatgaacagacatgcatccatctagcatttactgaccaactacaaaatgtgagcgctatcaaatatgaaagagacgctagggtatccttctcctgctgggggcttataagacacaaaatatatatatactcctactgtttaaggcagaggggaagtacttggtatccaatggcatgtttaagttaaaaaaatgacaccatatgtaa

SEQ ID NO: 36752 - DNA, 601 bp, Human
ggtaagtctaatgcaaatattccaaactccaaaatctgcaccacttccagtcccaagcattttgggtaagggatactcaacatgtaatggagagtatcatattggaatggccactagatgtctattttttttttttatgagatggaatgtgtcttcttgcccaagctggagtacaatggcacaatctcggctcactgcaacctccgcctcccgggttcaagtgattctcctgcctcagcctctcgagtagctgggacacaccaccatgcccggctaatttttggtattttcagtagagatggggtttcactatgttggccaggctggtcttgaactcctgacctcaggtgattcacctacctcggcctcccaaagtgctgggattacaggcatgagccattgtgcctggcctagatgtctatttttgttatgtattcccaggatggggttttcaaccatctaacagcatttctactcaagtcaataaaaccacaggagagttggaaatgaaaaataactgttttaaagtagaaaactattttgaccagagaactcttccatctttatttcaaatgagtactctcacatccaacctcatcac

SEQ ID NO: 36753 - DNA, 601 bp, Human
gattacttcttaggggtaaatgtcagtttcattaccaaagaataaagtgagaagaagcagataaagtacgtgtaaatgccttttagtgctatattatgttctaactttaggtcaatggacggccttttctccaggtcccatagacctttacagacatttgacgatgatgaatgagttccttgagaaattaacagcaaataataaatcctcagttctacccaaaatacttatatcaaggatccttacttaagatattacttataaactagggaacattcaggtgctttttctgttttaaaamataaattttaaggtgagaagatcaatataggttgagcatccataatccaaaacaaatctgaaatctgaaatgcttcaaaattcaaaactttttgagcaccgacatgatgctcaaaggaaatgctcactggaacatttcaaattttcagattagggatgcttaaccggtaagtctaatgcaaatattccaaactccaaaatctgcaccacttccagtcccaagcattttgggtaagggatactcaacatgtaatggagagtatcatattggaatggccactagatgtctattttttttttt

SEQ ID NO: 36754 - DNA, 601 bp, Human
agcacctttgcttttaatttgattacttcttaggggtaaatgtcagtttcattaccaaagaataaagtgagaagaagcagataaagtacgtgtaaatgccttttagtgctatattatgttctaactttaggtcaatggacggccttttctccaggtcccatagacctttacagacatttgacgatgatgaatgagttccttgagaaattaacagcaaataataaatcctcagttctacccaaaatacttatatcaaggatccttacttaagatattacttataaactagggaacattcagrtgctttttctgttttaaaacataaattttaaggtgagaagatcaatataggttgagcatccataatccaaaacaaatctgaaatctgaaatgcttcaaaattcaaaactttttgagcaccgacatgatgctcaaaggaaatgctcactggaacatttcaaattttcagattagggatgcttaaccggtaagtctaatgcaaatattccaaactccaaaatctgcaccacttccagtcccaagcattttgggtaagggatactcaacatgtaatggagagtatcatattggaatggccact

SEQ ID NO: 36755 - DNA, 601 bp, Human
accacacaatcatctgcataatgctaacacatgggtggggtttctagctgtttgccagaaaaagaccacgaacaccccaacccgatgtaaatggaacgactacatgaaagaaaagcccaaaatcacaactagcaacaaaaaacatgaccctctagaaacactttataatatcacaaattaaaaatcacttacaaaatctccaacagttaaaatgactgggaaaagcagctcgaaatgaaaatgctgcagatgtctatatgcaaatggaaaggggagtctgttaagcagaccgaggaagcarggcaggcagtcacctctcacgatgaattcctggccctccactctggtgtcccctttggacctctgcagcagggttatccagtggtgcatctcctccggcgtgtcggcgttgcagtgcagcacccggttggccgtgatgatcacaaacgagttgggtctgagccacaagatgagaaggaaacaaagccccttagccctaccgtcagcatcacctctgtgtgaaccgagactcagtgccttcttcctggcttctgggtcacgggatatacactgctaggctatctgtgcttttattaaggca

SEQ ID NO: 36756 - DNA, 601 bp, Human
actttctatgctactaggctaagttcatggacagtcaggatttatcttttacaggttgcataggacgctcatcgtacaatgatggaaaacagcctggcccacatggcaaaacctggtctccaccaaaaagtataaaaattagcccggtgtgatggtgcgtgcctgtagtcctagctactcctcgggaggctgaggtgggaggattgcttgagccctggaaggctgtagtgaaccaagattgcaccattgcactccggcctgggcaacagtgtgagaccctgtctcaaaaatgagaagaatraaaattaaaaggatgaaaacagtatatgaaaaccaagcttcccgtacgatgccctgcatctgttgacattttcttgtccttgcgagaatcttcctaccactccatgaatcgacctctagtacggcttaaacactaagtggtcacatagctaaccccagacaggcttagaagataaaccaagaggacaacttctttggggggaaataaagtacacactaggaaggaatcttattcctttgcccggagcaagcccagactttaagatttgatgctcagggttcgggcagccagcctggttac

SEQ ID NO: 36757 - DNA, 601 bp, Human
tacaaaaattacaagaaaccctctaagttacctgtgtactttctatgctactaggctaagttcatggacagtcaggatttatcttttacaggttgcataggacgctcatcgtacaatgatggaaaacagcctggcccacatggcaaaacctggtctccaccaaaaagtataaaaattagcccggtgtgatggtgcgtgcctgtagtcctagctactcctcgggaggctgaggtgggaggattgcttgagccctggaaggctgtagtgaaccaagattgcaccattgcactccggcctgggsaacagtgtgagaccctgtctcaaaaatgagaagaatgaaaattaaaaggatgaaaacagtatatgaaaaccaagcttcccgtacgatgccctgcatctgttgacattttcttgtccttgcgagaatcttcctaccactccatgaatcgacctctagtacggcttaaacactaagtggtcacatagctaaccccagacaggcttagaagataaaccaagaggacaacttctttggggggaaataaagtacacactaggaaggaatcttattcctttgcccggagcaagcccagactttaag

SEQ ID NO: 36758 - DNA, 601 bp, Human
tgtgttacacagaagcacaagatcacaaccagcaacaaaaatcaaaataagccatcttctggaaacactttcataatactacaaaaattacaagaaaccctctaagttacctgtgtactttctatgctactaggctaagttcatggacagtcaggatttatcttttacaggttgcataggacgctcatcgtacaatgatggaaaacagcctggcccacatggcaaaacctggtctccaccaaaaagtataaaaattagcccggtgtgatggtgcgtgcctgtagtcctagctactcctcgsgaggctgaggtgggaggattgcttgagccctggaaggctgtagtgaaccaagattgcaccattgcactccggcctgggcaacagtgtgagaccctgtctcaaaaatgagaagaatgaaaattaaaaggatgaaaacagtatatgaaaaccaagcttcccgtacgatgccctgcatctgttgacattttcttgtccttgcgagaatcttcctaccactccatgaatcgacctctagtacggcttaaacactaagtggtcacatagctaaccccagacaggcttagaagataaaccaagagg

SEQ ID NO: 36759 - DNA, 601 bp, Human
agcacttggcctggcagtgtgtgagttcagaggcaagctgtccgaaccgtcacccaaacctgacgcgaatggaacaactgtgttacacagaagcacaagatcacaaccagcaacaaaaatcaaaataagccatcttctggaaacactttcataatactacaaaaattacaagaaaccctctaagttacctgtgtactttctatgctactaggctaagttcatggacagtcaggatttatcttttacaggttgcataggacgctcatcgtacaatgatggaaaacagcctggcccacatggyaaaacctggtctccaccaaaaagtataaaaattagcccggtgtgatggtgcgtgcctgtagtcctagctactcctcgggaggctgaggtgggaggattgcttgagccctggaaggctgtagtgaaccaagattgcaccattgcactccggcctgggcaacagtgtgagaccctgtctcaaaaatgagaagaatgaaaattaaaaggatgaaaacagtatatgaaaaccaagcttcccgtacgatgccctgcatctgttgacattttcttgtccttgcgagaatcttcctaccactccatg

SEQ ID NO: 36760 - DNA, 601 bp, Human
ataaatgataactggctctggaagggaaaagggtaagttaatgtctctttttgggctctggaacaggagtgaaaactctctctgatttctgactttccttcttacttcctatttcttcctttcctttctttagcctctcccttcagaagacagcacttggcctggcagtgtgtgagttcagaggcaagctgtccgaaccgtcacccaaacctgacgcgaatggaacaactgtgttacacagaagcacaagatcacaaccagcaacaaaaatcaaaataagccatcttctggaaacactttyataatactacaaaaattacaagaaaccctctaagttacctgtgtactttctatgctactaggctaagttcatggacagtcaggatttatcttttacaggttgcataggacgctcatcgtacaatgatggaaaacagcctggcccacatggcaaaacctggtctccaccaaaaagtataaaaattagcccggtgtgatggtgcgtgcctgtagtcctagctactcctcgggaggctgaggtgggaggattgcttgagccctggaaggctgtagtgaaccaagattgcaccattgcactccg

SEQ ID NO: 36761 - DNA, 601 bp, Human
acatttacagctgagatggggagatgagtattagaacaataaacccatcattaaatatataaagataaatgataactggctctggaagggaaaagggtaagttaatgtctctttttgggctctggaacaggagtgaaaactctctctgatttctgactttccttcttacttcctatttcttcctttcctttctttagcctctcccttcagaagacagcacttggcctggcagtgtgtgagttcagaggcaagctgtccgaaccgtcacccaaacctgacgcgaatggaacaactgtgttamacagaagcacaagatcacaaccagcaacaaaaatcaaaataagccatcttctggaaacactttcataatactacaaaaattacaagaaaccctctaagttacctgtgtactttctatgctactaggctaagttcatggacagtcaggatttatcttttacaggttgcataggacgctcatcgtacaatgatggaaaacagcctggcccacatggcaaaacctggtctccaccaaaaagtataaaaattagcccggtgtgatggtgcgtgcctgtagtcctagctactcctcgggaggctg

SEQ ID NO: 36762 - DNA, 601 bp, Human
ctctgtcacctaggctggggtgcagtggaatgatctctgctcactgcaacctctgcctcggaggttcaagcaagtcttctgcctcagcctcctgtgtagctgggattacaggaatgcgtcactacacccggctaatttttgtatttttagtagagatacggtttcatcatgttggccaggttggtcttgaactcctgacctcaagtgatccacctgcctcagccttccaaagtgctggaattacaggcgtgagccaccgtgccggccaaccaagcactagttttgattacagaaaaaaaaytgagcttcactaatgctgaggtcttggtgctctaagggtagaatctctgagctgtaatcacccaccttgatgggcttgtcttggcttaccttgatatcttgaatcagctgctgggtgggggtgtcgatcggggccttggtgtcagtcacgttttgaatggcactggaccaccgggtggcctcgttgagcagcttggtgtagagccggtaacagtgcttgcgcccgtacacggtgacgttccagtagcctgcaatggcaggggtgcccagcacacgcacgtcaacgccaacctcggggact

SEQ ID NO: 36763 - DNA, 601 bp, Human
tttgggtgtttttttttttttttttgagacgaagtctcactctgtcacctaggctggggtgcagtggaatgatctctgctcactgcaacctctgcctcggaggttcaagcaagtcttctgcctcagcctcctgtgtagctgggattacaggaatgcgtcactacacccggctaatttttgtatttttagtagagatacggtttcatcatgttggccaggttggtcttgaactcctgacctcaagtgatccacctgcctcagccttccaaagtgctggaattacaggcgtgagccaccgtgccggccaaccaagcactagttttgattacagaaaaaaaattgagcttcactaatgctgaggtcttggtgctctaagggtagaatctctgagctgtaatcacccaccttgatgggcttgtcttggcttaccttgatatcttgaatcagctgctgggtgggggtgtcgatcggggccttggtgtcagtcacgttttgaatggcactggaccaccgggtggcctcgttgagcagcttggtgtagagccggtaacagtgcttgcgcccgtacacggtgacgttccagtagcctgcaatggcaggg

SEQ ID NO: 36764 - DNA, 601 bp, Human
caagcgctagttttttgggtgtttttttttttttttttgagacgaagtctcactctgtcacctaggctggggtgcagtggaatgatctctgctcactgcaacctctgcctcggaggttcaagcaagtcttctgcctcagcctcctgtgtagctgggattacaggaatgcgtcactacacccggctaatttttgtatttttagtagagatacggtttcatcatgttggccaggttggtcttgaactcctgacctcaagtgatccacctgcctcagccttccaaagtgctggaattacaggcrtgagccaccgtgccggccaaccaagcactagttttgattacagaaaaaaaattgagcttcactaatgctgaggtcttggtgctctaagggtagaatctctgagctgtaatcacccaccttgatgggcttgtcttggcttaccttgatatcttgaatcagctgctgggtgggggtgtcgatcggggccttggtgtcagtcacgttttgaatggcactggaccaccgggtggcctcgttgagcagcttggtgtagagccggtaacagtgcttgcgcccgtacacggtgacgttccagtagcc

SEQ ID NO: 36765 - DNA, 601 bp, Human
agaacctgacgcaaagcaggtggtcccccacgcaggtcaccacatccccatgagcagggagccccacagtgcaagctgcagacctcatccttctgcccacagaacccaacaggtgggatcgggtgactcagcgaaaatgtctaacacttccctagagacaaaacatttttggtctaaagtttctcatttagattcccgaaagcagggtactcaaacacaaatttaaccaagcgctagttttttgggtgtttttttttttttttttgagacgaagtctcactctgtcacctaggctggggtrcagtggaatgatctctgctcactgcaacctctgcctcggaggttcaagcaagtcttctgcctcagcctcctgtgtagctgggattacaggaatgcgtcactacacccggctaatttttgtatttttagtagagatacggtttcatcatgttggccaggttggtcttgaactcctgacctcaagtgatccacctgcctcagccttccaaagtgctggaattacaggcgtgagccaccgtgccggccaaccaagcactagttttgattacagaaaaaaaattgagcttcactaatgctgagg

SEQ ID NO: 36766 - DNA, 601 bp, Human
gacagtggaactagccggttactcctagaaggtctccaactgaggctgagggagaacctgacgcaaagcaggtggtcccccacgcaggtcaccacatccccatgagcagggagccccacagtgcaagctgcagacctcatccttctgcccacagaacccaacaggtgggatcgggtgactcagcgaaaatgtctaacacttccctagagacaaaacatttttggtctaaagtttctcatttagattcccgaaagcagggtactcaaacacaaatttaaccaagcgctagttttttgggtgtttttttttttttttttgagacgaagtctcactctgtcacctaggctggggtgcagtggaatgatctctgctcactgcaacctctgcctcggaggttcaagcaagtcttctgcctcagcctcctgtgtagctgggattacaggaatgcgtcactacacccggctaatttttgtatttttagtagagatacggtttcatcatgttggccaggttggtcttgaactcctgacctcaagtgatccacctgcctcagccttccaaagtgctggaattacaggcgtgagccaccgtgccggccaac

SEQ ID NO: 36767 - DNA, 601 bp, Human
cggaaagtgagggtaagaatccccgctcagggctgccatgcaaccattcattccttcatctcacatagatttactgagcgactacacgtacttataaacagcaatttgtaatgtaacatgctcggtgttaatagagagactcaggagcttctggaagtttgcacgtgcctgagagggatgccaagtgttcttctagaccaccctgggctccttgggaattcactcgtgtggtctggaaactgtacagtgacagtggaactagccggttactcctagaaggtctccaactgaggctgagggrgaacctgacgcaaagcaggtggtcccccacgcaggtcaccacatccccatgagcagggagccccacagtgcaagctgcagacctcatccttctgcccacagaacccaacaggtgggatcgggtgactcagcgaaaatgtctaacacttccctagagacaaaacatttttggtctaaagtttctcatttagattcccgaaagcagggtactcaaacacaaatttaaccaagcgctagttttttgggtgtttttttttttttttttgagacgaagtctcactctgtcacctaggctggggtg

SEQ ID NO: 36768 - DNA, 601 bp, Human
gttcaggcagttctcctaaaaataaagcaagcaagcttattgtaagaaacctgtattttcctacatataaatatttttcaagactctcaaatatccataaacctagtggggcaaagatggtggaaatccagtgttaggtggtttcatggacgaagatacccataatctgtgtttgaagacaaatcacaaaaatacattcttacagctcatttcttattttctcgtgcgtgtacttccccatgtgattttaaattttctcccctggagattacatacatttaaaaaatttcatctcagcagrgcacggtggctcacacctgtaatccccgcattttgggaggctgacgcaggtggatcgtgaggtcagcagttcgagaccagcctgaccaacatggtgaaaccctgtctccactaaaaatatgaaaattagccgggtgtggtggctgagtagctgtaatctcagctactcatgaggctgaggcaggataattgcttgaacccgggaggcggaggttgcagtgagccaagatcatgccacggcactccagcctggctgacagagcgagactccgtctcaaaaaaaaatttaggctgggcacag

SEQ ID NO: 36769 - DNA, 601 bp, Human
ttggaatgcaaaattacttaggatctggttgtctggctactcggccaggtgcaatggctcacacctgtaatctcagcactttgggaggccgaggcaggtgggtcacttcaggccaggagttcaagaccagcctgggcaatatggcgaaaccctgtctctattaaaaattcaaaaattagctggatgtggtggcgggtgcttgtaatcccggctacttaggaggctgaggcatgagaacgaccttaacctgggaggcagatgttgcagtgaaccaagattgcaccactgcaccccagcctgrgtgacagagtaagactctgtctcaaaaaacaaaaacaaaacaaaaggctactctcagttcatggggagagctggcattttctgactcctttaaatctcttcttttactacagcaatcaatcttagcattactacaaccacactctagaagtcttgctttaataatgaatctaagtatatttcatcttttccttccaattcacgacgaataagagagtctttgagataaaaacaaatgcttctgtgttaagctaaagagttagcagggcaagtggaatcatggtctctgaggagtcggggt

SEQ ID NO: 36770 - DNA, 601 bp, Human
gtgctgccaactcacctctgcagcgttgttaatacttgaaagagtcatgcctcatcctatcatatgaaaattcttggccgggcgccgtggctaacgcctgtaatcccagcactttgggaggccgaggcgggtggatcacctgaggtcagaagttcgagaccagcctggccaacacggtgaaaccccatctctactaaaagtacaaaaaattagccaggcgttgtggcgggcgcctgtaatctcagctactcaggaggctaaggcaggagaatcgcttgaacccaggaggcagatgttgcartgagccgagatcatgccattgcactctagcctgggcaacaagagcaaaactctgtctcaaaaaaagaaaagaaaagacacttctttttctatagctaatcaaaatctcaattagattgtttctatctctttgatctggaacaaatatccaagtttttttttttttttttaaatatagagcagtggtaattaattgatccaatgtcctatacattaggacattacaccaacggtgacttggtccctgaaataaccttgtgtgacttaaaaaggatggcagcattctctaagcttgctcagg

SEQ ID NO: 36771 - DNA, 601 bp, Human
actaagcaaactgcaactgtgcaggacagccactctaatgctgcacaatgttcctgacgcaggtgtatctgcagcaaaggcatctaacagaacaagcagcagctgcctctcctcacctccccagcggtggtgtgggagttgatggtgatcttgcaggagccgccgccatggcaatagaccgtggatgtcatttcctgcctgtggatcagagcttctatttcatctcgggaaggcacaaactctcggcatttggttttcttaagagattcgtaagtgaagagagcgtatttttccatctcgsttcctggaaactgttcccgtatcctaggaggcaaacactaactgttaatttttagactgatgggggctggctgctgggaggaactaggctgtgccaaggttctgtagaccaaagcagtgaatggtcccccactggtgaatggagcaagcaccagtgacttcttggcaagggcccgcttcattttgtgcagttcaatttaaatacaaaaaacccctaaagagccaatgtctcactgggagcaactgtgctgccaactcacctctgcagcgttgttaatacttgaaagagtcatgcctcatc

SEQ ID NO: 36772 - DNA, 601 bp, Human
tcacgcctgtaatcccagcactttgggaggcccaggtgggcggatcacctgaggtcaggagtttgggactagcctgaccaacatggccaaaccccatctgtactaaaaatacaaaaattagctgggcgtggtagtacatgcctgtaatcccagctactcgggagtctgaggcaggagaactgcttgaacccagaaggcagaagttgcagtgagccaaggttgcgccactgcacttcagcctgggcaacagagcaagactccatctcaaaaaaaaaaaaaaaaaaaagtaggtccattttayattgtagacataacacatagtttaaagagtttataagctggcttcagtcaatcagcccaatttcaaagctaatgacaactggaaacctaaaaaatcaagaaatacccagacgggtccaacatggaactgagaaaaggaatggggtaaaaaaccactgacaagttacatcacgtaagaccgtagctttatctaggaatcgagaaaaatagcggatatgcaaagttaaacaggcatcaacacaggtaaaataaaactaactccaatacagcgtgaagccacaaatggaatgggaagctcaaa

SEQ ID NO: 36773 - DNA, 601 bp, Human
aaatagcgtaggtctacaggccaggtgcagtggctcacgcctgtaatcccagcactttgggaggcccaggtgggcggatcacctgaggtcaggagtttgggactagcctgaccaacatggccaaaccccatctgtactaaaaatacaaaaattagctgggcgtggtagtacatgcctgtaatcccagctactcgggagtctgaggcaggagaactgcttgaacccagaaggcagaagttgcagtgagccaaggttgcgccactgcacttcagcctgggcaacagagcaagactccatctcaaaaaaaaaaaaaaaaaaaagtaggtccattttacattgtagacataacacatagtttaaagagtttataagctggcttcagtcaatcagcccaatttcaaagctaatgacaactggaaacctaaaaaatcaagaaatacccagacgggtccaacatggaactgagaaaaggaatggggtaaaaaaccactgacaagttacatcacgtaagaccgtagctttatctaggaatcgagaaaaatagcggatatgcaaagttaaacaggcatcaacacaggtaaaataaaactaactccaatac

SEQ ID NO: 36774 - DNA, 601 bp, Human
tataacatttttttaaatgtagatttttatcagtgtttaaaaaattagatctatagcttccctaaggaagggtagaagaatagatgacatcttaattttgcattcattcctaatattacagatgcatttactacacaggagaagagaaactgtgaggagaagggaggcgttaatggtacaattttgggggctcgaaaaaaagaggttgagagagcaaaatgctccatcttgtcttctctccacatgaacttggccgtgatccatgttctcagatgccagcacccagcccaccccaacacayggcagccagttctcacctccacatcaaacagcgtcgagccatagccaggccactccttgatcaaggccatgtacttggccatggcctgttcctggttcattccctgaaatttcctccacttgtcaatgatactggctcgagcagaggagacttcttccttaatccacatgtccagcatctgctcctcctcgaccttctgccggaccacggatcctgtccggaagctccgcctcagggtcccctctaggaagctcgtccgcctcttctccagccgttcacaaggggtgaaggttttggttg

SEQ ID NO: 36775 - DNA, 601 bp, Human
ggttggcaacagaaagcatctaaaccataagacaggctttgagtgaagtcctctgtgcagaagattaaatatattcgatgtgcatgcatgcatggaggggcctgaaatatgaaaaatggcacctctctggctatcttgatttctaactagttaatctcacgcttttgggaaaacctcactaactggcagagtctaacatcttgctttgactctccacttctcagcattattctactagctgtttggattagctacgtggaagtggcctggaaacgtacatgcttggccgggggacttaagraagcttccctgcaacccaagccaagtctactcttgtattaatatctccagttctgcctccaatcctctttgcggatggttagtcttcaaatacaaaatctaggatcacagaggaaaattctccaaatcacgcatgctgagcagttctggctcctcttcacaaggagcagcaatggccttccatatgcagagtgggaacagggactttaccagtttaactgtagactttcctgtacagattggtggaagaaaataagaccccatatgaaggggctaacaacacagggctgatccaaacctg

SEQ ID NO: 36776 - DNA, 601 bp, Human
atgagctgcacccaggatggtcatgctcccggctccctcctggtctcaagaggccaccagagccgagtctcacagctgtgacaccgctataattgctaactaattttcataaggttttgttgcaaataatatactttttcagggacatctatgtcacttccctttctctgcctttcctccaagggtaagactccttggcaaaatggaaccaaattcctctgttgcaaaagtatacaaaaaaaatatggtgatctcagattttggcctgcagggaaccggcagctggaaagggaccaccacrctgtattttcgtgttttgaagaaaaatattcaaagaaaatgacctggtcaaaggcatgaggaaatggggtcctgtttttctgttttgtcaagaccatgaataaaaagatgaacttgctttgcctcttacctcactggtttcaaagagcagctccctctcatcgaccacgatcttatacgtattcgccaggggtgccccaaaagagaggatgtgttcatactggaagacttccagtggtcttccctctccacgcttgtagacggagacggcgtccgcgctgacacccaaccagagttcctg

SEQ ID NO: 36777 - DNA, 601 bp, Human
gcactggagccagctgttgaagagtggtttataaatacagttatcttgtaggctgcttatctgtttataatacagcagacacagatggcagactttgctacatgtaaaacaatggagtcaacacgtgtttttcaaaatacagcaaagacaggaaaatccaggatttgggtttgttaataaaaccaccttataaagtaacaattgagactatagctctgcattattaaaatatacagactgtgtacaccattacacatcctttttccctttgctttttaatgctcatgaaaccatgattaargtgttgagtttatgaacacatgcacgaacaggcaagcacgtacacttaaaagatgaaacaaagaaaaaagttgattcatgtcattccatgagaaaggctgcccgcagcactccagctcaaacacactgtcccctcgagctctccatcccccttcccactccctcaccttccctcagattcggggaaatcaggttgggaggttagtgcatcattgacagagaatgccccccttccacgctctgttaagtctcccccagaagggggaaaggcagttcccttcagtagcacagttacggtcga

SEQ ID NO: 36778 - DNA, 601 bp, Human
tactagctgccaagtagcacacttatgctgctgtgtcccaatccattctgtggtgagtataagtcacaagagtctgcataaaacactatcagcaatcaggatggctatggggcaaggaccgtttagaatgttaccaagtcacaggaccagcaggaaaatggaataatggaagaatgtgaaataaatctgatttgtttgagcagaaggcagctttgattcaggcataaatgcatctcccagattatcatgtaaataaagacctcagaagttgacacttccctcccagtccaccacttaaaayaggacacatgctcagttttcccaatctgttttaaagtgttttcattaggatactcttctgtaagtgctttattcattcccagtctgttttgattactggctgaaaataaatcaggaaccattttatataaaaaccattatagtagataactggttatgtgtatttttccatttgcattttcatccaaaattgcttgtttcttttccttttatttatgtgcagaaagagactcatccgctgaatacacagcactgttaatcctacagtcttctgtccccacagagtctgctagatcttcct

SEQ ID NO: 36779 - DNA, 601 bp, Human
tgatttgtttgagcagaaggcagctttgattcaggcataaatgcatctcccagattatcatgtaaataaagacctcagaagttgacacttccctcccagtccaccacttaaaacaggacacatgctcagttttcccaatctgttttaaagtgttttcattaggatactcttctgtaagtgctttattcattcccagtctgttttgattactggctgaaaataaatcaggaaccattttatataaaaaccattatagtagataactggttatgtgtatttttccatttgcattttcatccaraattgcttgtttcttttccttttatttatgtgcagaaagagactcatccgctgaatacacagcactgttaatcctacagtcttctgtccccacagagtctgctagatcttcctcttctgagtcatcctcttcttcctcctctggtgctgacgaactggaggtgggccctttgcaggttttcaggtggcgggtgagatggtatttggttagataagcctttgtacatttttcacagacataatcccgttttccttcatgagaattgagatgcttctttaagtgatttgttctcaagaacag

SEQ ID NO: 36780 - DNA, 601 bp, Human
accatttttctgtccttttcttagactagtggttctcaagtaggggcgactgcctctatggggacatttggcaatgtctggagtcctttctgattgttatactggggaggggtggtataattagtatctagtaggaaaaggccaaggatgctgctaaccattctacaatgcacagggcagccccacaacaaaaaattaacccggtcaaaatgtcaataatgtcaaggtttgagtaaccctggcctagacatttcagagctgaaaagaaccttagagatcacacagaccaggaattttttarctttttttttttttttgagtagctgaaccccatgtctttatgaaagcccaatatgaaacagttaaagcaggttattaataaaatcctggaaggagtgagagggtgcagtcgggcgttctgaagcctggcttccttagcatttctctcatcctcttctagcaacagatggcactgaagaacccttagaattccctggagcagttttaaaaccaccaatctaatccaacctcttaattctgcagatgggaaacatcatgtgcataaaaactactaaggaacttgcccaaggccacaacaaaa

SEQ ID NO: 36781 - DNA, 601 bp, Human
ccccacaacaaaaaattaacccggtcaaaatgtcaataatgtcaaggtttgagtaaccctggcctagacatttcagagctgaaaagaaccttagagatcacacagaccaggaattttttagctttttttttttttttgagtagctgaaccccatgtctttatgaaagcccaatatgaaacagttaaagcaggttattaataaaatcctggaaggagtgagagggtgcagtcgggcgttctgaagcctggcttccttagcatttctctcatcctcttctagcaacagatggcactgaagaayccttagaattccctggagcagttttaaaaccaccaatctaatccaacctcttaattctgcagatgggaaacatcatgtgcataaaaactactaaggaacttgcccaaggccacaacaaaacccctaccaaaagtctgacttttcatcttctactctgatggtttttagatgtttattcaacacatatttactgtgtctaattatgccaggcactgttctagatgctagggctataggatgtgggtaaactaagtccctgctttcatgaagcttacattctaagtggacagattatagcat

SEQ ID NO: 36782 - DNA, 601 bp, Human
gcttccttagcatttctctcatcctcttctagcaacagatggcactgaagaacccttagaattccctggagcagttttaaaaccaccaatctaatccaacctcttaattctgcagatgggaaacatcatgtgcataaaaactactaaggaacttgcccaaggccacaacaaaacccctaccaaaagtctgacttttcatcttctactctgatggtttttagatgtttattcaacacatatttactgtgtctaattatgccaggcactgttctagatgctagggctataggatgtgggtaarctaagtccctgctttcatgaagcttacattctaagtggacagattatagcataaacaaatgtgtaacgtggtatcatatagcaataaagactacgaaaacacacgaagccaggtaaaagtgaaggggtcctattttagataagatagtcaaggaaggccctcctgaggagataacatttgagcagaaacctgaatggagggaagaagacatgcaggcatctggagggagaagtttctaaggcagaggccctgagactggatgtgcttagtatgctcaaggagtagcaaggggagggtcag

SEQ ID NO: 36783 - DNA, 601 bp, Human
gagcagttttaaaaccaccaatctaatccaacctcttaattctgcagatgggaaacatcatgtgcataaaaactactaaggaacttgcccaaggccacaacaaaacccctaccaaaagtctgacttttcatcttctactctgatggtttttagatgtttattcaacacatatttactgtgtctaattatgccaggcactgttctagatgctagggctataggatgtgggtaaactaagtccctgctttcatgaagcttacattctaagtggacagattatagcataaacaaatgtgtaacrtggtatcatatagcaataaagactacgaaaacacacgaagccaggtaaaagtgaaggggtcctattttagataagatagtcaaggaaggccctcctgaggagataacatttgagcagaaacctgaatggagggaagaagacatgcaggcatctggagggagaagtttctaaggcagaggccctgagactggatgtgcttagtatgctcaaggagtagcaaggggagggtcagagtggccaaagcagaatatgaaaagtaagaaaaggtgaagggagaggtagccaagtactattacatca

SEQ ID NO: 36784 - DNA, 601 bp, Human
taaaaccaccaatctaatccaacctcttaattctgcagatgggaaacatcatgtgcataaaaactactaaggaacttgcccaaggccacaacaaaacccctaccaaaagtctgacttttcatcttctactctgatggtttttagatgtttattcaacacatatttactgtgtctaattatgccaggcactgttctagatgctagggctataggatgtgggtaaactaagtccctgctttcatgaagcttacattctaagtggacagattatagcataaacaaatgtgtaacgtggtatcakatagcaataaagactacgaaaacacacgaagccaggtaaaagtgaaggggtcctattttagataagatagtcaaggaaggccctcctgaggagataacatttgagcagaaacctgaatggagggaagaagacatgcaggcatctggagggagaagtttctaaggcagaggccctgagactggatgtgcttagtatgctcaaggagtagcaaggggagggtcagagtggccaaagcagaatatgaaaagtaagaaaaggtgaagggagaggtagccaagtactattacatcataaagggcc

SEQ ID NO: 36785 - DNA, 601 bp, Human
agcataaacaaatgtgtaacgtggtatcatatagcaataaagactacgaaaacacacgaagccaggtaaaagtgaaggggtcctattttagataagatagtcaaggaaggccctcctgaggagataacatttgagcagaaacctgaatggagggaagaagacatgcaggcatctggagggagaagtttctaaggcagaggccctgagactggatgtgcttagtatgctcaaggagtagcaaggggagggtcagagtggccaaagcagaatatgaaaagtaagaaaaggtgaagggagaggyagccaagtactattacatcataaagggccttctgactgctgtaaaaagcttttaacacaaatacgatggaaagccaccagagatgtatgagtggagacaggcacaatctgacttatatttgaaatggattgctctggcactgcggacagaaaactgtgtgtatgtgtgttcatctgtgttgcggagtagatgaggagaaacagcaagtagtggcagggagatcaactgggaggctactgaagccatccatagaagaaaagctggtggtctggacaaggtgttagttgaatgaaggaagga

SEQ ID NO: 36786 - DNA, 601 bp, Human
ttcatggggtaatactgggttgagttttggacacataagatttaagttgcctagcgaacatccagcatcagagccgctgagtgatggtgaggtgtatgagggtggagacataaatcatatgacggtatctaaagccatgagacaagatgacctggggagtaaacatcactgttcttctgctcacttcctctttcttacaggaagggcaaagccaggttctgtcaccacccttccactctcgggggacactagggggggaactcctcttgcatttggcattagggctgtagctgtttttttwaagtagataaataaaaagactgctaatactactatatccactttgaaatgccccaaagtaaaaatacaagcatctgaaaattttaccaacgatctccataggaagcctaaagcctcattcaaaaccattttgagggaacagtgcttcttataagaatgacttataccagctttaagttttgacagtccaaaaccttctttctatcccatgaaagtttggcaaagaggcttaccatatcttctcaccctgaaaaggagtccagatccacatttgttaagcaaaagtaaaatgaaaggatag

SEQ ID NO: 36787 - DNA, 601 bp, Human
taagatttaagttgcctagcgaacatccagcatcagagccgctgagtgatggtgaggtgtatgagggtggagacataaatcatatgacggtatctaaagccatgagacaagatgacctggggagtaaacatcactgttcttctgctcacttcctctttcttacaggaagggcaaagccaggttctgtcaccacccttccactctcgggggacactagggggggaactcctcttgcatttggcattagggctgtagctgttttttttaagtagataaataaaaagactgctaatactactayatccactttgaaatgccccaaagtaaaaatacaagcatctgaaaattttaccaacgatctccataggaagcctaaagcctcattcaaaaccattttgagggaacagtgcttcttataagaatgacttataccagctttaagttttgacagtccaaaaccttctttctatcccatgaaagtttggcaaagaggcttaccatatcttctcaccctgaaaaggagtccagatccacatttgttaagcaaaagtaaaatgaaaggatagaggctgatatcgacttgattcaagcaaaacttttc

SEQ ID NO: 36788 - DNA, 601 bp, Human
atgaggtcatgaggatggggcttccatgatgtaggattagtgtccttatgagaagagattggaactctcatattctttctctttcattctctcaacagaaacgtattttctcacagtcctggaggctggagtcagagatcagggtgccagcctggctgggttctggtgggggccctcttccaggcttgctcatgactgccttctctcactgtgtctctcccgttgtttgagccacaaaatctgtggtattttattatcacaacctgagctgcctagacaggatgttaagactagatgatcyggggatctcttttggctccaatattgcacaatttgatgtaatatttgataatttctgtctaattttgtaaaatttcatgctagcaatggaactaaagaagtctttgttttagaatatccttctgagagttaggaatgtagatccaggctccttggctgtttagcatctcaggctgcattgtgataaggaagcagacagaagaactggtatcaaagccaagtgtttatccaaattctacattaagaatataacgttttcagtgaaggtaagatttctaaagagaatttccataacataagc

SEQ ID NO: 36789 - DNA, 601 bp, Human
attacaccgtgaagaaaacaactgctggcatccccaagacacacaggcacacatatgtgcatgcagcagaggcaggaatgaaacagagctgactggtaagcagcattttactttctagggttgtctatgtgagaccactcaagagctcctgagtttatattctgcaactaaagctagtaaattaatttgatctcctttaggacctctgacctaaatatgtatttttaaaaaatgtataggtgatacataaaacttgaaaaaaatgacttataatcctaatgccctaacacaaacataaagaaaaaaaaaaaaactcatgaattctaggacgtgtctatagagaaacatacttttacaagatagattttatagttttctatctttttaaaacatataatattgcctcaaaaccagggatgaaacaaaatccttccaagaatgcaaaaataagattcctctaaggggtcagcaaaccttctcttaaaggatagatagaattttaggctttgtgggccataaggtctctgttgcaaaaggatggggaagaaacttttgaagatctggagaaaagatgaccccaacaagaaagctaaagccatca

SEQ ID NO: 36790 - DNA, 601 bp, Human
acacaggcacacatatgtgcatgcagcagaggcaggaatgaaacagagctgactggtaagcagcattttactttctagggttgtctatgtgagaccactcaagagctcctgagtttatattctgcaactaaagctagtaaattaatttgatctcctttaggacctctgacctaaatatgtatttttaaaaaatgtataggtgatacataaaacttgaaaaaaatgacttataatcctaatgccctaacacaaacataaagaaaaaaaaaaaaactcatgaattctaggacgtgtctatagrgaaacatacttttacaagatagattttatagttttctatctttttaaaacatataatattgcctcaaaaccagggatgaaacaaaatccttccaagaatgcaaaaataagattcctctaaggggtcagcaaaccttctcttaaaggatagatagaattttaggctttgtgggccataaggtctctgttgcaaaaggatggggaagaaacttttgaagatctggagaaaagatgaccccaacaagaaagctaaagccatcagttattttgtagtatttattaaaaaaagttagtggccagg

SEQ ID NO: 36791 - DNA, 601 bp, Human
aaagttagtggccaggcatggtggctcaggcctataatcctagcattttgggaggctgaggtaagcagactgtttgagcccaggagttcaagaccagccttggcaacatggcaaaaccccatctatattaaaaatacaaaaattagtcaggtgtggtggcgcatgtctgcagtccatgctactcaggaggctgaggtgggaggatcacctgagtcctggaggcagaagtagtagtgaaccaagatggtgtcactgtactccagcctgggcaacagagtgaggccctatctcaaaaaaaaawttttttttttcttaaaaagtactaaaagaaaggtgttggtttgcatgggatttagaaaatggaagctcaaaaaataaactgtggcaatatttattgagcaataatattaaaggagagaaactggctctggctggtgactggggggtgagctctaatgagaggctcagactcagactcagaagcttctatttaagaccaaacacattgatcaacttcctgattattaagtgcattttcccaggcaccttccaactatggtggggagacctggaaagcagaacatcctaataattggaagtg

SEQ ID NO: 36792 - DNA, 601 bp, Human
tttgcatttatacaaacaaaggtatatgatttgcttcagctaacatgtaaatcattaccaaaactttaatcctggtctttggtatttttactaagccagattcattataaacacatattaacttaccaatctgttgagcataatctcggctataataaaaaagcagttcattttcaggagggatatcttgtgaggtgcagaaaaagatttttccatcatgaggataagccaccaaattctgctcttcccggttcctgagttatcacatttaatagatcaagcacattaattttgaaatgcrtactaagtacaacattcccccattgcaaaatcctatatgaaagcttaggcagaactatttactatttcctctggaatgtttttgtaatttcccgtcctatctatgagaaggcagttgtagagaaacagaattcttacttcaacatattagctgatgaccttttgtagtcaaaaacactacagtctgttattggaagcaaacaagataaataaaatgaagtctttaaaaaacagtatgacaaagacatagagctagctagctaaacaagaattaactccagtaactcaggggtggactaac

SEQ ID NO: 36793 - DNA, 601 bp, Human
tccagcaatacataaagaccatcagagacctacagttagtgctcagtgaagagactgactttgtttttgattattcaacctttgcctggaaaagacaaaaaaccagtctacctgtccacctgtcttcatcacctatcacacagtaggcactgaatgactgaatgtccattaagggcagaggatcatcccttgtcatgattttcccacttgggcctagcattccaaatttaaagttcccaatgacagtggtaccttacctttccaaagatcacaagacccattttctccttacttcaatttygcaagcatcattcccaatagatatctatgtgaaaatgttgtatttctaacccctcattagaaaactagaaaaataggccaggtgcggtggctcacacctgtaatcccggcactttgggaggctgaggtgggcagatcacttgaggtcaggagtttaagaccagtctggccaacatggggaaaccccgtctctacaaaaatacaaaaattagctgggcatgatggcaagtgcctgtaaattcagctacttgggaggctgaggtgggagagtcacctgagcccaggaggtagaggtggcagt

SEQ ID NO: 36794 - DNA, 601 bp, Human
aaaaaccagtctacctgtccacctgtcttcatcacctatcacacagtaggcactgaatgactgaatgtccattaagggcagaggatcatcccttgtcatgattttcccacttgggcctagcattccaaatttaaagttcccaatgacagtggtaccttacctttccaaagatcacaagacccattttctccttacttcaatttcgcaagcatcattcccaatagatatctatgtgaaaatgttgtatttctaacccctcattagaaaactagaaaaataggccaggtgcggtggctcacasctgtaatcccggcactttgggaggctgaggtgggcagatcacttgaggtcaggagtttaagaccagtctggccaacatggggaaaccccgtctctacaaaaatacaaaaattagctgggcatgatggcaagtgcctgtaaattcagctacttgggaggctgaggtgggagagtcacctgagcccaggaggtagaggtggcagtaagctaagattgtaccattacactccagcctgggcaacagagcaagactccatctcaaggaaaaaaaaaaaagaaaactagaaaaataatcttagct

SEQ ID NO: 36795 - DNA, 601 bp, Human
gcatcattcccaatagatatctatgtgaaaatgttgtatttctaacccctcattagaaaactagaaaaataggccaggtgcggtggctcacacctgtaatcccggcactttgggaggctgaggtgggcagatcacttgaggtcaggagtttaagaccagtctggccaacatggggaaaccccgtctctacaaaaatacaaaaattagctgggcatgatggcaagtgcctgtaaattcagctacttgggaggctgaggtgggagagtcacctgagcccaggaggtagaggtggcagtaagcyaagattgtaccattacactccagcctgggcaacagagcaagactccatctcaaggaaaaaaaaaaaagaaaactagaaaaataatcttagcttcttattccagaattatttcctaagataaacatttgaggaatgttttaattacaaagtaagacttttatcatacaaacaaagtctgtggcctcagcagtcacaagtaattcaaatgcattaaatggttaaaataattggattaactcacaaaacagagacaaaaacagtttgtcctctatttccagtagctggtgttttgctgtatgt

SEQ ID NO: 36796 - DNA, 601 bp, Human
aaagcaagtccgcacaggaatggtttctccagtccatacacctgtcagtggaaggacaccaactacacaatcaatgatttaaacagcaagatacagaagaaagaggtgcttcacccatgcaaagaatcttattttcaatgaatttaaccaatatgtaggctgggcgtggtggctcacgcctgttatcccggcactttgggaggccgaggtgggcagatcacctgaggtcaggagtttgagatcagcttggccaacagggtgaaacccggtctctactaaaaatacaaaaattagctgggcrtggtggcgcacgcctgtagtcccagctacttgggaggctgaggcagaagaattgcttgaacccaggaggcggaggttgcagtgagcagagatagggccaatgcactccagcctgggtgacaaagcgagactctgtctcaaaaaaaataaaaaaataaaaaaaacaatatgctagcattcctcagaggtgactaagccttgtgggtcctagcctgtaaatatataaaatgtaatgaacagataacatagggctcacaataaatgctgagtaagaagaaatatcaggaattcctgaacctag

SEQ ID NO: 36797 - DNA, 601 bp, Human
tccgcacaggaatggtttctccagtccatacacctgtcagtggaaggacaccaactacacaatcaatgatttaaacagcaagatacagaagaaagaggtgcttcacccatgcaaagaatcttattttcaatgaatttaaccaatatgtaggctgggcgtggtggctcacgcctgttatcccggcactttgggaggccgaggtgggcagatcacctgaggtcaggagtttgagatcagcttggccaacagggtgaaacccggtctctactaaaaatacaaaaattagctgggcgtggtggcrcacgcctgtagtcccagctacttgggaggctgaggcagaagaattgcttgaacccaggaggcggaggttgcagtgagcagagatagggccaatgcactccagcctgggtgacaaagcgagactctgtctcaaaaaaaataaaaaaataaaaaaaacaatatgctagcattcctcagaggtgactaagccttgtgggtcctagcctgtaaatatataaaatgtaatgaacagataacatagggctcacaataaatgctgagtaagaagaaatatcaggaattcctgaacctagttttatcc

SEQ ID NO: 36798 - DNA, 601 bp, Human
aagtttgtagctcacacatataatgagccaacactttgggaggccaaggcaggactgcttgaggccaggagttcgaaaccagcctcggcaacatagtgagatgctgtctctacaaaaaaaattttttttttaattagctgggcatgattgcatatgcctgtagtcccagctacttggaaggttgcggcaggatgattgcttgagcccaggaggtcaaggctgcactcgagttactgtactccgtatgttaggccagtgcactccagcctgggcaacagagtgagacccagtctcttaaaawtaaataaataaaaaataacagaaaacattattctattgtaaaaatataaagcaattactatagaaataaatcagacttctaaaatcttttgtgcttaaagcactgctctattttacctaaactgtttgatgctttgaaatgactcacacccaaactgcagctaaaagaataatgaacctaattttatatttccaaagaaatgtcgcagtaactcagaagccatgctaaattcaaatatgggtaagtaaagtctggcaatctacattctttattccttttatctaaggagcattatataat

SEQ ID NO: 36799 - DNA, 601 bp, Human
agttactgtactccgtatgttaggccagtgcactccagcctgggcaacagagtgagacccagtctcttaaaaataaataaataaaaaataacagaaaacattattctattgtaaaaatataaagcaattactatagaaataaatcagacttctaaaatcttttgtgcttaaagcactgctctattttacctaaactgtttgatgctttgaaatgactcacacccaaactgcagctaaaagaataatgaacctaattttatatttccaaagaaatgtcgcagtaactcagaagccatgctamattcaaatatgggtaagtaaagtctggcaatctacattctttattccttttatctaaggagcattatataatttacaaacatttgatctaaagttgtgtcataaggtgaattttccatgtttctataaaagaaactaagttttaagaaatgtgttgttagaataattgttagtggatgagacagatgagaataaaagttaaatcttcaaagactcagtctaggattttttgctttactcaatactgattctaacaaaggagagatttcccaataaagtttttgacttgatttattgctat

SEQ ID NO: 36800 - DNA, 601 bp, Human
agaaacaacccaaatgtccatcaactgataaatggataaacaaaatgtggtatatccatattacagattattcagctctaaaaagaaatgaagtacaaatacatgctacaacatggatgagacagaacagtattatgcgaagagaaagaaactagatccagaaggccaagtatcgcatgattccatttatatgaaatatctggaaaaggcaaatccatagagacagaaagtagattagtggttgctgagaatacgcggaaggagggaatgggaagtgactaatggttatgaagtttctttmccgggtgactaaaatgttttggaaggagacagtggtggtggttgcacagccttgtaaatacaccaaaaaaaccactaaattgcacgtttaaaatgtatacataaattatatctcattataaaccacacacacttagaagaggttccatttgccctcttaagaaaaaaatcaataagcttatttaggccacctcctaccttctgctaaattagccttatattcattacattcttcgattaaaacattttaaaactctaaatttgagactttaaaaggttaaaactagtctctccatgggct

SEQ ID NO: 36801 - DNA, 601 bp, Human
tacagattattcagctctaaaaagaaatgaagtacaaatacatgctacaacatggatgagacagaacagtattatgcgaagagaaagaaactagatccagaaggccaagtatcgcatgattccatttatatgaaatatctggaaaaggcaaatccatagagacagaaagtagattagtggttgctgagaatacgcggaaggagggaatgggaagtgactaatggttatgaagtttctttaccgggtgactaaaatgttttggaaggagacagtggtggtggttgcacagccttgtaaatayaccaaaaaaaccactaaattgcacgtttaaaatgtatacataaattatatctcattataaaccacacacacttagaagaggttccatttgccctcttaagaaaaaaatcaataagcttatttaggccacctcctaccttctgctaaattagccttatattcattacattcttcgattaaaacattttaaaactctaaatttgagactttaaaaggttaaaactagtctctccatgggctggattttgtggcacagaatggttctgggcttcctcctatttttgatgctcccgttgagtct

SEQ ID NO: 36802 - DNA, 601 bp, Human
ctaaaatgttttggaaggagacagtggtggtggttgcacagccttgtaaatacaccaaaaaaaccactaaattgcacgtttaaaatgtatacataaattatatctcattataaaccacacacacttagaagaggttccatttgccctcttaagaaaaaaatcaataagcttatttaggccacctcctaccttctgctaaattagccttatattcattacattcttcgattaaaacattttaaaactctaaatttgagactttaaaaggttaaaactagtctctccatgggctggattttgwggcacagaatggttctgggcttcctcctatttttgatgctcccgttgagtctatttggaagctcctcttctgctatatcttgatatccctagccctcttctcagtccacactcttactagatgatttcattccacttctacagccacaaataacatcttaatgttgatgattcttaaatatttccagacagatctctctcaggtccacacacaacttttcattagacatctctactgggtgtcttacagacactgaaatcaacatgtctaaaacttgactcatcgtcactcctcccaaaa

SEQ ID NO: 36803 - DNA, 601 bp, Human
atgtatgttacttcccttggttaaatcttccccgacccttccatggcctggctagttgctccccttcaggctactttagtaccaatgcacttcaccccatcgtcacacttattattatcctatattgtaacagtctcctatgcttcctaccagactgtaagctccttaaaggtatgtacacatactgtctcttggtagatcgttctatccctagcatctagcagaggctgccacatagtaagcactaaaaagcccagcatgatggctcacacctgtaatcctagcactctgggaggctgargcaggaagattgcttgagtcgagttcaagaccagccaaggcaacacagtgagacccccatctctacaaaaaatttaaaaattagccaggtgtggtggtacacacttggggtcccagttgctcgggaggctaaagtgggaggatcacttgagcccaggaggtcgaggctacagtgagccgtgatcgcaccactgcaccctagcctgggcgacagagaaaccctatcaataaattaaaataagcactcaacatgtttcctgcatgaatgaaacacagtgacaccagtaaatcaactgttttt

SEQ ID NO: 36804 - DNA, 601 bp, Human
cttcccttggttaaatcttccccgacccttccatggcctggctagttgctccccttcaggctactttagtaccaatgcacttcaccccatcgtcacacttattattatcctatattgtaacagtctcctatgcttcctaccagactgtaagctccttaaaggtatgtacacatactgtctcttggtagatcgttctatccctagcatctagcagaggctgccacatagtaagcactaaaaagcccagcatgatggctcacacctgtaatcctagcactctgggaggctgaagcaggaagaytgcttgagtcgagttcaagaccagccaaggcaacacagtgagacccccatctctacaaaaaatttaaaaattagccaggtgtggtggtacacacttggggtcccagttgctcgggaggctaaagtgggaggatcacttgagcccaggaggtcgaggctacagtgagccgtgatcgcaccactgcaccctagcctgggcgacagagaaaccctatcaataaattaaaataagcactcaacatgtttcctgcatgaatgaaacacagtgacaccagtaaatcaactgtttttatattgtttt

SEQ ID NO: 36805 - DNA, 601 bp, Human
ccggagtgcagtactattcacaggtgtgatcgcagcatactatagcctgaaactcccgggctcaagcaaccctcttcctcagcctccagaatagctgggactattcacaggtgggatcacagaacactatagcctgaaactcctgggctcaagcaacctcctgcctctgcctccagaatagctgggactacaggcacacactaccgcatgtgctaagcttatctgcaaaatacaaaaatgactacttcacatttcatttcttcaggaggatgctctaagaaccaactaaatgtatgtatawcatttggcttacttgaagaaaaggcaccacattaatataaaggacaataccaaggcaaagaaaagttccaaggtctagttgctttctatactcccttaatgccaaactttacgacttaacttgttagggatggtggccctttttacaaatatttccaaaaaagaaaggctaaacacactcacaaattgtaaacaaggttgccatgttctccttgtttgaattggagtcttccatttgcagtgaaggtgatacaaaagaaagactgtctgaagatacatctacatgacctgtccccatagc

SEQ ID NO: 36806 - DNA, 601 bp, Human
ctattcacaggtgtgatcgcagcatactatagcctgaaactcccgggctcaagcaaccctcttcctcagcctccagaatagctgggactattcacaggtgggatcacagaacactatagcctgaaactcctgggctcaagcaacctcctgcctctgcctccagaatagctgggactacaggcacacactaccgcatgtgctaagcttatctgcaaaatacaaaaatgactacttcacatttcatttcttcaggaggatgctctaagaaccaactaaatgtatgtatatcatttggcttacytgaagaaaaggcaccacattaatataaaggacaataccaaggcaaagaaaagttccaaggtctagttgctttctatactcccttaatgccaaactttacgacttaacttgttagggatggtggccctttttacaaatatttccaaaaaagaaaggctaaacacactcacaaattgtaaacaaggttgccatgttctccttgtttgaattggagtcttccatttgcagtgaaggtgatacaaaagaaagactgtctgaagatacatctacatgacctgtccccatagcaacctcctgggtg

SEQ ID NO: 36807 - DNA, 601 bp, Human
agattctagggaggcaaggttgtgtgaggtagagagtgccacgcttacagagttggtgctcatggccacagtgtgaatggagtcactgagggcactgtcagacatgccattgacccgacttgcaatgtggtctgtctccatgaccacagggagctccaggccattcccatgcatgggtatcacaccaccatgtcctacagcgtctgctgcaaggttgttgctcacagaatccacagacagaggttcatgacttctggagccatttgggatttgggaatgctcgcctgcaacaccgtccatygtaagctcctctgccattccatctgtcgaaattgggctggtaaccctagaaacgttctccatagtgattgctgtgtccaaggccacctcatggccatcactgggatgaagactttgggcaccatgtgtgttcacagagcgagagtctattgaaacaatgcctggttctaatccaacatttccattggactgatagggatctagtgctgaagggttattggtgatagataatgctgtattaccatcaacatttatagagttagggtggatgtactgtggaggtggtctgtcagctaaataa

SEQ ID NO: 36808 - DNA, 601 bp, Human
catcactgggatgaagactttgggcaccatgtgtgttcacagagcgagagtctattgaaacaatgcctggttctaatccaacatttccattggactgatagggatctagtgctgaagggttattggtgatagataatgctgtattaccatcaacatttatagagttagggtggatgtactgtggaggtggtctgtcagctaaataagataaaatgcctgagaaaaggaaaagatgagatatcagagacttttagtacattattaaagaattccaagcactagacgctatttccttacaaayataactaagttcaaataatctcctgcttctttaatttaatcgatacacactattttataaatagcaacatacatataccgtaattgagtttttcctgtaaaactcgaaaatcctaaaaaagttaactatgttcctttgaagctaactgggaatcactaacgaaaacactgcttttaatatacatatggttgcaattcctgagtcctaaggtgtaaaatttgctctcctaattattaaaaggtaaaatgatttaaaaacagatcttccatgtgaaaaataaaacttaattaaatataattt

SEQ ID NO: 36809 - DNA, 601 bp, Human
aaatgcctgagaaaaggaaaagatgagatatcagagacttttagtacattattaaagaattccaagcactagacgctatttccttacaaacataactaagttcaaataatctcctgcttctttaatttaatcgatacacactattttataaatagcaacatacatataccgtaattgagtttttcctgtaaaactcgaaaatcctaaaaaagttaactatgttcctttgaagctaactgggaatcactaacgaaaacactgcttttaatatacatatggttgcaattcctgagtcctaagrtgtaaaatttgctctcctaattattaaaaggtaaaatgatttaaaaacagatcttccatgtgaaaaataaaacttaattaaatataatttaatataattaaactatcataacacaaactatttaatacaagtcacaattgtacctgttttattaaaacaaaaaaaaattaacacttgtgcttgggaggatatggtgaaatgatacttactaaactgccagagggaatgtaaactgctaaaacttctttgtgaagcatatatattaggagcctcaaaaatgttaataccctcttgcacaag

SEQ ID NO: 36810 - DNA, 601 bp, Human
aactcgaaaatcctaaaaaagttaactatgttcctttgaagctaactgggaatcactaacgaaaacactgcttttaatatacatatggttgcaattcctgagtcctaaggtgtaaaatttgctctcctaattattaaaaggtaaaatgatttaaaaacagatcttccatgtgaaaaataaaacttaattaaatataatttaatataattaaactatcataacacaaactatttaatacaagtcacaattgtacctgttttattaaaacaaaaaaaaattaacacttgtgcttgggaggatrtggtgaaatgatacttactaaactgccagagggaatgtaaactgctaaaacttctttgtgaagcatatatattaggagcctcaaaaatgttaataccctcttgcacaagaaattccacttaaggtactcttctctaaatccattttgtaaatattatacataaagacgttcataagagcattagttacaatggtaataaaaactggaaaaaccaaactgtccaacaataaagataataaaccatcaaatacccattcagtagaaagtaatgcatcattaaaaaggataattatgaaaacc

SEQ ID NO: 36811 - DNA, 601 bp, Human
ggaatcactaacgaaaacactgcttttaatatacatatggttgcaattcctgagtcctaaggtgtaaaatttgctctcctaattattaaaaggtaaaatgatttaaaaacagatcttccatgtgaaaaataaaacttaattaaatataatttaatataattaaactatcataacacaaactatttaatacaagtcacaattgtacctgttttattaaaacaaaaaaaaattaacacttgtgcttgggaggatatggtgaaatgatacttactaaactgccagagggaatgtaaactgctawaacttctttgtgaagcatatatattaggagcctcaaaaatgttaataccctcttgcacaagaaattccacttaaggtactcttctctaaatccattttgtaaatattatacataaagacgttcataagagcattagttacaatggtaataaaaactggaaaaaccaaactgtccaacaataaagataataaaccatcaaatacccattcagtagaaagtaatgcatcattaaaaaggataattatgaaaaccacgtagcagcaaaggaaaatacccatgtaacagcagagaaaaagataa

SEQ ID NO: 36812 - DNA, 601 bp, Human
aatcccggcactttgggatgctgacgtgggcggatggcttcagcgcaggagttcgagaccagcctcggcaacatgccaaaaccccatctctttttttaaaaaagttatttataaaaaagaaatgaaatatggtatggtctcaaggcaggcatgtgcctgtattccaagctactcaagagtctgaggtgagagaatcactggagtccaggagttccagtccagcctgggcaaaatagttgagactccgtctccattaaaagaaaaaaaaaaaaaagaaaagaaaaaagagagcaagagaagaaaccgtggtcttaattatgaaaattggtaaaaacctatacaccaaaacaaatggcaggaaggaagtacaccaaaaagatggatgatgggactgagtggttccttcccttatttgctaaattttccgcaataagcatataatactcctataacagaataaaaattcaatgaacttaaaaaacatgacactataacaagacactatagtgcttgactgaaattatagctgtagaattataaacaccaaatgaaagagatactggaggagaaagaagaaaaattatgtgcaattaagaaattc

SEQ ID NO: 36813 - DNA, 601 bp, Human
ctccattaaaagaaaaaaaaaaaaaagaaaagaaaaaagagagcaagagaagaaaccgtggtcttaattatgaaaattggtaaaaacctatacaccaaaacaaatggcaggaaggaagtacaccaaaaagatggatgatgggactgagtggttccttcccttatttgctaaattttccgcaataagcatataatactcctataacagaataaaaattcaatgaacttaaaaaacatgacactataacaagacactatagtgcttgactgaaattatagctgtagaattataaacaccaaaygaaagagatactggaggagaaagaagaaaaattatgtgcaattaagaaattcagcttagtcaaactgtattactaatgtgttatgtgccacattctaagaggaaaagtacataaatataaacaaagatacttttcctgcctagagattaatatctaatagtgacaaacagaaaaaagtgttattcatatcttcaggataaaagtttaaaagctggcgccgttctttttctctaacatctcaagtaactgtaacacttaccaggtagaatggttctgaaataactgctctccaggtgaggg

SEQ ID NO: 36814 - DNA, 601 bp, Human
aagtaactgtaacacttaccaggtagaatggttctgaaataactgctctccaggtgagggtaaggtggtggaggtagggtgtagtttctttcaggtaacccacacatcacccctcgatccccaatacccattggtagcattaaagacagagcagaaggcagagagctcagggagggacccaggtttggaattgccactgggaggcctacaaaacaaaattttttttctcagttaaaagaaaataggtaattaaaaattctcactacaaccactggctaaactcttagaaaggtttttacayatgggcaaaaatctcacctactagcccttttcatccttagataatgtgcaaatatccacaaataagcctaaagaaagtagtcttagtcccaaagatagtttttaagttagttctaaaccggcaagttgatactccaattgtctgtattgcgcttaaatacaaaaatatttaattaattaatttatcgattgatttgagacggagtcttgctttgttgcccaggctggagtgcagtggtgtgatctcagctcactgcaatctcggcctcctgggttcaagcaattctcctacctcagcctc

SEQ ID NO: 36815 - DNA, 601 bp, Human
gtgagaatatttcatttctacctggaaaacaacgtagtttagttagatgtaaaactgtacatgtacaccttcatacaatcttttgtatatatgctacacttagtgattaataaaagctttaaacgtgagattatatctactttgagttatatgtacttgcaaagtgaagtgacttttactgggctaagtatcataataaatacccaccaacttggtcagtgctgatttgcatatttttgccaggggcaatattttttttttttgagacaaggttttgctatgttgcccaggttggagcgtwgtagcatgaccatggctcaggcaacctgagctttcctggctcaagtggccatcccttctcagcctcctatgtagctcctacgtagctgggactacgggtgtgtgccaccatgcgctgctaatttttttttttttctttgtagagatggggtctccttatgttacctaggctgatcttgaactcctgggctcaagtgatcctcctgccttggcctctcaaaatgctgggattataggcgtgagccactgtgcctggctggcaatattttttaacaggcttttccaccttaacaagagtgtc

SEQ ID NO: 36816 - DNA, 601 bp, Human
ggtcgacaagagcgaaactccatctcaaaaaagaaaaaaaagaaaatgagccaggtgtaggggtgcatgcctataatcctagctactcaggaggctgaagcaggagaatcacttgaacccgggaggcggaggttgcagtgagccgagatcgtgcccctgcactccagcctggatgacagagtgagactccatttcaaaaaaaaaaggataggaagaatgaatttttcctatacgattttgctgtgtatggaggctcatgaggcgttccatgtaaaagccccaggtaaaagtaccacacttstttccacattaattctagacctggtacacttgcagttattgccatttaatttcaaacctggtggaatataaagcccaattccccatgctctctgggaatagttattagagtaattttaactgattctcttctattaacccagggaacgggtactgaagtgtgaaccagatgaatgggcagccctaaataaaatgccaagttaattacagctctggacaaaaagctaccaactcagaagaggactatcagaaaaaattgctgctactatccactagaattctaatactctacctctacaaa

SEQ ID NO: 36817 - DNA, 601 bp, Human
atgtgaaaagcatcgtattttccccattcagcaacagtttactaagattctgtatcagtatattaatgtcctccaaatattgagggtcattatgtaagctttgctaccacttcacttaaaatgacttcaaatcctcacaccaatactgcaacgtaagatagatgagggaactatggctcagagaggccatgtcatatgccccaaatcacatagctattaagtgaaagatcacagatcaaactgcaaaacactgccaaaaagtttttcattgcaccaaacttttttttaactgcaccaaactttttttttaactacagactatttttggcaaggtgaagaacctaggaatcaccttttctatgcaaaccatcttgcactgccattacaaatgtctttcgaataagagtaatactgatttgaataaaacagcactgaaggttgttatcaaaaagtattagttcttatatcataatttagagactgccatactataaacattacagaaccactaggctagccaacaggttacccaaaaggggctctctaatgacctccagtccttacactgggctttattctctgcgtatgggagggggtgaag

SEQ ID NO: 36818 - DNA, 601 bp, Human
taaggagagctgggatttaaattcagaactaatttaagaaaccaaagctcttaactatagtaagaaaaagacaattacaataaaagaactatattgccttttacacagttgcaatacattagggcctatctacttatattgtggcgtatatttaaagttccacatagacctgtttcttgcattattaggtttcacccttatccctggccatggatcccataaaactaagctctaagacatcaataaaatgtaaaaggccaacctagtaccttgtatagaacagacattctgaattttcttwttttatcggatggagctatgcaaactcatcacccttaccagaaagacagctagaagcacctggcaaatgaggtacaccttatgaagaacagcatgctaataacagtttttattatgctataaaataaagcagcccaggtgtggtgatttacacctgtaatcccacactttgggaggccaaggcagaaggatcgcttgagcccaggacttggagacgtccctaggcaacacagtgagacccctgtctctactaaacattttttttaacttagccaggcatggtggttcgtgcttgtggttc

SEQ ID NO: 36819 - DNA, 601 bp, Human
ccatggatgacccataaaaacatatgctaagtgcaagaagccagacacaaaaggccacagattgtatggttccatttatatgaactatccagaatatgtaaatccatagagacagaagcagattagtggttgccaggggctggaaggagaagggaatgggaattgactgctttatttgtaagaagtttcttgttgggttgatgataatagtctagaactatatagtggtgatggttgtgcaacattgtgaatgcactaaatgccactaaattgtatactttaaaatggttaaaatggtaaatttcatgttatgtgtattttgccagaataaaaataaatcctaatggtgcagaaattttccttatatttatagatgagagagtcacttactaatgcttgttatagctctacaaggagtcacagaaattttatttttcttgtggatattccttctatcatcaaatactgttgggctttcttcctcttggactcttagctctttcttttgagagcagagtctgtattctggtatcccacgtagaagattttcagtagaagttttctaagttgaataaatgttaattagttgtagagagacaaa

SEQ ID NO: 36820 - DNA, 601 bp, Human
atactgttgggctttcttcctcttggactcttagctctttcttttgagagcagagtctgtattctggtatcccacgtagaagattttcagtagaagttttctaagttgaataaatgttaattagttgtagagagacaaaaaagcactacagcagaaaagtgaggaggcagtgaaaacacgaagcctttgcacaagcttctgtctccctcacctcccagcctttaagtcatttctcacaggagatttaatctcctctttatgaggtacaaagtcctgtggttttgctgggttttttttttttggcatttcttttaatgaggaatggaagagaagagtgttaggaatttgggggaagtgaaaattaggagaaagagggaatgagatcagaaagtgttagttataggcactggaattaatagtgactattgatacccataaatgttctgtaaatttgacaattctgcagtataaaaagtcaagttagctaaggtaatgaaaataaatgtatcaccattttttccccacatttgtaagaaaataatctatggaaacctacttcaaaactctattctaatatttagagtaaattagtagaaatttg

SEQ ID NO: 36821 - DNA, 601 bp, Human
ggcactggaattaatagtgactattgatacccataaatgttctgtaaatttgacaattctgcagtataaaaagtcaagttagctaaggtaatgaaaataaatgtatcaccattttttccccacatttgtaagaaaataatctatggaaacctacttcaaaactctattctaatatttagagtaaattagtagaaatttggttacttatataatttaagaaactaaagaaaatatgtcaaatcaaaaacatcagtactaatatagcatatttcttatattagcaacatatactgatttttargatatactatgtttaagatgtacttgatgtgtttttttctcctgtaattttcattgtatcaatattatagtctaagtgaacagaatgctttcaaaacaggtgctgtagtcaactagtcacttttcattagtcactgtgaagaaatagaaacttagaatgtaaaataggggtttaattgggttttattaataacagaaagagttaggagaccatcactgtgtcattatgctaaccataaaaccatagtgagtgtcacagccacatatttcctatacatttaatttttttagcgatatgaag

SEQ ID NO: 36822 - DNA, 601 bp, Human
aaataggggtttaattgggttttattaataacagaaagagttaggagaccatcactgtgtcattatgctaaccataaaaccatagtgagtgtcacagccacatatttcctatacatttaatttttttagcgatatgaagagaaacatgttagtcttgtgtttcagtttcatttactcattccttagtgagaaacaatgcatctataggaaatataaatatgaagcagtatttaaaatttacaaaatggtaagtaatttgcttttatcttaaaaaaaaagcatttctagagaaaataacttwtatcccattgtttggctgatttatttgccaggaaaagttttaaaatgtgtcatgaatgttttgcctttatgtttatttgatgattgtaagcacattttagaacatggttgttacttcagaataatttaggacaccagaaagattagttgaggtcatgaaaggcctaccatgcttaaagactgagggcaagtaaaggaaatgaattagtcagttgacagtgagcttagttgcacatgctaacaatctaagagttcccaagggtcaaacaatacattttggtgtaatgcagatacataaaat

SEQ ID NO: 36823 - DNA, 601 bp, Human
ggtgacaatcaaaaatgtctccatactttgccatgtgttcctcagggagcaaaactgcctccagttgagaacactgggttatattagcagagtttgagcttgaaatctgtttctagtcatttccaactttccatttgtagattgtgaggacaatggaactttgccatccttacaattttatgtcagctgggagtagtgagaacactattatagctccaggttgggagaaatcacaaaggtcccctggcctactgtgaccactccagtagctgctcttacatggtgatttcccgccctgagytcctagatgggaaagaaatagagagaaagcaagcctgtgttgattctgaagtatcttttttctgtgtatattttgactaatcaatttttatttcattaaactttaagtcctcattgtttatttcatctaacatctttatttgcttgagatttttcaaaattaaagtgcactcagctagtaatcattactagcaaagggggaataattaggttagaatatttcaagtccgacattgtctttcaccattcagtgattaatctgcttcatactcacccattgtgatgggggggtttcagtagt

SEQ ID NO: 36824 - DNA, 601 bp, Human
agttatgaaccagccctaggcttagagtctacatgaggaattttgacatccattataatagggataaaagttgtgccatcgatgcatgaaaaattgaaccacagagtaaagctcctcacagtttgtgcatttgaactagcaggtttattgtacttgtatatttctttaataaatataataatttcactaaatgataattcaatttcaccagttgtttttaggttctaaatagagtgtggcaatattaaactgtatttaaagaccatcatagggtcctggtgatctaactcttgttcccatagcttagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaaggtttgttcttgcttcgttttcttccagttgcagtaagaaattctaagacagaaccacagattaatgttctccaacagaatacaaaatataactgactggagcaaaaaaattacctgaaaaaaattttgattgtttcaatgc

SEQ ID NO: 36825 - DNA, 601 bp, Human
tattgatctctggacgaatgcttcaaagcctgtgtgcttacagtgtgtgcggtgaccctctggggtgtgggtttcttatcagcatagaaaacctgctgctgtatgttaaacagaaatgtggattttttttatcccttactaatcctcagaataaaaaggagcctcagatctttattttctacctatttcttgataattctttgctttactcccttttatcctgctcttttccttttgttcttctactaccacagactgtgatagtgactagagcaatagtggtgctttctgaagggtcacrgtaaggatgttactaggtttttgatccttggttcttttgtggatagtcatgaagcttatgcatgggaagaatgatgaaagaagaagcaattgccgttgcttcccatatgccttcctgaaattaaccagggagctctccccttctttggtctaaggttgctgctggcctttcccacttggtttgtttttcagatagagatcaaggtgttgcttgctgaaactccagcagtttcgggcaagccacatagtatggtagcactctctgcttttcctgtgtggtactataaagactaacaataat

SEQ ID NO: 36826 - DNA, 601 bp, Human
aatcatttgtattttcttttttgagacagggtctcactctgttgcccaggctgggctgctgcccaggctggattgcagtggtgcaatctcagcttactgcaacctccacctcccaggttcaagtgattcttgtgcctcagcctcctgagtagttgggattacaggcatgtaccaccatgcctggctaatttttttggtatttttagtagagacagggttttgccatgttggccaggcttgtcttgaactcctgagctcaaatgatccacctgcctcggcctcccaaagtggctgggattasaggtgtgagccactgctgctggtctctcaattgtattttcatgtacaggtaataaacaattcaaatatgaagttaagaaaataatgttattcataataacatcaagcattaaatacatataaattaacaaaagtttaagactagtacactgaaaactataaaacattacttaaaaaataaattatgagacattccatgttcatggactggaagactcaatattgataaactggcaatactccaaattgatctatatatttaacataatctctatcaaaatcctagctggcttttttttcc

SEQ ID NO: 36827 - DNA, 601 bp, Human
acacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagwtttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaac

SEQ ID NO: 36828 - DNA, 601 bp, Human
cctggccccgggctgcctcctagtgttgaggctgaggaggcaccccttggcgggccagccaggaacccccaaaaagatccttcctgagtacccgtgacctgctttgaacccttattttgaactcaaaaaagaaagccaggtggcagccccccttctgtggcttctaggatgttccccttctagaacgttccagaggctccctgcagctgggttggaaggtttcctaagatccttataggttggggagtttggggtacagttagctttgtattttttaaacgttttttgggataaaattttwggttaaactttaagggttttttttggtttttattttttggtttttttttagaaagaaaatgagtgttgtatgtcttctctcagtaagcgaatggttttctcagaattaacaaggacatcaacacattttaagtggtttataataagacaacatgtttaattgttttgcaagtggagagaatgtacatattttaaatgatttatttaaaatcaattacaggaaccctccagctatccatgttagaattaaccacagaaaacatgactacgttattgaccattttcacttaaaaatacttta

SEQ ID NO: 36829 - DNA, 601 bp, Human
ggcgggccagccaggaacccccaaaaagatccttcctgagtacccgtgacctgctttgaacccttattttgaactcaaaaaagaaagccaggtggcagccccccttctgtggcttctaggatgttccccttctagaacgttccagaggctccctgcagctgggttggaaggtttcctaagatccttataggttggggagtttggggtacagttagctttgtattttttaaacgttttttgggataaaatttttggttaaactttaagggttttttttggtttttattttttggtttttttwtagaaagaaaatgagtgttgtatgtcttctctcagtaagcgaatggttttctcagaattaacaaggacatcaacacattttaagtggtttataataagacaacatgtttaattgttttgcaagtggagagaatgtacatattttaaatgatttatttaaaatcaattacaggaaccctccagctatccatgttagaattaaccacagaaaacatgactacgttattgaccattttcacttaaaaatactttattttgtttcctcgacttgctttcttggttgagcaaagtttttcagcct

SEQ ID NO: 36830 - DNA, 601 bp, Human
ttttattgcctttaccttgccaaaaaaaaggatttaggaagtttacgaaatacataccatacagagaggttatgtaaactagaagtaggtgtgaaagatgaggcaaaggaaaacaatgctagcaccaacagaatggagcaccagaagaggttagaattccaaatgcatgtgataaagtctcataattttgctaagaataggcaccatacttggagctaagctttctagcagtcagagggggagatgtcatgggtgcaattctcacatatgccacaaaagcaaaccacttgctcaggggaartataaccaatcctgataccagaccaaaataaaagtatcctgaacatagagcacatttaaggctttctcctgacagatcttctgcccctgctaaatcatgtgtccaaaaagggtaaaatcagcaaacagctttatcagaattcttgaacctagttataccggttttttccagcctctcatattttttaagagatacagaaacaaaatgaaaggaattttgagtctccttcatcactgttgttttatgatctatataagtaatataagctgtatacttttcagtcatgttttgaaagatgga

SEQ ID NO: 36831 - DNA, 601 bp, Human
tatattgtttggtgtttagaagttgtctttttcacttttttcctttgctttaaacaaaatgacaggtttgaagattctgtgggtcttcagatggtatcccattgcaccaccagaaagatcaaaagtgattcaccaaaatcagctcaaaaattttgtaagttaattgttcttagcttttggtaataaaggataaataaattttgttatcttctcaattttatttgttgctagttaaataattttacctgtttttaatagatcactttcatacataaaataaatttctataatttttcattgkcaataactatggaagtaggttatcaacataaacatttttcaaggtatatggttcagtgcataattatcctctcagttttgctatccatagagcaattaattttaactgattctgcaggtaattgttctgtacttaaccctcccattttggaaagataattttttaaatgttaactaaaattaagttaaaatccttgatagcagtatcttttgaatcagtaagagaaatgatgagtaacttgtttgttgaattttattttccagctctaatccttaaaatattgtccatgatttataaatt

SEQ ID NO: 36832 - DNA, 601 bp, Human
atacaaagagagcccacagtactaaacttagtacccctgttgggagaattgctgtgagtcatgtgccggttttcttactgaggggtaaagctgttttctactattttttaacagaggaagaagtctctgatgactggtatggtcaaagaaaaataaaaacagagggctttgtgataaactaaaaatgtggttattttgctttttatgtaagataaaaactttttttttaaaaggctgttgctgtgccatcgaatattcaaggaattcggagtatcctttaagtgggaaaactatttaaacktttggaatgttcattcattcattaattcctttggtaagccaagccttcataatgtgtaaggaacaagttaggccctgtagcagtcaagatgaacacaccatggtcccttctttagtactcttttaggagctcaccatctagtggaagagacagatatctgaatatatgaatagatgtgtttatatgtttgaaggtacaaactaaaatgttgtatctatagctgcttttgaattatctatatggcaccttaatttagttggtgattaaattgaaatactcttgctttcaatttatcagcct

SEQ ID NO: 36833 - DNA, 601 bp, Human
ctcttgctttcaatttatcagccttaacttcacagatttagttacagatgcaaagtttgtattaattgtagaaaaagatgcaacatttcagcggctcctagatgacaacttttgcaacaaattgtctccttgcatcatgattacggtatattatctaactttactacaattccaagactaatgtatactgttatggtgattggtaagaggatttacaatattatctacacaatgtcctgttttcaatataatgcatcctttgggatcatagaacgggaatttccaatgtgtttatttaaasatcctcaaagctggctatcacctcaagttcttttttttttaatagagacagggtctcgctctgttgcccaggccgaagtaccatggcatgatcatagagcactgtaaccttgataagttcatgtttctaaaaccacactcaaaagctttcttccttgaaaagctgagtgttcctgccacttgtcctgtggctatcagtgcagacactgcaatgaggtccacacgtcagagtcagtttgacttactcctcacatcccatggtcaccaagtccttttgaattggccttgggaatctctttca

SEQ ID NO: 36834 - DNA, 601 bp, Human
aataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggkgtccggtagtttcttcttacattttcctttgcctttatactttaggggtcttactccattaattcatttgttacattagtaaaattcagtatgaataaatatttggattgatgtagtcttcagtgttttgctttattttgtattgagcctattttttattgataatattatttatttgaaaagtttctcgaaggtcttgaatgcttctctagtctgtctatagaacaaaaaacttcttcagttttaagatctacagaagcctcagattttaataaggtacttctccaacagtaaatatgt

SEQ ID NO: 36835 - DNA, 601 bp, Human
tttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttrctccattaattcatttgttacattagtaaaattcagtatgaataaatatttggattgatgtagtcttcagtgttttgctttattttgtattgagcctattttttattgataatattatttatttgaaaagtttctcgaaggtcttgaatgcttctctagtctgtctatagaacaaaaaacttcttcagttttaagatctacagaagcctcagattttaataaggtacttctccaacagtaaatatgtgaccttttccctccataaacctatcttaattttgccagaggtcagttttatga

SEQ ID NO: 36836 - DNA, 601 bp, Human
tggtgctctgccttcttctgcagctcctgcaccaggccctccaggagctgggtggccttaatgttctcctgtggattatcaagatctactgagtccctaggggaaaaaaattacataatctgtatacatacatgcacgtgagcctgtataaatacagcctcaacacatcctactttttcttcaactaaagtgatgtttttaatcctcactgcaaattttaagaaacagcccaacagaaatggactcaatgcctatgttaatctatttgtaatttactaaatagttggattatacagtagatttccttcttttaaaaaaaaaaatttttaacaatgtgctgcccttcttcctttctctcaatgatgtgcttggtgcttatgctatttgctccgagaaatgcaaggaaaaggaaagggttctgtgtactctgaaggaaataaggacttggataatttcctatttatagttacccctcatgggtgtaaaggaggcacaaggccaagactcttctacatgtcctttccagcctcaaggagtttggtatctgtgggtttcttaggtagagacaggtgaaacaagttattgctatttctaagaagcc

SEQ ID NO: 36837 - DNA, 601 bp, Human
ggggtagcaggaaatagagaagtttgctaaaaatgtacgtcatttagaggaaatgttagctacataacacatacatgtaatcttctcggacgtatctctacaaaatgaaacaagatcaaactatcttcacagaaaacagttcctaagagaacttttttttttttttttgtgacggagttttgctcttgttgcccaggctggagtgcagtggcgtgatctcagctcactgcaatctcagctcactgcaatctctgcctcccaggttcaagggattctcctgcctcaggctctctagtggctgggattacaggtgcctgccaccacgcccggctaattttttgtatttttagtagagacagggtttcaccatgttggccaggctggtcttgaactcctgacctcaggtgatctgcccacctcggcctcttaaagtgcttggattacaggtgtgagccaccacaccaggcccaagaacttccttatattcctttgctgatgcccagaagaggccagaagggcaaacagggatctgacacaggaggcagaattctttttttcctgttgccaggacatgagacaagtagcagggaatgagaggaag

SEQ ID NO: 36838 - DNA, 601 bp, Human
tcccaggttcaagtgattctcctgagtagctgggattataggcacgtgccaccacgcctggctaatttttgtactttttagtagagatggggtttcactgtgttagccaggctggtcttgaactcttgacctcaagtgacctgactgcctcaacctaccaaagtgctgggattacaagcatgagccactgtgcttggcctctgttcatgtcttaagagaacctaagtgaaacagttctcagggtgaggtcagtccattttcagtttaccaacagtcaaaaagaagaagatgctatgtgataaaaaaaaaatattttgtaacataaagtacaccacacacacacacgcacacgcacacgcagagctgagggaaggctttaccttgacttgaaaaaccagctcatttccaccaacactgaactgggattcaaacaggattgtaaatttttcttctgtcaccgactctgccccacgacggtctgacctcttaattcgtttcagggactacaaagaagaaacataagatgaaacgtaagatataagttgttcccctcaaagaccagggaaaaattcattcttcctcttcttccaccctcaccata

SEQ ID NO: 36839 - DNA, 601 bp, Human
gacaatcacggttatatatcaattgcttggcagacagagtgacgaagactcactggagcacatgtgctttctcctccctttgtccttctcttattcaaacagccacatgtcaaagtccagccactcttaagacacatggccaacttccaggcttcacgaaactcactgcctttttgcacaaagtaaaaaccaccacagcttctgtctgtggcccctctgctacaactaaactctcagacagtgagagggagaaacaccataacgtgcaaacacgcacacacacacacacacacacacacamacaaacacatactcgcactcccttcgctggtgccaccatgcacagaaacactaaggtcacaactagtattaacacttcacattatgagtattgtttcaaaagagaagcgattcatggaattaaaacatccacaagagtgattcctctggtgaagatgaagaagctgaagatggagaggtcgcggggtcacgattgtgcgtgcgggatccactgactgtccattggccggcccaggagctcctccacacgccgcgctacgtccattgtgtcctccagatcgaagtccccatcggtgtcaag

SEQ ID NO: 36840 - DNA, 601 bp, Human
agcttttaggaagaagatatcttggtttcctctggaaaaatccttccatttctttaaacccaccacaagccactttgagggactgcctgagcgccccatgttcccctaccgacctcccctctttgccctcccactgactcccagacccccggtgggcgcaggtcggtactcacgctgctggggtggaggacgggcagaggcagcagcaggagcgggacgcagacgaccagcagcagcttccggactcggagcaggccctgcagcaggcccatcgcgcctctgtcctctccagctcgtcctyggaccccgctctgccggcgaaaggcttcctgcctgggcactgctctctatccagaaagacttcttaaacctttcttggcttccgagagtcctccttcgtcttgggggcagaacgggagggcagttataccctcgctgtttctacaagaggctgggctcctggcctcctgctttaggtgggattgatgagcatcgttttgtgaccagcaaaaaggaactgggaaaggatgataaacgggggcatagtgggcctcctctcggcttgattagtaatagagtaacttcattctaggtgccagca

SEQ ID NO: 36841 - DNA, 601 bp, Human
cctgatactgcttgggagaggaggctagtatgtctctcggtaacagtcccttatagcaacctacatggagaaaaaacaaaaacaagaaaagccacaaaaagaaaaaaaatcaggcccatttggacaaagcagaaaattgactagggtacagtccaggaagaatgtcagcagcaatcactgtctgctaatcccagcccagttttaatcagcgtctccctggcactctggagtatttattctatgaaagatttaagccagtttgtttttaagaagaaccatcctaatcccctctgtttaactktttaacttaatcttggttaccaagttacttaaggagcagagtggaagaattgctccccctcctacaaacgtgattaacctgttttagcttatttttcctaaagtctccagggcagtgccagctgggggaaggggacaagccacagacaggaggaagagaacagcggagggaagggaagcaggtgaccaccaggagggtgtgacaggcaagctggatgctgagccagagctgaggttcctctgttctcacaaaccaggtgaagaatgaggtcacgggctagagtttgggggctcttatctc

SEQ ID NO: 36842 - DNA, 601 bp, Human
agcctgggcaacatagtgaaacccccatttctacaaaaaaaatttttttaaaaattagctgcatgtggtggtacttgcttgcctgtagtcccagctactccagaggctgaggcacgaggattgcttaaccccaggagctcaaggctgcagtgagctacgattgtgccactgcactccggactgggtgacagagtgagactctgcgtctacaaaaaaaagtttgatgaaaggggtgacggatggatgaaactctacctgctgggcacctagtctgtgccttctgtgggcagtggccaaggtycccaaagatggggctgcctcaaccaggagatatgagaggttcctgatactgcttgggagaggaggctagtatgtctctcggtaacagtcccttatagcaacctacatggagaaaaaacaaaaacaagaaaagccacaaaaagaaaaaaaatcaggcccatttggacaaagcagaaaattgactagggtacagtccaggaagaatgtcagcagcaatcactgtctgctaatcccagcccagttttaatcagcgtctccctggcactctggagtatttattctatgaaagatttaagccagt

SEQ ID NO: 36843 - DNA, 601 bp, Human
caagaaaatccatttggaattttaagggttaaatatcagactctaaaagtttgatgcaggccaggcacggtggctcacacctgtaatctcaacactttgggaggatcacgtcagaccatgagtttgagaccagcctgggcaacatagtgaaacccccatttctacaaaaaaaatttttttaaaaattagctgcatgtggtggtacttgcttgcctgtagtcccagctactccagaggctgaggcacgaggattgcttaaccccaggagctcaaggctgcagtgagctacgattgtgccacygcactccggactgggtgacagagtgagactctgcgtctacaaaaaaaagtttgatgaaaggggtgacggatggatgaaactctacctgctgggcacctagtctgtgccttctgtgggcagtggccaaggtccccaaagatggggctgcctcaaccaggagatatgagaggttcctgatactgcttgggagaggaggctagtatgtctctcggtaacagtcccttatagcaacctacatggagaaaaaacaaaaacaagaaaagccacaaaaagaaaaaaaatcaggcccatttggacaaa

SEQ ID NO: 36844 - DNA, 601 bp, Human
tgtctgcccctcactggggacccttatttcttcctggaacccttagtctttcttgatctggtcattacagggctacaagttacaagttaaggggaaggaggtggggagagaaggtgcagagaaagggaaaggagaaagaggaaaagagcctgtaatcccagcactatgggaggccgaggtgggtggatcagttgaggtcaggagttcgagaccagcctggccaacatggcgaaaccctgtctctattaaaaatacaaaaaattcatccaggtgtggtggcacatgcctgtaatcctagctrctctggaggctgaggcaggagaatcccttgaacccgggaggcagaggttgcagtgagccaaggttgtgccactgcactccagagcctgagtgacagagtgagactctgtctcagaaaaaaaaaaaaaaaaaaaaaagaagaaaggagagagagagaaaagaaagaggactttccctctgccaggtgcctttagttttcaattaggagaatgtgggtaaaataaagcaaacattttggttgtaaatattgttagacatgcgactaggttactggaagaagtaagtcatcaggccaccttca

SEQ ID NO: 36845 - DNA, 601 bp, Human
gacattcaccagcattttccatagcccactcactttgctggctggacaacctaggggtgcacagggtaattaagtacaacattcttatcagaagccagccctccatcagcttgccctctagttgtgttgattgccctgaattatgctgatgaacgctgttaagacaggttaccgccttactctagggagaggctgcagttcatgggccttgttaatggtaacatcaccaagctccgtgactcagaagagcatttatagaaaatccaagttggctgtgggatcctcaatttttacatagttstaaaccatcaggactcgtgtctgatttgccctgaggctggctgctgatcaaggaacctgacaaatcttgctgtttatggccccttgagttcagaacacgcgtcctcaaactcttgcataaaagttacaaaaggtcgctgtatcagtaaggggcagcaggagtgattaaatcagctgggctggcaaggaccttgtgccctcctgacattcgtggattatgggattggggtttgagaaatgggaactgggcccaaaagttgactgtagctccccactgagatgttctctggggccaaaagat

SEQ ID NO: 36846 - DNA, 601 bp, Human
tgttttgcatctagagactgaatccttctcccaaaggcccctgtaagagttaataaggagctcccttccctgggagagggaagggaagactgaagaggaaggcagcgatcctgagcatggaactctcattttggatgaagaagcatcagctcctaactcagtgtttgtcaaccttcgtactactgacatttagggccacatagtttcttcttgcaggggggctgtcctgtgcactgtaaaagagcagcatccctggtctctacccactaaatgccggtagcacttcctccactgtgacaascaaaaaaccatctctagacattgccaaatgtcccttggggaggtaaaatgattcctggttgagagccactgccctaaccagggtctggttctcgttgctcttggactccattctatccgcttgacaccatggaaacatccatctacaaagactgaagacagccatctatctggaaggggaggcctggacattcaccagcattttccatagcccactcactttgctggctggacaacctaggggtgcacagggtaattaagtacaacattcttatcagaagccagccctccatcagcttgc

SEQ ID NO: 36847 - DNA, 601 bp, Human
gacacatgtgcctaagatatgaagatatgtggcattggtgtgtgcctgactgaagagaagtggatcagtaagaagtgagatttataaacaatccaaaaggtggcttctggactgtgctcttacagccctgggcatctggggtgtgtctcaagaatataccagggggatcagcaaggcctggaatctggaccccctctccagcctcatcccaaatggagtagctttgttctcatttgattcatatacgaacattacatgtgagatttgaaaaaaaaaaagctttattgctttaaaaatgaayaaacaaagttaaatccccctgttttagactatttgctgaaacaacttgattcagtagtaaattttaatcaaataaattattaggcaacttgaagaactggttgaccatttcccccttcaattttggatctgaggtcctaccatgttttgcatctagagactgaatccttctcccaaaggcccctgtaagagttaataaggagctcccttccctgggagagggaagggaagactgaagaggaaggcagcgatcctgagcatggaactctcattttggatgaagaagcatcagctcctaact

SEQ ID NO: 36848 - DNA, 601 bp, Human
ctgagatcagtcatcctgagtttgacacatgtgcctaagatatgaagatatgtggcattggtgtgtgcctgactgaagagaagtggatcagtaagaagtgagatttataaacaatccaaaaggtggcttctggactgtgctcttacagccctgggcatctggggtgtgtctcaagaatataccagggggatcagcaaggcctggaatctggaccccctctccagcctcatcccaaatggagtagctttgttctcatttgattcatatacgaacattacatgtgagatttgaaaaaaaaaaagctttattgctttaaaaatgaataaacaaagttaaatccccctgttttagactatttgctgaaacaacttgattcagtagtaaattttaatcaaataaattattaggcaacttgaagaactggttgaccatttcccccttcaattttggatctgaggtcctaccatgttttgcatctagagactgaatccttctcccaaaggcccctgtaagagttaataaggagctcccttccctgggagagggaagggaagactgaagaggaaggcagcgatcctgagcatggaactctcattttgga

SEQ ID NO: 36849 - DNA, 601 bp, Human
gggctggggcttgcacttgtaatcccaggactttgggaggccaaggtgggaggatcacttgagcccaggagtttgagaccagcctgggcaatatatagcaagaccccatctctaaaaaataaaatataaattagccaggtgtggtggcacaggcctgtagtcccagctacttgggaggctgatgccagaggatcacttgagcccaggggcttcaggctgcagtgagctatgatcatatgccattgcactccagcttggactacaggactatagagtacaatgctgtctcaaaaaaacaagcaaacaaacaaaaaaaacagttcgttcacatgtgagctctgagatcagtcatcctgagtttgacacatgtgcctaagatatgaagatatgtggcattggtgtgtgcctgactgaagagaagtggatcagtaagaagtgagatttataaacaatccaaaaggtggcttctggactgtgctcttacagccctgggcatctggggtgtgtctcaagaatataccagggggatcagcaaggcctggaatctggaccccctctccagcctcatcccaaatggagtagctttgttctcatttgattc

SEQ ID NO: 36850 - DNA, 601 bp, Human
ggggctggggcttgcacttgtaatcccaggactttgggaggccaaggtgggaggatcacttgagcccaggagtttgagaccagcctgggcaatatatagcaagaccccatctctaaaaaataaaatataaattagccaggtgtggtggcacaggcctgtagtcccagctacttgggaggctgatgccagaggatcacttgagcccaggggcttcaggctgcagtgagctatgatcatatgccattgcactccagcttggactacaggactatagagtacaatgctgtctcaaaaaaacaarcaaacaaacaaaaaaaacagttcgttcacatgtgagctctgagatcagtcatcctgagtttgacacatgtgcctaagatatgaagatatgtggcattggtgtgtgcctgactgaagagaagtggatcagtaagaagtgagatttataaacaatccaaaaggtggcttctggactgtgctcttacagccctgggcatctggggtgtgtctcaagaatataccagggggatcagcaaggcctggaatctggaccccctctccagcctcatcccaaatggagtagctttgttctcatttgatt

SEQ ID NO: 36851 - DNA, 601 bp, Human
tcctgttttacctgatgggcccctatatgttgtaagctgctgcccttgcagcctaggtcaatgggtaaattctttggataatgatagcaaggtcacaggtttaaatctctactccatgatcacaggccctctccctggacgggtcctatggctctggtgtcagcccgaccctttggtaaaaaaacagctgaagtggacatcccgcagtgacctgagaccactgtcctggtggcacactgggagctagaaggatgccctatgtcctggcatcccaaataagacttacatgcccggcttggcyccggccatcaagaccatgcgcagagcaatgcgcttatgcaggttccacttctccacggcagccgccacgcagatgacccccaccagcagcagcgtggtgttcttgaagtactccgccgccacctgtagggaggccaggcatgtcagtcaccctcccggaccaaagacccagggcccagcaccagctgggagaatgggccatacccaataaaacctgttctcaatcaaagaggctggcgaaggggaggcaggggggtgaggattattgaaatagccgcccatcctagagtcacatctactg

SEQ ID NO: 36852 - DNA, 601 bp, Human
actgtgtgcctgggaggttgagtgtaggggcaagattattactgagttagggggtggattaagctgtagttatcagacctgtttgacaatctgggagacaggaacatgcttttaagcataacctatagtcatctaaatgactcatactgagaaccaatactatattatttatttatactcgtgttgactcccataggagtcagggcagcttacataaaatacagcaagaaagttgtaaactagaaggaggtgagcaggatattccaaaagggaaggtacaggcaggggaatccaaatggarcattgctgaagctaacacaaaactcaaccttgacaccgtaacacattccccgagggtgggactccctcccgcatcacagtcaaatgcagtgtctctaactgggtctgtggtctgaactgatgacaaaaactcagggtggatgggaggaaacattcccgtctccttcagtgacaaaggagaagacagccacttccggtccagcctgttccctgatacacaggaaacaggttgggaaacaatttctcttggtccatcctgttttacctgatgggcccctatatgttgtaagctgctgccctt

SEQ ID NO: 36853 - DNA, 601 bp, Human
ccccaaagtcacagaagtgtcccgtgtcactgtgtgcacttttccagctgacatcttaaagcgtcaacacttggagaaaaacactaacaaggttaaccctctaattatttctctttggctttgagaacgttgtgcaatgtgtgcctgtacagacatgtcctagtttccataagataagccaacataaagactactgtgtttattattttaggtggaatcactgactttgcacaacttggggacagtacgtttatcatgtggactccattggctgacagcgacttgactttgccaattctgwacctacacgggtaactgcctctgggggtggcaacttgctgactgatgtaaatagggaggagtggaaatgtgagaggataaaaattcttgcagatagtacacagagattttaaagagccacagagtctccatatgatgtgacgaaatgccactgtgtgcctgggaggttgagtgtaggggcaagattattactgagttagggggtggattaagctgtagttatcagacctgtttgacaatctgggagacaggaacatgcttttaagcataacctatagtcatctaaatgactcatactgag

SEQ ID NO: 36854 - DNA, 601 bp, Human
ggggcagagcgtccacggaacacacatccctgcggctccacagtgggcctcctaccaacctgctggggctggtctagacagctgtggctggaaaggcaggcatttgtcctgcagggtgccattcagctctgtactcccaatgcttggcacagcgtaagtattaaagcaatacttcttgaatgaatgaatcacacttcatggactagcggccttagccagaaaaaagtccttagtgaagcaaagaatagctctggtagtagggccacagggtgtagacttaccattgtttttctgtctccayggacattggctggagcttggcggtgatgtgtgtttgtgtgtggaaggcaatactttgtttgccctcgcagccagcaattctgtgagcgccacggcactccttgctttgccgccaagtcaccatagatatcagtgacccaatagagatgaatgtttggagctcacagttccacccactacctgtcaacatgctgaaggcatagcccccaaagtcacagaagtgtcccgtgtcactgtgtgcacttttccagctgacatcttaaagcgtcaacacttggagaaaaacactaacaaggttaac

SEQ ID NO: 36855 - DNA, 601 bp, Human
cctcccccgacttactttcaccttctttcttctgcaggcctagggtgaggggtgggtgggtatgggagaagctttggctgagaagttgaagttttgatttgaatttggactagtctcccaaatgtctgaacatgagattgttataatacctgaaaggaaccaggagagctacgggatttgcctgggatatcatcaagggtgatgtcatcaagaaatccaatatgctatgattgaagatagtggtggagaaaaataaagcgatttcctgatggcacccttccacgtctgtcccactgtgaaygctgatttcacccaatgtgcgttctccttttttacaacaagggcaaatgacagagctgagctgtattacaaatccagcttttaaatgtggactattcattgtggcatgcctgtgggccacattttgaaatagaatctccaaatggaatcagctgttaatagagcttcctccaggaatgtctgaggctgcttctccttttccagctctgcttcccatcatcacaaggccctctcacctcctgtcccctcatcccctacctgtcacctaagttttctttgccatatctaacaagaccaaatc

SEQ ID NO: 36856 - DNA, 601 bp, Human
gaggtgacaggagcagggagggcctggattgtactcagggaaagtcaagggagagggagagggtggcggagggggaggacttctgatcagcaagtacacctcagggggtgagtctctcccacccctgctggtccccaacctttgccttgaggacagaagaagatgagaacttagccatcagtgtaactgacacactgagtgatcagtgaatgtttccagtttgtcttagttgcgaggacagtgggagccaccagctcagccactgtgaagacagagagcgtattgggcacacacatgcggkatgtgggtcctgcggccatggtccctcttcaggctctgtcagggaaggataagaagctgacaggcgtgcagagggaagtgttctttggagtgagttcttagcctgggaggagaatgtgctgtgatgtttcccttcccttcttcccaaactgggtgaggagggtaggcgaggatcctcaggtagcatgggaggtggtggccgcaagagtgctgtctgcacacccagcaaatgacccagttcccaccagcacaaaagatgcttagagttctagggacaactcaggcttttcttttggagttt

SEQ ID NO: 36857 - DNA, 601 bp, Human
gggcaggggcagcactttcctttgatattaacaatcgtcctaacagcagatgtggagtggatattagatacagagtgcacatatatgggctttaacccccagacattgttaatcctcatcacagatctatggtcctggcattcatacctccatttacaccagtacttagcacggggatgctaagtggcagaggagggtaggagtccaggagtctgtctctctggaaagcctatgccccctgaccatgttctcactggctgactctcatgttctcactggctgactctcatgttctcactgrctgactctgggaagaccactatctagaaaggggaacttgtgatatgcgtatcggaggtgacaggagcagggagggcctggattgtactcagggaaagtcaagggagagggagagggtggcggagggggaggacttctgatcagcaagtacacctcagggggtgagtctctcccacccctgctggtccccaacctttgccttgaggacagaagaagatgagaacttagccatcagtgtaactgacacactgagtgatcagtgaatgtttccagtttgtcttagttgcgaggacagtgggag

SEQ ID NO: 36858 - DNA, 601 bp, Human
cagaagccacgtcagtgaggccgactcttgggaggggaggtccccctgcatcaggcgtttggtgtaagggacttaaactctctggattccagttttctagtctccagagaagactaatctctcccttgtcttccttgccttctgagatgctgtaaggattagtggggccaggggcctgcttccttctgagggcaggggcagcactttcctttgatattaacaatcgtcctaacagcagatgtggagtggatattagatacagagtgcacatatatgggctttaacccccagacattgttartcctcatcacagatctatggtcctggcattcatacctccatttacaccagtacttagcacggggatgctaagtggcagaggagggtaggagtccaggagtctgtctctctggaaagcctatgccccctgaccatgttctcactggctgactctcatgttctcactggctgactctcatgttctcactggctgactctgggaagaccactatctagaaaggggaacttgtgatatgcgtatcggaggtgacaggagcagggagggcctggattgtactcagggaaagtcaagggagaggga

SEQ ID NO: 36859 - DNA, 601 bp, Human
tcaagtggtcctcctgctgtggcctcccaaagtgctgggagtacaggcatgagccaccacgcccagccaatgtgtcctttttaataataacattttgtcaatggaatcctcactgaagggaactctaaggtggatctgtggctgttgaaaatctggttctgaatcttgggtttccatgaagaagtgctgagggattttcaagtgattccaaagcacagaaaaaccccaaggccatacctcgttgtgcatcagagtggtgaggtctgcgttggacctgctggaaccaagcagaggacacagragccacgtcagtgaggccgactcttgggaggggaggtccccctgcatcaggcgtttggtgtaagggacttaaactctctggattccagttttctagtctccagagaagactaatctctcccttgtcttccttgccttctgagatgctgtaaggattagtggggccaggggcctgcttccttctgagggcaggggcagcactttcctttgatattaacaatcgtcctaacagcagatgtggagtggatattagatacagagtgcacatatatgggctttaacccccagacattgttaatcc

SEQ ID NO: 36860 - DNA, 601 bp, Human
ctcactgcaacctctgcctcccaggttcaagtgattctcccgcctcagcctcccaagtagtggggattaccggtgcccatcaccactcccagctaatttttgtatttttagtacaggcggggtttcaccatgttggccaggctggtcttgaactcctggcctcaagtggtcctcctgctgtggcctcccaaagtgctgggagtacaggcatgagccaccacgcccagccaatgtgtcctttttaataataacattttgtcaatggaatcctcactgaagggaactctaaggtggatctgtrgctgttgaaaatctggttctgaatcttgggtttccatgaagaagtgctgagggattttcaagtgattccaaagcacagaaaaaccccaaggccatacctcgttgtgcatcagagtggtgaggtctgcgttggacctgctggaaccaagcagaggacacagaagccacgtcagtgaggccgactcttgggaggggaggtccccctgcatcaggcgtttggtgtaagggacttaaactctctggattccagttttctagtctccagagaagactaatctctcccttgtcttccttgccttct

SEQ ID NO: 36861 - DNA, 601 bp, Human
aagtgcagtggcacgatctgggctcactgcaacctctgcctcccaggttcaagtgattctcccgcctcagcctcccaagtagtggggattaccggtgcccatcaccactcccagctaatttttgtatttttagtacaggcggggtttcaccatgttggccaggctggtcttgaactcctggcctcaagtggtcctcctgctgtggcctcccaaagtgctgggagtacaggcatgagccaccacgcccagccaatgtgtcctttttaataataacattttgtcaatggaatcctcactgaarggaactctaaggtggatctgtggctgttgaaaatctggttctgaatcttgggtttccatgaagaagtgctgagggattttcaagtgattccaaagcacagaaaaaccccaaggccatacctcgttgtgcatcagagtggtgaggtctgcgttggacctgctggaaccaagcagaggacacagaagccacgtcagtgaggccgactcttgggaggggaggtccccctgcatcaggcgtttggtgtaagggacttaaactctctggattccagttttctagtctccagagaagactaatctc

SEQ ID NO: 36862 - DNA, 601 bp, Human
cctcagcctccccagtagctggaagtacacgtgcacatcattgtacccagctgaagtccaatgtttaattggccttttatacttctcatgaaaagatgtataaccagatttgggggaggtgaaataagttcgagtaactgtgtgcaggtaaactctgctttcccctgtaaatgtgttctttttatttttatttatttttattttttgagatgggggtctcgctctgttgcccaggctgaagtgcagtggcacgatctgggctcactgcaacctctgcctcccaggttcaagtgattctccmgcctcagcctcccaagtagtggggattaccggtgcccatcaccactcccagctaatttttgtatttttagtacaggcggggtttcaccatgttggccaggctggtcttgaactcctggcctcaagtggtcctcctgctgtggcctcccaaagtgctgggagtacaggcatgagccaccacgcccagccaatgtgtcctttttaataataacattttgtcaatggaatcctcactgaagggaactctaaggtggatctgtggctgttgaaaatctggttctgaatcttgggtttccatgaa

SEQ ID NO: 36863 - DNA, 601 bp, Human
tattaggaagaggaagtggtgagccaggtgcctcgagaaggaccacctagtcatcccagggccaccccatgcctcagcactgtgggaaccagaggccagaagccagggggagcatatacaccagggcacctcagccaggcctgccccgcccagcctggtgtcaagctctccacttgaagaggctttgaaactaggcagaacatggctctgcccttacaggagagccagcctttctgggactttattagctaatgaagaaccctttatatataagatgaaaaaaaagaaaataaaaaaaaaataatcacaagcaagtccacagttttttgtttgttttagagacagggtctcactgtgttgtccaggctggggtcaaactcctgggccacagcgatcctcctgcctcagcctccccagtagctggaagtacacgtgcacatcattgtacccagctgaagtccaatgtttaattggccttttatacttctcatgaaaagatgtataaccagatttgggggaggtgaaataagttcgagtaactgtgtgcaggtaaactctgctttcccctgtaaatgtgttctttttatttttatttattttt

SEQ ID NO: 36864 - DNA, 601 bp, Human
gccctggtgttggtttgcagttttgatggggttggtgatcgagggcacaccattcaggttctgttgggacaaaggccatctcactattaggaagaggaagtggtgagccaggtgcctcgagaaggaccacctagtcatcccagggccaccccatgcctcagcactgtgggaaccagaggccagaagccagggggagcatatacaccagggcacctcagccaggcctgccccgcccagcctggtgtcaagctctccacttgaagaggctttgaaactaggcagaacatggctctgcccttasaggagagccagcctttctgggactttattagctaatgaagaaccctttatatataagatgaaaaaaaagaaaataaaaaaaaaataatcacaagcaagtccacagttttttgtttgttttagagacagggtctcactgtgttgtccaggctggggtcaaactcctgggccacagcgatcctcctgcctcagcctccccagtagctggaagtacacgtgcacatcattgtacccagctgaagtccaatgtttaattggccttttatacttctcatgaaaagatgtataaccagatttgggg

SEQ ID NO: 36865 - DNA, 601 bp, Human
aaacagagctagaaggggccgttctattacctgggatgggtgttgcttcttgccctggtgttggtttgcagttttgatggggttggtgatcgagggcacaccattcaggttctgttgggacaaaggccatctcactattaggaagaggaagtggtgagccaggtgcctcgagaaggaccacctagtcatcccagggccaccccatgcctcagcactgtgggaaccagaggccagaagccagggggagcatatacaccagggcacctcagccaggcctgccccgcccagcctggtgtcaagytctccacttgaagaggctttgaaactaggcagaacatggctctgcccttacaggagagccagcctttctgggactttattagctaatgaagaaccctttatatataagatgaaaaaaaagaaaataaaaaaaaaataatcacaagcaagtccacagttttttgtttgttttagagacagggtctcactgtgttgtccaggctggggtcaaactcctgggccacagcgatcctcctgcctcagcctccccagtagctggaagtacacgtgcacatcattgtacccagctgaagtccaatgt

SEQ ID NO: 36866 - DNA, 601 bp, Human
tgcatccaattttgtaattggaagtatattgatgggttaattgcatgtggtcaaggagacttggatttgaatcagaatgctcccctatctagttccttggtcttgggttatgatttcatctctgccttgtttgcaaaaatggagctcaaaatcgctacctcattgagccaagaccatagaaaaaatgctgagtgcaatgattgatacataataagcatttaataaatggtggcagttatttatgatgatggatattaaacaagtgagactgttttgatgaacacagacatttgaaatcaasggtcgtaagtgacagttgctattttatacaagcctcaacattcattcgacttctgcattttgtttcagaggaatcgtgccaggaagacaattattagttcagaaaagcaggtgccttacaatcttaggatactcaaataaaatatttgcagtgtccctgaagcacctttgaagactagtttgaggacctctgatctacaccaaaccccagcttttatcgttgaagacactggggctcaggcagtggactgtcttgctacagtcaagtgagcttgatgtctcacctccatggcgcacacag

SEQ ID NO: 36867 - DNA, 601 bp, Human
aagtccctcctgttcccttcacacctggccaccttcactgattcttcatgagactaggaaagtcctggtgcaattgtcagcaagtcaggtcatgaaagaaccaatggggaagcgccaccttgccacatctctcaaagccctttcccactgccccatcttcctagtggggccgaagtatggctgaccctccagacctctaaaagatccattgattaacagagctggaagagacctcaaagattctttggtccagtggttttccacaatcctttcttctactgaaattttacacagaatagtwtaagtgtagcaattggatacatccttatttttttgaggcagggtttcactctgttgcccaggctagagtgcagtggtgccatcatagctcactgcagccctgacctcctgggctcaagtgatcctcctacctcagcctcctgagtagctgggactacaggcatgcaccaccatgccagctaatgattttacttttatttttagtagagacgagatctggctgtgtttcccaggctggtcttgaattcctgagctcaagtatcctcctgtcttggtctcccaaagtgctgaaccaccgcac

SEQ ID NO: 36868 - DNA, 601 bp, Human
ccaacccagcttgggctgtctggccgaagcatgagaggcaggaggcaccatggtacagcggaaagggtttgagcttgggtgtcagaaagacaaatcacagtttctaccatttgtcaacttgggcatgcatctgagctgcagtttcttctttgtaaaatggtggaaaccatattttctctgctgaattgttgtgaagagtaaatgaagtaatatatgtaaagcgcttagaacacttcctggcatttaatgaatggtaggctattattatttttgtgattaatgttattattgacagcatggstttttatttgaactcctgtaaaactggtgtcactctacattgtgtttgaataacaaacagatgttattcctgtagagttagaatgacaggatttggccttcccctcaggccctttctaatcctaccaagacccatcaagctacctctgaatatctctcaaatctggccattcaagtccatcaaaccctgatggagagatgactaaaaaatacacctggattacataaaaaccctagtcttcattgggaagagggttgaagtgtgattatttcctccttcccttcctcattcttttctcct

SEQ ID NO: 36869 - DNA, 601 bp, Human
aggtggcctggctttggaaggaattcacattttccaagagggtggctgtgctgtctttcccttcttctgcctctgtctgctccatggtcagcactccaccccatgccatggctataccctggactctgaatagagcaaaggggaagggtggccacctgaaatctgggccagcttggctttggcactaaatagcatcttctaaaggcctgattcagagttgtggaaaattctcccagtgtcagggattgtcaggaacagggctgctcctgtgctcactttacctgctgtgtttctgctggaraaggagggaagaggaatggctgatttttacctaatgtctcccagtttttcatattcttcttggatcctcttctctgacaactgttcccttttggtcttcttcttcttgctcagagagcaggtctctttaaaactgagaagggagaatgagcaaatgattaaagaaaacacacttctgaggcccagagatcaaatattaggtaaatactaaaccgcttgcctgctgtggtcacttttctcctctttcacatgctctatccctctatcccccacctattcatatggcttttatctgccaagt

SEQ ID NO: 36870 - DNA, 601 bp, Human
catgaggtcaggagatggagaccatcctggctaacacagtgaaaccccatctctactaaaaatgcaaaaaattagctgggcgtggtgtcacgtgcctgtagtcccagttactcgggaggctgaggcaggagaatcgcttgaacccaggaggtggaggtttcagcgagccaagattgtgccactgcactccagactgggcaaaagggtgagactccatcccaaaaaaaaaaaaaaaaaaaaaaaaatagttggtcattcccatcatctaaccagaaatgcatactgagacattaattacctrttaaaaaatggaagcatcctctatatccaatggtatttcatgacactgaatacattttgatacaactctgtgttaaaatgagatgcatccattgataatcccatttccacagcagagttaaggatgtggaacatactgtactgagagtacaaagttgagttgagaaaggcaaggtatacaacagtttcagtgtggactgaattttaccaaaaatacataagagttttgcacaaaaaagcatggaaagaagtgttaacatttgttaacatggggtgctaagaatccagtcaattttgattt

SEQ ID NO: 36871 - DNA, 601 bp, Human
ctggctagagtagatgtcttaatgtgaatttgtgagcccgttaattggggcaagtcctagatggagtgatcaggagtggagttggttagataaaggagaatagaagaggatgagacctctttcctatgaaggccacacctccatgtgcctcccttctcaagtgagaagttgatttcttctttacagttggtactttatagatgtttcctcctttaactttcataaccacctatgaggtaaccaagcttccaagagcttatgtaatgagactacatgcagcactggattccaaccccagacygggactccaaagagtgtttttccttcctgatttcacactgcagcctccctaaaaagagtggatttcctggggaatgaaatcttcctggcttcatatctgcccctgagagtctatgaagtcttgcctgaagaattggggtgagggggttgttcttaaggaggaaatgatatcacttacttttcaaagaaagaatcccagccagggacaaagccaggctcccgggtaaaccacagtacggtcatcaggatgaagaaaaatccagtcaccatttctgggtagctataaaataaaacagaaaga

SEQ ID NO: 36872 - DNA, 601 bp, Human; identical to SEQ ID NO: 19058

SEQ ID NO: 36873 - DNA, 601 bp, Human; identical to SEQ ID NO: 19059

SEQ ID NO: 36874 - DNA, 601 bp, Human; identical to SEQ ID NO: 19060

SEQ ID NO: 36875 - DNA, 601 bp, Human; identical to SEQ ID NO: 19061

SEQ ID NO: 36876 - DNA, 601 bp, Human; identical to SEQ ID NO: 19062

SEQ ID NO: 36877 - DNA, 601 bp, Human; identical to SEQ ID NO: 19063

SEQ ID NO: 36878 - DNA, 601 bp, Human; identical to SEQ ID NO: 19064

SEQ ID NO: 36879 - DNA, 601 bp, Human; identical to SEQ ID NO: 19065

SEQ ID NO: 36880 - DNA, 601 bp, Human; identical to SEQ ID NO: 19066

SEQ ID NO: 36881 - DNA, 601 bp, Human; identical to SEQ ID NO: 19067

SEQ ID NO: 36882 - DNA, 601 bp, Human; identical to SEQ ID NO: 19068

SEQ ID NO: 36883 - DNA, 601 bp, Human; identical to SEQ ID NO: 19069

SEQ ID NO: 36884 - DNA, 601 bp, Human; identical to SEQ ID NO: 19070

SEQ ID NO: 36885 - DNA, 601 bp, Human; identical to SEQ ID NO: 19071

SEQ ID NO: 36886 - DNA, 601 bp, Human; identical to SEQ ID NO: 19072

SEQ ID NO: 36887 - DNA, 601 bp, Human; identical to SEQ ID NO: 19073

SEQ ID NO: 36888 - DNA, 601 bp, Human; identical to SEQ ID NO: 19074

SEQ ID NO: 36889 - DNA, 601 bp, Human; identical to SEQ ID NO: 19075

SEQ ID NO: 36890 - DNA, 601 bp, Human; identical to SEQ ID NO: 19076

SEQ ID NO: 36891 - DNA, 601 bp, Human; identical to SEQ ID NO: 19077

SEQ ID NO: 36892 - DNA, 601 bp, Human; identical to SEQ ID NO: 19078

SEQ ID NO: 36893 - DNA, 601 bp, Human; identical to SEQ ID NO: 19079

SEQ ID NO: 36894 - DNA, 601 bp, Human; identical to SEQ ID NO: 19080

SEQ ID NO: 36895 - DNA, 601 bp, Human; identical to SEQ ID NO: 19081

SEQ ID NO: 36896 - DNA, 601 bp, Human; identical to SEQ ID NO: 19082

SEQ ID NO: 36897 - DNA, 601 bp, Human; identical to SEQ ID NO: 19083

SEQ ID NO: 36898 - DNA, 601 bp, Human; identical to SEQ ID NO: 19084

SEQ ID NO: 36899 - DNA, 601 bp, Human; identical to SEQ ID NO: 19085

SEQ ID NO: 36900 - DNA, 601 bp, Human; identical to SEQ ID NO: 19086

SEQ ID NO: 36901 - DNA, 601 bp, Human; identical to SEQ ID NO: 19087

SEQ ID NO: 36902 - DNA, 601 bp, Human; identical to SEQ ID NO: 19088

SEQ ID NO: 36903 - DNA, 601 bp, Human; identical to SEQ ID NO: 19089

SEQ ID NO: 36904 - DNA, 601 bp, Human; identical to SEQ ID NO: 19090

SEQ ID NO: 36905 - DNA, 601 bp, Human; identical to SEQ ID NO: 19091

SEQ ID NO: 36906 - DNA, 601 bp, Human; identical to SEQ ID NO: 19092

SEQ ID NO: 36907 - DNA, 601 bp, Human; identical to SEQ ID NO: 19093

SEQ ID NO: 36908 - DNA, 601 bp, Human; identical to SEQ ID NO: 19094

SEQ ID NO: 36909 - DNA, 601 bp, Human; identical to SEQ ID NO: 19095

SEQ ID NO: 36910 - DNA, 601 bp, Human; identical to SEQ ID NO: 19096

SEQ ID NO: 36911 - DNA, 601 bp, Human; identical to SEQ ID NO: 19097

SEQ ID NO: 36912 - DNA, 601 bp, Human; identical to SEQ ID NO: 20977

SEQ ID NO: 36913 - DNA, 601 bp, Human; identical to SEQ ID NO: 20978

SEQ ID NO: 36914 - DNA, 601 bp, Human; identical to SEQ ID NO: 20979

SEQ ID NO: 36915 - DNA, 601 bp, Human; identical to SEQ ID NO: 20980

SEQ ID NO: 36916 - DNA, 601 bp, Human; identical to SEQ ID NO: 20981

SEQ ID NO: 36917 - DNA, 601 bp, Human; identical to SEQ ID NO: 20982

SEQ ID NO: 36918 - DNA, 601 bp, Human; identical to SEQ ID NO: 20983

SEQ ID NO: 36919 - DNA, 601 bp, Human; identical to SEQ ID NO: 20984

SEQ ID NO: 36920 - DNA, 601 bp, Human; identical to SEQ ID NO: 20985

SEQ ID NO: 36921 - DNA, 601 bp, Human; identical to SEQ ID NO: 20986

SEQ ID NO: 36922 - DNA, 601 bp, Human; identical to SEQ ID NO: 20987

SEQ ID NO: 36923 - DNA, 601 bp, Human; identical to SEQ ID NO: 20988

SEQ ID NO: 36924 - DNA, 601 bp, Human; identical to SEQ ID NO: 20989

SEQ ID NO: 36925 - DNA, 601 bp, Human; identical to SEQ ID NO: 20990

SEQ ID NO: 36926 - DNA, 601 bp, Human; identical to SEQ ID NO: 20991

SEQ ID NO: 36927 - DNA, 601 bp, Human; identical to SEQ ID NO: 20992

SEQ ID NO: 36928 - DNA, 601 bp, Human; identical to SEQ ID NO: 20993

SEQ ID NO: 36929 - DNA, 601 bp, Human; identical to SEQ ID NO: 20994

SEQ ID NO: 36930 - DNA, 601 bp, Human; identical to SEQ ID NO: 20995

SEQ ID NO: 36931 - DNA, 601 bp, Human; identical to SEQ ID NO: 20996

SEQ ID NO: 36932 - DNA, 601 bp, Human; identical to SEQ ID NO: 20997

SEQ ID NO: 36933 - DNA, 601 bp, Human; identical to SEQ ID NO: 20998

SEQ ID NO: 36934 - DNA, 601 bp, Human; identical to SEQ ID NO: 20999

SEQ ID NO: 36935 - DNA, 601 bp, Human; identical to SEQ ID NO: 21000

SEQ ID NO: 36936 - DNA, 601 bp, Human; identical to SEQ ID NO: 21001

SEQ ID NO: 36937 - DNA, 601 bp, Human; identical to SEQ ID NO: 21002

SEQ ID NO: 36938 - DNA, 601 bp, Human; identical to SEQ ID NO: 21003

SEQ ID NO: 36939 - DNA, 601 bp, Human; identical to SEQ ID NO: 21004

SEQ ID NO: 36940 - DNA, 601 bp, Human; identical to SEQ ID NO: 21005

SEQ ID NO: 36941 - DNA, 601 bp, Human; identical to SEQ ID NO: 21006

SEQ ID NO: 36942 - DNA, 601 bp, Human; identical to SEQ ID NO: 21007

SEQ ID NO: 36943 - DNA, 601 bp, Human; identical to SEQ ID NO: 21008

SEQ ID NO: 36944 - DNA, 601 bp, Human; identical to SEQ ID NO: 21009

SEQ ID NO: 36945 - DNA, 601 bp, Human; identical to SEQ ID NO: 21010

SEQ ID NO: 36946 - DNA, 601 bp, Human; identical to SEQ ID NO: 21011

SEQ ID NO: 36947 - DNA, 601 bp, Human; identical to SEQ ID NO: 21012

SEQ ID NO: 36948 - DNA, 601 bp, Human; identical to SEQ ID NO: 21013

SEQ ID NO: 36949 - DNA, 601 bp, Human; identical to SEQ ID NO: 21014

SEQ ID NO: 36950 - DNA, 601 bp, Human; identical to SEQ ID NO: 21015

SEQ ID NO: 36951 - DNA, 601 bp, Human; identical to SEQ ID NO: 21016

SEQ ID NO: 36952 - DNA, 601 bp, Human; identical to SEQ ID NO: 21017

SEQ ID NO: 36953 - DNA, 601 bp, Human; identical to SEQ ID NO: 21018

SEQ ID NO: 36954 - DNA, 601 bp, Human; identical to SEQ ID NO: 21019

SEQ ID NO: 36955 - DNA, 601 bp, Human; identical to SEQ ID NO: 21020

SEQ ID NO: 36956 - DNA, 601 bp, Human; identical to SEQ ID NO: 21021

SEQ ID NO: 36957 - DNA, 601 bp, Human; identical to SEQ ID NO: 21022

SEQ ID NO: 36958 - DNA, 601 bp, Human; identical to SEQ ID NO: 21023

SEQ ID NO: 36959 - DNA, 601 bp, Human; identical to SEQ ID NO: 21024

SEQ ID NO: 36960 - DNA, 601 bp, Human; identical to SEQ ID NO: 21025

SEQ ID NO: 36961 - DNA, 601 bp, Human; identical to SEQ ID NO: 21026

SEQ ID NO: 36962 - DNA, 601 bp, Human
gcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacaaaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattca

SEQ ID NO: 36963 - DNA, 601 bp, Human
actagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcatargactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaccacattgtgtttatctgagtaagttcattgggatacagtcaatacttgtgctgttaatgtagaagaa

SEQ ID NO: 36964 - DNA, 601 bp, Human
gcatggtggtgcacacctgtaattccagctactccggaggctgaggcagaagaatcatttgaacccgggaggcagagtttgcagtgagccaagatcgcaccactgcacttcagcctggaccacagagcaagactccttctcaaaaaagaaaaagaaaaagaaaaaaaaagtaaactagtacaacctttatggaaaacagtatggagacttctcaaagaactaaaaatggaactaccattcaatccagcaatcccactaatgggtataagggtaagaaatcagtatatcggccgggcgtggyggctcatgcctgtaatcccagcactttgggaggccgaggtgggcagatcaggaggtcagtagatcaagaccatcctggctaaaacggtgaaaccccgtctctactaaaaatacaaaaaattagccgggcgtggtgacgggcccctatagtcccagctactcgggaggctgaggcaggagaatggcgtgaatccgggaggcggagcttgcagtgagccgagatcgcgccactgcactccagcctgggcgacacagcgagactccgtctcaaaaaaaaaaaagaaatcagtatatcaaaaag

SEQ ID NO: 36965 - DNA, 601 bp, Human
gtcctgccttctcgcccacaacaaaagattctatagcaatccagccattagtgaccaacatctggactcttccatttataactaccattataagaatctcaagctaacaacagatgttttgtgtgattcttattataaaaacaaacttggaatgtttaagactcatctgaaaattagaaaaccatttcagacctttgaatataacagcccctccaatcacttggagcagaaaacaaataggaaagagcatgtcagttcattagcaagtgactgaccaacaagaaaatgtggttcttcaagycaagcctattgattaatataataattttgccagtttattccttgtgggctttgaagacctacaatgtaacttaaaatatctatttttaatttcatttttagctaatgcccctgttgcaactgccttttaaaatgcaggacatggtcagcacatttcctaccaaaagcacagatgacgtcacatgagtgattaagtgggaaaatcgccagctcagcagcacaagaattatttctgtaatacagggctctctgctgggctgcgtgcaggaactacgtctaataaatttatactaagtagagg

SEQ ID NO: 36966 - DNA, 601 bp, Human
tttaagctttgtgtcttaagtattttgctccttctaaattttagctccaattttaactgggagataaacagtaatctgttatcatagccaaaagtgagaactaatggctatgtaaaaaaacagtttcaagaaaaactaaagttatgccagtgggctagcaattcaaaggtaaagcatgacacaagcagttctctggtcctcggtatgcagcagtaagaaactacccaatacatccaatccccgcctccagagggttctaagaaaccaactctccaaaattttgctagttgttttacacagkccagtttagtcacaaattcaatggacctgttttccttcggctcctggtccaatatggcacagtctcaatagtggacacagcttcgatgggcccgccatcattgggaacagtcactgtagtttttgcaactatggattcattcccctgcaacaaaagtagtaatgaggaaagacaaacaaagaatctaacttaccctccactatagggtattttggagcaggtaaaaaattccttagtcttagtcaagacttaagaccccagtctgatactttttttttgagacagagtttttcactctac

SEQ ID NO: 36967 - DNA, 601 bp, Human
cagacataaaggctgggtgccatggctcacacctagaatcccaacactttaggaggccgaggcaggcggatcacttgaggtcaggagttcaagaccagcctggccaacatggcaaaaccccgtctctactaaaaatacaaaaaaattagttgagcatggtggcacatggctgtagtcccagcaacttgggaggctgaggcatgagaatcacttgagcccaggagacagaggctgcagtgagccaaagttgcaacactgcaatccagcctggacaacagggaaactctgtctcaaaaaaaaragagacattaaaaaaagaatggacatgaccaggcgcggtggctcacgcctgtagtctcagcactttgagaggctgaggtgggcggatcacttgaggtcaggagcttgagaccaccctggccaacatgatgaaaccccatctctactaaaaaatacaaccaaaaaaaattagccgggcatggtggtggtacatgcctgtaattccaggtacttgggaggctgaggcaagaaaatcgcttgagcccaggggggcggaggttgcagtgagctgacatcctgccagtgcactccagcctaggca

SEQ ID NO: 36968 - DNA, 601 bp, Human
aagaggtcatatgactaaaactaaagagagagtcaagtccctgaagaagcacatcttgggccttacctttaatatctggtgtctgtggtgttgaaaaggcatttgagttttcaatgacatgtagggggtcaatgttctcttgctccaccatcatgaactgactccaatactccagaggcaaggaaagcaggcgctcaaccacctaaaagccagcaaatctgttagcaaacttccaaagctcagggcttctcaactgtctttcaagttatcacattacacaagttcacatacacacacacaygcacctgcctaccttgggttgacgcttgatgtcctgtaacattgtcactgggtctggattgggcacagcatgggccactattgtagggccaaagactttagccagattggcaacatccattttagtatgtggactctgagccactctaagcaaaagaatattaaattagaagtcttgctccttgcttaaatgcagaccaaaatataaattctataagaaaacaattcatccctcatactcccaaacactcaacccacattatcttccccttggaaaaaaattccctaactcccagaacaa

SEQ ID NO: 36969 - DNA, 601 bp, Human
ttatagtttaaaacaaagacaataacaaccctttcccaaagcagacctccttcttgcctggggactagactgcctttgtaggactaacattagccacgagaaagagtaggctataagggaagattgtcaatattttatgtggtaagaaaagctacagtcattttttctttgcactttggatgctgaaattttcccatggaacatagccacatctagatagatgtgagctttttcttctgttaaaattattcttaatgtctgtaaaaacgattttcttctgtagaatgtttgacttcatatygacccttatctgtaaaacacctatttgggataatatttggaaaaaaagtaaatagctttttcaaaatgaaaaaaaaaaaaaaagaaattatggtttaggagtcatgcaactggaggctacaagattctgaccctccctaaactgcccctaaggtcagtgcttgagatacttcgcaaatgctgcacttgatggatagggggatgccacccagatcaataaactggctcatttgatcctgtggtccccccactcaggaactgactcagtgcaaaaagccagctttgactccctatgatttcg

SEQ ID NO: 36970 - DNA, 601 bp, Human
tcctgtcacatcaccatggccagcatcagaccctttggttgaaggggttgctgaggttcaggacagagtggatggccaggaatgctcagctcaggtcaagactctgtcttatcagcatcccctctccactgtcccttacctcaagtctgggaaatttgaagatgagaggcaggagccaaggtccttctcacattgggatcccagactgggctgagacagggttgtgagacgattgtgggggtaccccaagcaggaccaggccaaacccagggcctcccgagagttgcagaccatcaggtggccagcctgaggaaaggcaaggatctgcggctggcttcccaagaagagcctacttgctagcctggggcaggagaggggacaccaggacagagggggccaggggctggtccaaggttactagcaggcagggcagcaggcaggctagcgtagagtgctctgggcccagaagaatatctgggattgttggccacatcttgggggacgccgtgccgttagcatccatctgctccaatgagaacccaggctgagcccaccctgtgagttcctcctttagccggccagcccccggtttcccaatcca

SEQ ID NO: 36971 - DNA, 601 bp, Human
tttgagatgacctgcttgctggggcccagagctaccttcccaggagcatggttggtggctagccagtcaggctggaacctctgtgggtggccacgtccagatagcttagccggtcctcagatcccacatgtaggtgtgggcacctttggggctgatgtggtagctgggtgtatgaatagctgtgttgatcaccacaagctcctggtgagtgtgtacctgggcaggggtgtgtccatggctgtgtcatcatcatggtggggacagtggctggtgtgttctaggtacatgtgtgtgcccgctktggagcgcagcagtctaaaactttgttccctgacacccaacagtagccctgagcttacaagggggtgctcacctagggtaaaaagtgaaagaggctatgggaccccggaatgcagggggaggctcctggggtggaaggcagtggtggggcaggtattcaggagtcccagaatgcagacaggaggaaggaacttgctggagacagcaagggagaagtagtcttcccagcacctccatgtcctcttccttggcctcaccttccaccctccctcacttggcaccaggccagttgcgataagca

SEQ ID NO: 36972 - DNA, 601 bp, Human
acttccccaggaagacagctgctcctccctcactccttgcaaaatacatctccaagccttagttctgggtctagtccctggctgggcctcaggacaccgccataatgaaaccatggccttgccctcaaggagaaccagactggctggggaagatgacactaagagtaattataatgcaaagtcataaaactgcaggtgtcacgggggagtcagggtctgcttgctcctgagctgtgtcttccaggccaaaggaaggagctgggggaagggaccccaggtagagaggacagcatgggcaaayagcgccagtattgcttgtgaggcaggaaggcgcaggcaggagctggtggcaggagccagacctgactcctgtgtaggttataggtgaccctctaggttctaacaaatcatggccctatgaccactcacagtgagaaagggccacacaactctggcacaccacagcctgacaaaaacttttccacacctaccctggctgtactgtgggatcttggaaatccctcttggagagctggaggccaaattttgagatgacctgcttgctggggcccagagctaccttcccaggagcatggttggt

SEQ ID NO: 36973 - DNA, 601 bp, Human
cacgtactaagaacgtgccttctggcatcttctgcaggtgttgtcgggcctcgctggccgtaatggaaccccaataccagcctaggcaagtgcagagggggccaagggacatagtggaaattagctggggtaaccaatccagggcaagtcaaggcagtgcctccagcttcacgcttccctagagagggctgtgcctctcccatcagactctcctgggccgggctatgcctcccaaatcagactcaaaggcagaactaagcttctcccaccagactactcaggaaaaggcctgcctcccccstcagactcaccagattcccgaaggtaggagaaggtcttggctatgcacagcagatcctcctctgggtccagcacctttggctcactctctgtctgggctggggtaccctctgccacctcctcgaggaaggccccagcaggcaagggctgcatgactggcttgggcagttccagggacggggcccacaggggccgctgcccagtccgctccacagccagcaaaggacgaggtctagaaggcagtggatgagcagtgagtggaggacccatgcttcccccatctccagagacccccctatgc

SEQ ID NO: 36974 - DNA, 601 bp, Human
cagacggttgatgacaaggcggcacaggtgttgcaggctgcgggcactgcttctgcgtacaaagggctgcaccagttttaggtgtacagcagtggctggtggaggagcaggcagtgctgggtcactaggcgcatcctccttaggcataggcagggccggggtgggagcaggatcggggctgtcgcttcgggtatcagcagtgcaggaggccacatagtgctgcacaaggctgaccacatccggaaaggccaggatgcgtggcctggacaagcagttggagtccagacggaagctggagtcrgcatactcaatgcgtacattggtggggccacgagtggttttcactgacagcgtgaacaggtagctggggtgcgtgctgtcacgtactaagaacgtgccttctggcatcttctgcaggtgttgtcgggcctcgctggccgtaatggaaccccaataccagcctaggcaagtgcagagggggccaagggacatagtggaaattagctggggtaaccaatccagggcaagtcaaggcagtgcctccagcttcacgcttccctagagagggctgtgcctctcccatcagactctcctgggccgg

SEQ ID NO: 36975 - DNA, 601 bp, Human
caaatatcaaatgggggctaatgataacaagatcaaaggggacacactgtgtacacaactgaaaatcggccccattgagggctctgtacatgaaaggtatcattttattatagaggtaataaaataaagaggtaataaaggtataatgtcattacagaaaaatcagtggaagagaaaagaccaccaaactgttctttgctataattattatttcatgaagtcttatcagacgtgtatttctctcctctcatgtgcaggcaccttcctgggcaggaagcagacctagcagaactgcagtggyggccctcaaaccagcaccccctcttcctgacagcacaggcactccccccggggcctgcgccacagtgagaccagctctatgcagatacagctctgtcctgtgagggggtgagacacaggctctgctggggactgaggctccggctgcattttcttacctattgtagttgtccatcctccccaaatatggctgggggcagaagagagtggacacattcacagacgggtgggtcagtaccaggacatccaggattgccttggttccagcaagatgtctcaggatgggctttccacagggaag

SEQ ID NO: 36976 - DNA, 601 bp, Human
tctgttccccagggtggagtgcagtggtgcgatcttggctgactgcaacctccgcctcccaggttcaagtgattctcctgcttcagcttcccaagtagctgggattagaggcgcccaccaccacgcccggctaattttttttgtatttttagtagagatggggtttcaccgtgttggccaggctggtttcgaactcctgacctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtga

SEQ ID NO: 36977 - DNA, 601 bp, Human
aagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactccgtctcaaaaaaaaaaaaaaaaagatttttaaa

SEQ ID NO: 36978 - DNA, 601 bp, Human
aatttaacttaaaaagagtttttagactgggcgcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcaatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacggggtctcactgtgttgctgaggctggtctcgaattcctg

SEQ ID NO: 36979 - DNA, 601 bp, Human
agatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactccgtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacggggtctcactgtgttgctgaggctggtctcgaattcctgtgatcctcctgcttcatcctctcacagtgctgggattacaggtgtaggccgctgtgcccagctgagttcactttttaacatctgtctgagg

SEQ ID NO: 36980 - DNA, 601 bp, Human
acccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgttctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatc

SEQ ID NO: 36981 - DNA, 601 bp, Human
ttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagag

SEQ ID NO: 36982 - DNA, 601 bp, Human
ctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacgtactcttctgtggcattcctgtttatttttaaattttttttggagagtgtcgctctgttgcccaggctggagtgcagtgttacaatctcagctcaccac

SEQ ID NO: 36983 - DNA, 601 bp, Human
aggaagcatgtcataaatgcaggaaatacttgtgagaggagataaaaatattaaaagagagttgtgatgttaatgacaaattccttctcaagtaagagctagcctgtagggaggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacaatctccacctcctgggttcaagtgattatcctgcctc

SEQ ID NO: 36984 - DNA, 601 bp, Human
ctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaacgctgaaattaactttggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctttttttttttttccttaaacagaactttattttctcacagttctggaggctagaagttcaagatcaagatgtctgcaggtttgctttcttctgaggcc

SEQ ID NO: 36985 - DNA, 601 bp, Human
gctgtaggtttgttactgtaacctgggatcacttttctctttctcacattccgtgtgacagtgatgatgaatattgcattctttgggactgacagtcacagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctccttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctggtagtaatgttttat

SEQ ID NO: 36986 - DNA, 601 bp, Human
ttactgtaacctgggatcacttttctctttctcacattccgtgtgacagtgatgatgaatattgcattctttgggactgacagtcacagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctcttttttttttttcccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctggtagtaatgttttattctttgtccgat

SEQ ID NO: 36987 - DNA, 601 bp, Human
aacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctgtgcactcggcgcagaccttgacacttaggtccaaagcgcgagtgctcttcgccaaagcttgtctgcctgggctctttcctacctttgggtggtct

SEQ ID NO: 36988 - DNA, 601 bp, Human
ccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagt

SEQ ID NO: 36989 - DNA, 601 bp, Human
gcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgttagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactg

SEQ ID NO: 36990 - DNA, 601 bp, Human
ggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacc

SEQ ID NO: 36991 - DNA, 601 bp, Human
cagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaa

SEQ ID NO: 36992 - DNA, 601 bp, Human
ttttttttttttttaaccgtaaccagaaaggggttgcgaatgacatctagctgtcaggtctttaaagtattgtatttcttagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttat

SEQ ID NO: 36993 - DNA, 601 bp, Human
ttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggcygagtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttg

SEQ ID NO: 36994 - DNA, 601 bp, Human
tagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggctragtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttgg

SEQ ID NO: 36995 - DNA, 601 bp, Human
aagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaa

SEQ ID NO: 36996 - DNA, 601 bp, Human
ttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagct

SEQ ID NO: 36997 - DNA, 601 bp, Human
cacaacacactcattgcaggcagagctggcactacagcccagatagtatttgcttgggtttctttctctggccccctacggccaccagtaaaaacagccacccacgctctctgaaggccctgatgcattcagagtgctttcacttccattatttcactgtgcgttaggtaggccaagcagtctccccattttacagttgaggtcactgagttgcagggtcagctaggggcttgcactccatcacacagcagaccagaagtggggcctcttaaccttccactctgttgtgtggtcaggaggmcttcccaccctgggcccttgctggggtctccccacagcctctgccaggcctctgcctcctcctgccagtcttgagggatggggtggatggagcatcagccagcactctagggagttggccagtgctagggggctgcctctctgcctgtagagccagcttcagggaggctgtagagcacttcagggaggcacttgaggggatgattctcgaagtgtgtatcaccatctctactcccatggcctcctttccttggtgttcctgctgagtaattctcacttgacaagtttttttgtccccctt

SEQ ID NO: 36998 - DNA, 601 bp, Human
caagtgatcccccgcctcggcctctcaaagtgctgggattacaggtgtgagccaccgcacctggcccaacttttcagatcttaaaaaattttttttaatttattttttatggagacagaatattactgtgttgcccaggcggtctcaaatccctgatctcaagcaatctcccgcctcagcctcccaaagtgctgggattacaggcatgagccattgtgcccagctaaaaacattttttttaggcttaagcatgcttaactggtttcatttgtcttggggcaagtgaaaacaactttaattwaaaattttttttaaatgagacatggtcttgctctgtcacccacgctggagtgcagtggtgcgattatggctcactgcagcctcaacctgctgggctcaagcaatcctcccatcccagcctcctgagaaactgggactataggcgcacatcaccatgtccggctaattgtttctattttttgtagagatggggtctcactatgttgcccaggctgcagctttgctttttgtctggctgtttgccagtggctgtctgagtctattaagtggatctgaggttggtaagacgaggagttccctt

SEQ ID NO: 36999 - DNA, 601 bp, Human
tgatcccccgcctcggcctctcaaagtgctgggattacaggtgtgagccaccgcacctggcccaacttttcagatcttaaaaaattttttttaatttattttttatggagacagaatattactgtgttgcccaggcggtctcaaatccctgatctcaagcaatctcccgcctcagcctcccaaagtgctgggattacaggcatgagccattgtgcccagctaaaaacattttttttaggcttaagcatgcttaactggtttcatttgtcttggggcaagtgaaaacaactttaattaaaawttttttttaaatgagacatggtcttgctctgtcacccacgctggagtgcagtggtgcgattatggctcactgcagcctcaacctgctgggctcaagcaatcctcccatcccagcctcctgagaaactgggactataggcgcacatcaccatgtccggctaattgtttctattttttgtagagatggggtctcactatgttgcccaggctgcagctttgctttttgtctggctgtttgccagtggctgtctgagtctattaagtggatctgaggttggtaagacgaggagttcccttgatg

SEQ ID NO: 37000 - DNA, 601 bp, Human
cgaactcctgagctcaggaaatccaccctcctcggcctcacaaagtgctgggattacgagtgtgagccactgtgctgggccatctttcgaactttttaacagctttcagaggaaagatggacaggagttagactctccatttacatgtgaagaaactgagatttgggctgggtgcagtggcccatgtctataatcccagcactttggaaacctgaggcgggtagaccacttgaggtcaggagttcgagaccagcttggccaacgtgaaactccatctctactaaaaatacaaaaattagcygggtatggtggcacatgcctgtagtcccagctcttgggaggctgaggcaggagaatcacttgaacctggaaggtggaggttagagtgagctgagatcacgccactgcactccagcctgcatgacagagcgaaactccatttcaaaaagaaactgagatttggcttgagaattaacttatccagggtcatagggtagtaatctatttttctcaactcaggaaagtcaggggaagacaggcgtgtgacagcacccttctaggacaccttcccaaggttgttaggtaagttgtcctggggacc

SEQ ID NO: 37001 - DNA, 601 bp, Human
gacctctggggattagaagtccctcaaaaacagttcctaggcccctggaaccctccctcctccaggtttcctgactcagataggtccctttttcctcatccttcagggcttctcatgagaggagggggaagtgtgtggaaatgaaaaataattctgatgaggattagcttctgccattctgaaaactctgctcttcctgcttgtgttagaagagaaaggctaagccattggagctggtgatggaattggtgctggtggaggtggtggttgtagtgacggtactactggtggtggttgtgayggtgaaggtggtggctgtagatggtggtgcccgtgctggtgctggtggagatcgtggttatcgtgatggtggagggggcagttgtagtgacggtggttgtgatggtggtgatgggtggttacagtgctactggtggtgatggtgctggttgtagtggtggtggtgacggggctagtgaaggtgttagtggtggagatggtgatggtagaagagtgcttcttttctgaatctgttactctggcacaacagcggaatcatacagcatcccaccccctaacttcctctacttttcctggaaac

SEQ ID NO: 37002 - DNA, 601 bp, Human
agacaggggtgtgcaggtagatgtcgagcaactgaccctctgaaagaacattttaaaaaactctgatttgtagtgtttgctgatccctgtggtgtaaatactcctgctatggatgatttcaagcgactcatgtgagtcattgaacacagagccgggaagagactcacagtgcactgtgatttagtacctcctccatgcagctgcgatagacggaagtaacctcgacagtgcagacaatagtaaaacgtaaaataactgggcagtgatgattttttagtttttactccttttttttttttttgagatggagacttgctcttgtcatccaggctggagggcagtggcgcgatctcagctcactgtaacctctgcctcctgggttcaagccattctcctgcctcagcctcctgagtagctaggattacaggcgcccacgaccacacccagctatttttgttgttgttgttgtactttttagtagagacggggtttcgccatgttggccaggctggtctcgaactcctgacctcaggtgatccgcccgccttggcctctcaaagtgctgggattacaggcatgagccactgtgccgggcctactt

SEQ ID NO: 37003 - DNA, 601 bp, Human
ggaaggaaggttcgtttttcttctgtcctaaacgaagggtcatttttcctccttcctaaactctggctgtttctcacccaccttgggaggaagatgagatgggatgaagctgaatcttggacgggggtcatattcaggccacacaggccaacccagcctcagggtttcttcaccaaatcatgggttgccattgctccggcaccatgaaaggcacagagttggccctgtggtcccagggaatagatgccgagtttctctaggttgaacaatcctgttaaaagtgcccttgctggctgggtgyggtggctcacacccataatcccagcactttgggaggccaaggcgggtggatcacaaggtcaggagttcaagaccagcctggccaagatgatgaaaccccgtctctactaaaaatacaaaaattagccaagcatggtggcgggtgcctgtaatcccagctactcaagaggcggaggcaggagaatcgcttgaacccgggaggcagaggttacagtgagctgagatcatgccattgcactccagcctgggtgacagagtgagactccgtctcaaaaaaaaaaaaaaaagaaaaaagaaaaaa

SEQ ID NO: 37004 - DNA, 601 bp, Human
aaagttcccgagccccagactcaggactcaggtgactctatttcccttctctctagattactcagctgaaaattgataataacccctttgccaaaggattccgggagaactttgagtcgtaagtgccactgggttcaactcagctttggtccctcctgagacacatcctctccctgcccctgaaaacaggagggtgggggacagatgctacaggtgggcaggccagggaaggagggtcggagaaggaatgtgtgaaacaggtaggctcacaggtgactggttctgcttgtgacccgttttyttgccttctatttttttctagcatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggcca

SEQ ID NO: 37005 - DNA, 601 bp, Human
ggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagaygcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcag

SEQ ID NO: 37006 - DNA, 601 bp, Human
cttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagmcccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccct

SEQ ID NO: 37007 - DNA, 601 bp, Human
aactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactycctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaa

SEQ ID NO: 37008 - DNA, 601 bp, Human
ccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacmtatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaa

SEQ ID NO: 37009 - DNA, 601 bp, Human
gtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgayagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaa

SEQ ID NO: 37010 - DNA, 601 bp, Human
atatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccarggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgtt

SEQ ID NO: 37011 - DNA, 601 bp, Human
tgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacckcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaat

SEQ ID NO: 37012 - DNA, 601 bp, Human
ggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcaytagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgtt

SEQ ID NO: 37013 - DNA, 601 bp, Human
gaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctgrccggccactcccgtctgctgtgacgcgcggacagagagctaccggtggacccacggtgcctccctccctgggatctgtaagtaacaacctttgagctctttctgttgtggtgtggatggaatctgcaccttccatctggagaactggggccgccccaggccgggcttccagcaccagagcgatggtcaggcttcagctggacgcagatttcaccccgcagggcacacgcagacccatttgtttggaagcggcagtcctaaggcagtgcaggtgcctccacggccccagcccagctctcct

SEQ ID NO: 37014 - DNA, 601 bp, Human; identical to SEQ ID NO: 33244

SEQ ID NO: 37015 - DNA, 601 bp, Human; identical to SEQ ID NO: 33245

SEQ ID NO: 37016 - DNA, 601 bp, Human; identical to SEQ ID NO: 33246

SEQ ID NO: 37017 - DNA, 601 bp, Human; identical to SEQ ID NO: 33247

SEQ ID NO: 37018 - DNA, 601 bp, Human; identical to SEQ ID NO: 33248

SEQ ID NO: 37019 - DNA, 601 bp, Human; identical to SEQ ID NO: 33249

SEQ ID NO: 37020 - DNA, 601 bp, Human; identical to SEQ ID NO: 33250

SEQ ID NO: 37021 - DNA, 601 bp, Human; identical to SEQ ID NO: 33251

SEQ ID NO: 37022 - DNA, 601 bp, Human; identical to SEQ ID NO: 33252

SEQ ID NO: 37023 - DNA, 601 bp, Human; identical to SEQ ID NO: 33253

SEQ ID NO: 37024 - DNA, 601 bp, Human; identical to SEQ ID NO: 33254

SEQ ID NO: 37025 - DNA, 601 bp, Human; identical to SEQ ID NO: 33255

SEQ ID NO: 37026 - DNA, 601 bp, Human; identical to SEQ ID NO: 33256

SEQ ID NO: 37027 - DNA, 601 bp, Human; identical to SEQ ID NO: 33257

SEQ ID NO: 37028 - DNA, 601 bp, Human; identical to SEQ ID NO: 33258

SEQ ID NO: 37029 - DNA, 601 bp, Human; identical to SEQ ID NO: 33259

SEQ ID NO: 37030 - DNA, 601 bp, Human; identical to SEQ ID NO: 24156

SEQ ID NO: 37031 - DNA, 601 bp, Human; identical to SEQ ID NO: 24157

SEQ ID NO: 37032 - DNA, 601 bp, Human; identical to SEQ ID NO: 24158

SEQ ID NO: 37033 - DNA, 601 bp, Human; identical to SEQ ID NO: 24159

SEQ ID NO: 37034 - DNA, 601 bp, Human; identical to SEQ ID NO: 24160

SEQ ID NO: 37035 - DNA, 601 bp, Human; identical to SEQ ID NO: 24161

SEQ ID NO: 37036 - DNA, 601 bp, Human; identical to SEQ ID NO: 24162

SEQ ID NO: 37037 - DNA, 601 bp, Human; identical to SEQ ID NO: 24163

SEQ ID NO: 37038 - DNA, 601 bp, Human; identical to SEQ ID NO: 24164

SEQ ID NO: 37039 - DNA, 601 bp, Human; identical to SEQ ID NO: 24165

SEQ ID NO: 37040 - DNA, 601 bp, Human; identical to SEQ ID NO: 24166

SEQ ID NO: 37041 - DNA, 601 bp, Human; identical to SEQ ID NO: 24167

SEQ ID NO: 37042 - DNA, 601 bp, Human; identical to SEQ ID NO: 24168

SEQ ID NO: 37043 - DNA, 601 bp, Human; identical to SEQ ID NO: 24169

SEQ ID NO: 37044 - DNA, 601 bp, Human; identical to SEQ ID NO: 24170

SEQ ID NO: 37045 - DNA, 601 bp, Human; identical to SEQ ID NO: 24171

SEQ ID NO: 37046 - DNA, 601 bp, Human; identical to SEQ ID NO: 24172

SEQ ID NO: 37047 - DNA, 601 bp, Human; identical to SEQ ID NO: 24173

SEQ ID NO: 37048 - DNA, 601 bp, Human; identical to SEQ ID NO: 24174

SEQ ID NO: 37049 - DNA, 601 bp, Human; identical to SEQ ID NO: 24175

SEQ ID NO: 37050 - DNA, 601 bp, Human; identical to SEQ ID NO: 24176

SEQ ID NO: 37051 - DNA, 601 bp, Human; identical to SEQ ID NO: 24177

SEQ ID NO: 37052 - DNA, 601 bp, Human; identical to SEQ ID NO: 24178

SEQ ID NO: 37053 - DNA, 601 bp, Human; identical to SEQ ID NO: 24179

SEQ ID NO: 37054 - DNA, 601 bp, Human; identical to SEQ ID NO: 24180

SEQ ID NO: 37055 - DNA, 601 bp, Human; identical to SEQ ID NO: 24181

SEQ ID NO: 37056 - DNA, 601 bp, Human; identical to SEQ ID NO: 24182

SEQ ID NO: 37057 - DNA, 601 bp, Human; identical to SEQ ID NO: 24183

SEQ ID NO: 37058 - DNA, 601 bp, Human; identical to SEQ ID NO: 24184

SEQ ID NO: 37059 - DNA, 601 bp, Human; identical to SEQ ID NO: 24185

SEQ ID NO: 37060 - DNA, 601 bp, Human; identical to SEQ ID NO: 24186

SEQ ID NO: 37061 - DNA, 601 bp, Human; identical to SEQ ID NO: 24187

SEQ ID NO: 37062 - DNA, 601 bp, Human; identical to SEQ ID NO: 24188

SEQ ID NO: 37063 - DNA, 601 bp, Human; identical to SEQ ID NO: 24189

SEQ ID NO: 37064 - DNA, 601 bp, Human; identical to SEQ ID NO: 24190

SEQ ID NO: 37065 - DNA, 601 bp, Human; identical to SEQ ID NO: 24191

SEQ ID NO: 37066 - DNA, 601 bp, Human; identical to SEQ ID NO: 24192

SEQ ID NO: 37067 - DNA, 601 bp, Human; identical to SEQ ID NO: 24193

SEQ ID NO: 37068 - DNA, 601 bp, Human; identical to SEQ ID NO: 24194

SEQ ID NO: 37069 - DNA, 601 bp, Human; identical to SEQ ID NO: 24195

SEQ ID NO: 37070 - DNA, 601 bp, Human; identical to SEQ ID NO: 24196

SEQ ID NO: 37071 - DNA, 601 bp, Human
ttggcatggaccttcccctggcccccagccacgtgcctggctttccccatgctgaagatgctgaggctagttccagcgaccgcagcgtgaagatctccgaatcccgcctctccagtgcctcatttattgtgctgctctgctgctcacaggggaagccggtcccccagagtccccttcctggtcctagtgagtatcttgtccctagattgcttgtcagccttgtccgcctggagcactcagtagccagcaggctccccgcctttcctggagtccgaggcagctgcccagccaccagccgtgyggacgatggcttgcaccacagcgatgaaagtggatgcgatctgggtgtgatggtgccgggtctccagggctgcagtcactgcctgggggtgggaggagaggggaagcctgagcaaggctccagatgccacctgaaccacatctgtgtggtcacaggcctcagcccaggtggtgccatttcgggccaggtcatcaggaagagcaggttggggcctgctgggtctcactggagcagggggtttggccttcatgtcacaggggctccagatggcccaggcactagagagaggacaccaaccat

SEQ ID NO: 37072 - DNA, 601 bp, Human
gatggggacctagggatctccttgttgttcaccagagagagagacaaagaggcagaggtagagagaaaacggagattagggagatagagagactgaaagagagacagaaggagaaagacagagagagagagagaaagaagggagaagctgggggtaccctgcagtggagaagtcctggcctctattttccccgccccccgcccatgtctttctatgcgctatattaagagcagtggctctggggtcctagcactcactttttgcccctttccttcccccgtgcctcagtttcccctcttakggagcagatgccaaactggctccagtagaaagcttgaggatccctccgggcagggtagcaggctccgagagcaccctggagttcctgccggggtgtgggggtgcccaagcaccaccagcccctctcgccgtgtgcccgtgagtgcctgcttgaccatgtggctttctccatcgccggccccacagacaccagcggcgcctcccgtttctcagacgcatccaaggggtcccgctggagcttcctcgctaccacccccagcggggccccaaagtacttaccgagaaagacgagaaagacgcg

SEQ ID NO: 37073 - DNA, 601 bp, Human
gccgccagccccggcggcccatcctgaaacccagtggtgatatttcaccccgggcgcccctcccacaggaaaacgctgtggccgcctgttggggtgcatgtggagctgcggttcccagcgctcaggaagttcccctttccaaggcatgtcctgggggaccctcctcaggtcaccaggggctttagggatggggacctagggatctccttgttgttcaccagagagagagacaaagaggcagaggtagagagaaaacggagattagggagatagagagactgaaagagagacagaaggagaragacagagagagagagagaaagaagggagaagctgggggtaccctgcagtggagaagtcctggcctctattttccccgccccccgcccatgtctttctatgcgctatattaagagcagtggctctggggtcctagcactcactttttgcccctttccttcccccgtgcctcagtttcccctcttatggagcagatgccaaactggctccagtagaaagcttgaggatccctccgggcagggtagcaggctccgagagcaccctggagttcctgccggggtgtgggggtgcccaagcacca

SEQ ID NO: 37074 - DNA, 601 bp, Human
aaggctccgcctcagaaaaaaaaaaaaaaaaatgatggcgctggatcccccaggctctaagatgccctggacccgcatgcttcctcagggacacaggtgcacacacaccacaaccgccgccagccccggcggcccatcctgaaacccagtggtgatatttcaccccgggcgcccctcccacaggaaaacgctgtggccgcctgttggggtgcatgtggagctgcggttcccagcgctcaggaagttcccctttccaaggcatgtcctgggggaccctcctcaggtcaccaggggctttagrgatggggacctagggatctccttgttgttcaccagagagagagacaaagaggcagaggtagagagaaaacggagattagggagatagagagactgaaagagagacagaaggagaaagacagagagagagagagaaagaagggagaagctgggggtaccctgcagtggagaagtcctggcctctattttccccgccccccgcccatgtctttctatgcgctatattaagagcagtggctctggggtcctagcactcactttttgcccctttccttcccccgtgcctcagtttcccctctta

SEQ ID NO: 37075 - DNA, 601 bp, Human
acccaggaggcggaggttgcagcaagctgagatcgtgccactgcactccagcctgggcgacagagcaaggctccgcctcagaaaaaaaaaaaaaaaaatgatggcgctggatcccccaggctctaagatgccctggacccgcatgcttcctcagggacacaggtgcacacacaccacaaccgccgccagccccggcggcccatcctgaaacccagtggtgatatttcaccccgggcgcccctcccacaggaaaacgctgtggccgcctgttggggtgcatgtggagctgcggttcccagcrctcaggaagttcccctttccaaggcatgtcctgggggaccctcctcaggtcaccaggggctttagggatggggacctagggatctccttgttgttcaccagagagagagacaaagaggcagaggtagagagaaaacggagattagggagatagagagactgaaagagagacagaaggagaaagacagagagagagagagaaagaagggagaagctgggggtaccctgcagtggagaagtcctggcctctattttccccgccccccgcccatgtctttctatgcgctatattaagagcagt

SEQ ID NO: 37076 - DNA, 601 bp, Human
caggagaatcgcttgaacccaggaggcggaggttgcagcaagctgagatcgtgccactgcactccagcctgggcgacagagcaaggctccgcctcagaaaaaaaaaaaaaaaaatgatggcgctggatcccccaggctctaagatgccctggacccgcatgcttcctcagggacacaggtgcacacacaccacaaccgccgccagccccggcggcccatcctgaaacccagtggtgatatttcaccccgggcgcccctcccacaggaaaacgctgtggccgcctgttggggtgcatgtggmgctgcggttcccagcgctcaggaagttcccctttccaaggcatgtcctgggggaccctcctcaggtcaccaggggctttagggatggggacctagggatctccttgttgttcaccagagagagagacaaagaggcagaggtagagagaaaacggagattagggagatagagagactgaaagagagacagaaggagaaagacagagagagagagagaaagaagggagaagctgggggtaccctgcagtggagaagtcctggcctctattttccccgccccccgcccatgtctttctatgcg

SEQ ID NO: 37077 - DNA, 601 bp, Human
aatatggtgaaaccccgtctctactaaaaatacaaaacattagctgggcgtggtggcagactcctgttacccaactacttgggagattgaggcaggagaatcgcttgaacccaggaggcggaggttgcagcaagctgagatcgtgccactgcactccagcctgggcgacagagcaaggctccgcctcagaaaaaaaaaaaaaaaaatgatggcgctggatcccccaggctctaagatgccctggacccgcatgcttcctcagggacacaggtgcacacacaccacaaccgccgccagcccyggcggcccatcctgaaacccagtggtgatatttcaccccgggcgcccctcccacaggaaaacgctgtggccgcctgttggggtgcatgtggagctgcggttcccagcgctcaggaagttcccctttccaaggcatgtcctgggggaccctcctcaggtcaccaggggctttagggatggggacctagggatctccttgttgttcaccagagagagagacaaagaggcagaggtagagagaaaacggagattagggagatagagagactgaaagagagacagaaggagaaagacagagaga

SEQ ID NO: 37078 - DNA, 601 bp, Human
aacaacctctgtcccccactggcactgggctatgcctcataatcgcagatgtcccctgcgctgccctcaagcctctgtaccgtcacaagtctccatgggggtggtgatgatctcagaaaaagagctgaaccctggattgcagcgacaggcggtggcattgacacacgaggagtcctgagggcaccaccgggcacagcctgcaagagcagggagcacggtcagaaggtgaggggtaagggaatacacaaaaagggggcactgggggagatggggcagagcgctgagtttcccgtgcacgagscctctctttccctgggctgaagggggctgggcgggggtccaggaccctccccaggctctggctgtggactgtgctttctgcttcccagcagactcacccctggagtcctgggtttcagctcccggcagagtcagccagacacagaatgctgcaacagagaaaggaaagggggtcagaggggatcccagggtgggaaaggaggcgtaagggtgatgcactttgtgggaggaggatgctgacccctctcaggctcagatcctgcccatcgttcaaacagagtgagcagatgtcacgtcccac

SEQ ID NO: 37079 - DNA, 601 bp, Human
ctcacaacaacctctgtcccccactggcactgggctatgcctcataatcgcagatgtcccctgcgctgccctcaagcctctgtaccgtcacaagtctccatgggggtggtgatgatctcagaaaaagagctgaaccctggattgcagcgacaggcggtggcattgacacacgaggagtcctgagggcaccaccgggcacagcctgcaagagcagggagcacggtcagaaggtgaggggtaagggaatacacaaaaagggggcactgggggagatggggcagagcgctgagtttcccgtgcrcgagccctctctttccctgggctgaagggggctgggcgggggtccaggaccctccccaggctctggctgtggactgtgctttctgcttcccagcagactcacccctggagtcctgggtttcagctcccggcagagtcagccagacacagaatgctgcaacagagaaaggaaagggggtcagaggggatcccagggtgggaaaggaggcgtaagggtgatgcactttgtgggaggaggatgctgacccctctcaggctcagatcctgcccatcgttcaaacagagtgagcagatgtcacgt

SEQ ID NO: 37080 - DNA, 601 bp, Human
gaaggtaaggctgtggcccctcacaacaacctctgtcccccactggcactgggctatgcctcataatcgcagatgtcccctgcgctgccctcaagcctctgtaccgtcacaagtctccatgggggtggtgatgatctcagaaaaagagctgaaccctggattgcagcgacaggcggtggcattgacacacgaggagtcctgagggcaccaccgggcacagcctgcaagagcagggagcacggtcagaaggtgaggggtaagggaatacacaaaaagggggcactgggggagatggggcagrgcgctgagtttcccgtgcacgagccctctctttccctgggctgaagggggctgggcgggggtccaggaccctccccaggctctggctgtggactgtgctttctgcttcccagcagactcacccctggagtcctgggtttcagctcccggcagagtcagccagacacagaatgctgcaacagagaaaggaaagggggtcagaggggatcccagggtgggaaaggaggcgtaagggtgatgcactttgtgggaggaggatgctgacccctctcaggctcagatcctgcccatcgttcaaaca

SEQ ID NO: 37081 - DNA, 601 bp, Human
ccctggatgctgcagaaacagctctggtgaccccaaacctcatggacagtggtgatggaggatgtggggtggttcttaccttgacacgtgttctcgctctcattcttgaatgtttttgccccagaaacaggctcatatcctgggctgcacacgcagtcgtagctcccctctgtgttccagcagtccgagaattttccgcatgacactttcgacagtgttgcacactcgttgatgtctggaacacaacaggacaggaggtcatctcccaaagatgtgagttccgtcagggcagagacccccrtcctgactccccaacatggggcctgctgcttagtatcttttggaaaggatctcaagttgcactgcacaggctatgctgcagctggagcaggccattcctgaagaccacacttgatctcagttctctggctggcatcctagatttggacacagtggacagtgctgaggtgggggatggacaggaagcgccatatccccatccccagtctttttgtagaaatttaaaccccatggcagccgggtgcagtggctcatacctgtaatcccagcactttgggaggccgaggccggcagatcactt

SEQ ID NO: 37082 - DNA, 601 bp, Human
ctcatctcagactccaggaactgaacctatacttgggtacctgctccctggatgctgcagaaacagctctggtgaccccaaacctcatggacagtggtgatggaggatgtggggtggttcttaccttgacacgtgttctcgctctcattcttgaatgtttttgccccagaaacaggctcatatcctgggctgcacacgcagtcgtagctcccctctgtgttccagcagtccgagaattttccgcatgacactttcgacagtgttgcacactcgttgatgtctggaacacaacaggacaggrggtcatctcccaaagatgtgagttccgtcagggcagagacccccgtcctgactccccaacatggggcctgctgcttagtatcttttggaaaggatctcaagttgcactgcacaggctatgctgcagctggagcaggccattcctgaagaccacacttgatctcagttctctggctggcatcctagatttggacacagtggacagtgctgaggtgggggatggacaggaagcgccatatccccatccccagtctttttgtagaaatttaaaccccatggcagccgggtgcagtggctcata

SEQ ID NO: 37083 - DNA, 601 bp, Human
acaggggacccctgtgaaccagcccccctgctgggctctatgcagctgcgtgctctcagaacgtacacctctgctctgtcctcactttcctcccaccagggaggctctactgactgcagggagaacaggagggacagggctgggaacaggagcactgccacttttctctttacagcagggcaggtctgctgaacccccttaatgtcccctgggacccttggctcagcctcagcttcttcatttcctgcctttgctcaccttcccttcccactctgtgtactctgtgttaatctcccttctytgtccacctgctactggttcccatctggccttgcagatgtctgaagctccctcccgcacccaactagttcccactggaaagaaggcaaagcagagtgatgcatgggggcctggcttctcatgggctggagctgcagtgtggaataagaccatggcaagggatgaggcaggctgtgtcgaaatagatttcttctgagtgccagccaggagtgtggccccacaggagcccagcttgtctgaacaactcctaaaaggcatccattgcttatttatttatttatttatttatttatttatttat

SEQ ID NO: 37084 - DNA, 601 bp, Human
tttggtcaagatatgtgcatgcaatgtagcatctgttcacaggggacccctgtgaaccagcccccctgctgggctctatgcagctgcgtgctctcagaacgtacacctctgctctgtcctcactttcctcccaccagggaggctctactgactgcagggagaacaggagggacagggctgggaacaggagcactgccacttttctctttacagcagggcaggtctgctgaacccccttaatgtcccctgggacccttggctcagcctcagcttcttcatttcctgcctttgctcaccttcycttcccactctgtgtactctgtgttaatctcccttctctgtccacctgctactggttcccatctggccttgcagatgtctgaagctccctcccgcacccaactagttcccactggaaagaaggcaaagcagagtgatgcatgggggcctggcttctcatgggctggagctgcagtgtggaataagaccatggcaagggatgaggcaggctgtgtcgaaatagatttcttctgagtgccagccaggagtgtggccccacaggagcccagcttgtctgaacaactcctaaaaggcatccatt

SEQ ID NO: 37085 - DNA, 601 bp, Human
ggctctgtcctttggtcaagatatgtgcatgcaatgtagcatctgttcacaggggacccctgtgaaccagcccccctgctgggctctatgcagctgcgtgctctcagaacgtacacctctgctctgtcctcactttcctcccaccagggaggctctactgactgcagggagaacaggagggacagggctgggaacaggagcactgccacttttctctttacagcagggcaggtctgctgaacccccttaatgtcccctgggacccttggctcagcctcagcttcttcatttcctgcctttkctcaccttcccttcccactctgtgtactctgtgttaatctcccttctctgtccacctgctactggttcccatctggccttgcagatgtctgaagctccctcccgcacccaactagttcccactggaaagaaggcaaagcagagtgatgcatgggggcctggcttctcatgggctggagctgcagtgtggaataagaccatggcaagggatgaggcaggctgtgtcgaaatagatttcttctgagtgccagccaggagtgtggccccacaggagcccagcttgtctgaacaactcctaaaa

SEQ ID NO: 37086 - DNA, 601 bp, Human
ccaaatcagcttcttttctttatacatgatccagcctcatgtattcctttatagcaacacaacatagactaaaacagaggctctcactgacaaggacccatgaccaccacgtacagttgtgtaggttgctgactacatatggatgcccagccaaggcggtgagcagaggctgaaaacctctccattccccaaatggggctgtgtctacctggagaggagaggcttttctgtttctctttttctttttgtttctttcttttcttttctttttcttttttttttttttttttttttgagacaragtcttgctctgtcacccaggctggagtgcaatattgagatcctggctcactgcaacctctgcctctgggttcaggtgattctcctgcctcagcctcctgagtagctgggattacaggtgctcaccactatgcctggctaacttttgtattttttagtagagatggggtttcactatgtttgtcaggctggtcttgaactcctgacctcaggtgatccacccgcctcagcctcccaaagtgctgggattacaggcgtgagccactgtgcctggcccggagagtcctttttctaattcaca

SEQ ID NO: 37087 - DNA, 601 bp, Human
agccatgtgtcttacatggcctgcagaaccatgagccaaatcagcttcttttctttatacatgatccagcctcatgtattcctttatagcaacacaacatagactaaaacagaggctctcactgacaaggacccatgaccaccacgtacagttgtgtaggttgctgactacatatggatgcccagccaaggcggtgagcagaggctgaaaacctctccattccccaaatggggctgtgtctacctggagaggagaggcttttctgtttctctttttctttttgtttctttcttttcttttctttttcttttttttttttttttttttttgagacaaagtcttgctctgtcacccaggctggagtgcaatattgagatcctggctcactgcaacctctgcctctgggttcaggtgattctcctgcctcagcctcctgagtagctgggattacaggtgctcaccactatgcctggctaacttttgtattttttagtagagatggggtttcactatgtttgtcaggctggtcttgaactcctgacctcaggtgatccacccgcctcagcctcccaaagtgctgggattacaggcgtgagccact

SEQ ID NO: 37088 - DNA, 601 bp, Human
aggcctgtgacaccaggtagacaaaaaaaacaagaatgctgaggggtgagggggatgcagacagggccccacggagcccttccctgagctgaggcttcaagaggcaggtcctgctccgaactagcaggctgttctgtgcggatggggtccatgagagccctctcccacttcattcctgctcatctgtgtctctgcctatccaccaactaagccccctctctcagtgttggcctcttttcttttctctcttctcttctctccttttcttttcttttttttggagacggagtctcgctctgtsgtccaggctggagtgcagtggtgccatctcggcttactgcaagctccgcctcccaggttcatgccattctcctgcctcagtctctgattagctgggactacaggcacccaccaccacgcccagctaatttttttgtatttgtagtagagacggggtttcaccatgttagccaggatggtctcgatctcctgaccttgtgatccgcccacctcggcctcccaaagtgctaggattacaggcatgagccactgcgcccagccagtgctggcctgtttctaacatggcaacacacctcctcaa

SEQ ID NO: 37089 - DNA, 601 bp, Human
tgatgggcaaagatggaggtgtatctgtcatctcatctcttggcattccaccagggacacagacctatttctgaatggttccactcccatgggatctgggttgacctcctgggagaggatcaggcttggagcaatggccctgatgttaacctctcttgccattgggtccacactagtgcctcttccattcactcaactctccaagtatggggagtccatgtcactgtgcccaccgttagccacaacatcctccagtgcactcaggtggaccaaaactatcaggaagggtcagggcagtctygctcagtgaaagggacagagactgagtggcagaaaaagaggtcagggctccacgaggcatcttctccaggtggggttgttggccagtggcaggttcgactggggacagtggccctgccttcaaatctccctcctccttcatttctggacagggtgcctgggtccatgatgagctgggggatcagagagagttccaggtgagcagagctgtgtggagactgtctcatcctggcagtcgctgatgatagcagagagaatggatactgcgctggaatgcaccacgcagtgagctcatcgaata

SEQ ID NO: 37090 - DNA, 601 bp, Human
tccatatgcagtcagcagcctatgcaactgtacatggtggtcatgggtccttctcagtgagaaccctctggtttagtccgttttgtgttgcaagaaaagaagtttatttggctcatggttctgcaggctgtgtaagatgcatggctccagcatctgcttctggtggccttgatttccccaggacagctgctcactggctgagttatcagaatcccggtggccctagcaggatggtgctctcccatccacactagctctgagagcccagctccaggcacatggaccaagactggcccctgarccagtccccaggggagcatgagtctggtgctgcataggccagggctgcctggacagtgggtcccaggccagggtggacagtggggaccgacatacagctgggttgccccagggctgtgaaggtgcctttttttgatcctcaggaaggtgtcttggaaatggcaggatgtagtgagaatccatagctgagaaagactggccctgggtgaaggtttagtggctggagaggggcacagatgctgatgggcaaagatggaggtgtatctgtcatctcatctcttggcattccaccagggacaca

SEQ ID NO: 37091 - DNA, 601 bp, Human
tcaggagatcgagaccatcctggccaacatggtgaaaccccgtctctactaaaaatacaaaaattagccgggcgtggtggcgtgtgcctgtaatcctagctactcagggggctgagggaggagaatcgcttgaacccgggaggcagagactgcagtgagctgagatcgggccactaaactctggactggcgacagagtgagactccgtctaaaaaaaaaatgacattggatgggattccctaggtgatccttgactctggttatggcccctcagaggccaacacttctgtgcaatatcaaygctgacctaaacccaaagtccagggaaagcaagaggaaagatattaagtgcacttgggtgtccattagcttccaccagccctgaaagatgctgggagtcagaccagcacccactgcattgggtcctgtcccctcccagacccaaactgccccaggcctctgtgggatgcagccaccttcctgcctcgcccccttgccctgggtcctgtccttacctggatggtgttattggccaagcctggcttgtagtctctgcccaggtcctggactttgtcgaagaatcgggaaagcgtctgcagag

SEQ ID NO: 37092 - DNA, 601 bp, Human
atggcgaaaccctgtctttactgaaaacacacaaaataattagccgggcgtggtggcgggcgcctgtagtcccagctacttgggaggctgaggcaggagaatcgcttgaacccgggaggtggagtctacagtgagccaggatcgcaccactgcactccagcctggttgacagagcaagactctgtctccaacagaagacaacaacaacaacaatcacaacaagctgtaccacgactaccttgtgatatagaagttaaaaaggaattatttaggcagagagtgtgggtaaggaagtcctggstaagtctttccttttaatgaaaatcagcccctatatcattttttttttttctaacaaagagcagcctgtaaaatcgagctgcagacataggcaagcaagctggaagcctgcacaggtgaatgctggcagctgtgccaataggaaaaggccacctgggactaggcatgttgaaaatggcggctccatcttcccatctctttgccaaccacgtatacagtaaggagctggcgaagactccatttgcataataagattagggtggggcagccagcttccctgcaccttatgtaaacgtcacac

SEQ ID NO: 37093 - DNA, 601 bp, Human
tataccccaaagaactgaagacagttattcaacccaaaatgtgtccactaatattcataagagcactattcacaccagccatctaaacaaaaaaaaaaaattcgaagtcctctcccgcccccctcaaaaccatctgaatggacttcctttttggccagggcactctaaatttaactggaaagactagttcaggctatggtgggaagtggggggtctgacatgtgtcatgccctcctcccttttggagttgaggaaaagctgaccagcatttaacataacacagacctgaagcttaataagraacatttaccatctattctctctgaagcctgatacctgaagagttcatctggatgatacaacttcagcctttacagccccttatcgtattccagacattcttttctatggataataactccttcaaccaactgccaatcagaaaagcttaaatctacctataatctggaagcacccgccccacacctccacttcaaattgtcctgcatttctggactgaaccaatgtatagcttaaacatatttgattgatgtctcatgtccccctaaaatgtataaaaccaagttgcgggggcaggcgt

SEQ ID NO: 37094 - DNA, 601 bp, Human
cgcctggctaattttttgtatttttagtagagatggggtttcaccctgttagccaggatggtgtcgatctcctgacctcgtgatcctcccacctcggcctcccaaagtgctgggattacaggcgtgagccaccgtgcccggcccaagttctattgtttgacagcagagcagagtgactataattaacaagactgtatgatgtatttcaaagtagttacaaaagaggacttcaattgttcccaacacatacaaatgataagtactcaaagtggtggatacctgagataccctgacttgatcsttacacattctaggcaagcaacaaagtatcacatgtacccataaatatgtaagatttatgtatcaataaaagcaattaaaaacagaacaaaagaaaacggaagtaacaagttttgctgaaggtgtggagaggataacccgtgtatgtttctggtggggaattagaatgatgcagctgctttggaaaaagtttggtggttcctccaaaagctgaacatagaattaccatatcacccagcaattccactccttagtatataccccaaagaactgaagacagttattcaacccaaaatgtgtc

SEQ ID NO: 37095 - DNA, 601 bp, Human
tctgacaatattgggcgtgagccactgcttctggcctacaaaagtgtttgaaagaaataaaaggccctctctaaatggaaagacagcctatgttcatggattggaagactttctattgttaagataacaatactcccccaaagtggtctagagactcaatgcaatccctatcaatattttagcctattattactttgcagaataagaaaagttcatcttaaaattcatatggtgttgtaaggaatccaaatacccaaaaacaatcttgaagaagaacaagaaggttggagaattcacactwcctgattccaaaacttactacaaactgacagtaatactggcataaggacacaacagaatagaattgagagtccaggaataaacccatccatcttatggtcagttgattctcaacaaggggtgccaagactatacaatgggggaaagaataatctcttcaacaaatagtgctgggattactggatagtaacatgaaaataaggaagttttaaccctaccctcacacaacaaacaaaaattaactcaaaataagccagtgacctaagcttagaagctaaaactagaacacttaggaggaaac

SEQ ID NO: 37096 - DNA, 601 bp, Human
tacaaaatatcggaagagaatagtgtgagcaactgtatatctacaaagtaggtaacctagatgaaatggacacattcctagtgacacacaaaccactgaaaccaactcaagaagaaatagaagatctgaacagacctataacagattaaatcagtaatcaaaacctctcaaaactaacagcccagaccagatgacttcactggtgagttctaccaatagcttaagaaagaatgaacatgaatcttttacctttttaaaaatatggaagaggaggaaacactatttaagtaattttatgagkctaatattgctctgataacaaaaccagatgaagacatcacaagaaaataaaattatagaccaatatttcttatggacatagatgcaaaaattttcagcaaaaatgttaggaatacattttacgaaggagactcaagacttataggaaagttttttgagtatttttttttttttgagacaaattctcacctgttggtcaggctagagtgcagtggcatgatcatagctcactgcagtctcctgggctcaaccaatccttccacctcagcctcccaagtagctggcactacaggtgctcact

SEQ ID NO: 37097 - DNA, 601 bp, Human
gtccccaacaaggtccgttcctcctcagctggactctcctcttacagccccactccaaacatcccacacttccctttaatctttaaatctcttatttttcacattcttgggcatcttttcccaccatgaagcttcactgaccacctccccatctcagccattacctgggtcaccagatttctgtgcctgattccagtcgagctgcatcactgcctgattctgtctcaaggtgacactcctgtctacttgcttctgcacctccagggacaattctatgagttgtgggaattacataaggggrgttaggttaggaatcgtgcctgcagtggttgatatactatgacttaatatatatactatatacatatatagtctgaagttacaaaatatcggaagagaatagtgtgagcaactgtatatctacaaagtaggtaacctagatgaaatggacacattcctagtgacacacaaaccactgaaaccaactcaagaagaaatagaagatctgaacagacctataacagattaaatcagtaatcaaaacctctcaaaactaacagcccagaccagatgacttcactggtgagttctaccaatagct

SEQ ID NO: 37098 - DNA, 601 bp, Human
cccaccacagaagggcctgcagggcgaggccaaggttgaatcttggagtaggttgaatctctgggtccacaccagagttcctctgccctgcacagaactttctactcagatgggctaccttcctttggcttcacccctcccacactttccttcaatctttagttctatgtgtatcacatcctgcaggacaaggccacggttaatatctcagggtccccaacaaggtccgttcctcctcagctggactctcctcttacagccccactccaaacatcccacacttccctttaatctttaaatytcttatttttcacattcttgggcatcttttcccaccatgaagcttcactgaccacctccccatctcagccattacctgggtcaccagatttctgtgcctgattccagtcgagctgcatcactgcctgattctgtctcaaggtgacactcctgtctacttgcttctgcacctccagggacaattctatgagttgtgggaattacataaggggggttaggttaggaatcgtgcctgcagtggttgatatactatgacttaatatatatactatatacatatatagtctgaagttacaaaata

SEQ ID NO: 37099 - DNA, 601 bp, Human
aaaaaaaaaaaacaaaaaaacaaaaattagctgggcgtggtagcacacacctgtagtcccagctattagggaggctgaggcaggagaatcgctcgaacctgggaggcggagactgcagtgagctgagatcgtgccactgcactccagcctggctgacacagcgagactctgtctcaataaaaaaaagaacacaggtgtgagctggtgggtcggatgctcagaaatgcttacccaaagccggcttgggaaggactgactttcctggggagataatgtacccataacagagacccctgagccycagggctgagctgagcagcaaggctatgcccggactcagactattcacccaccaaccaactccaccagcactcacacggtgggagaaggtgaaggtaactggggagctgaggttttgggtgtcgttgttgctcagaaaggcagagatcacatctgagagcaggatgggggagccgtcctgcagcaagccctggtgtgtctcatgcagaagcatctgcttctcaggttccaggaccagaggggcctcagccagcaacttgcccatccctggaatggagacaaggcccaccacagaagggcc

SEQ ID NO: 37100 - DNA, 601 bp, Human
ccttctgtctcgggatcactgactgcaggaacagaacacaggtgtgggctgggcatggtggctcacgcctgtaatcccagcactttgggaggctgaagcaggtggatcacttgaggtcaggagtttgagaccagcctggccaacatggtgaaaccccatctctactaaaaaaaaaaaaaaaacaaaaaaacaaaaattagctgggcgtggtagcacacacctgtagtcccagctattagggaggctgaggcaggagaatcgctcgaacctgggaggcggagactgcagtgagctgagatcrtgccactgcactccagcctggctgacacagcgagactctgtctcaataaaaaaaagaacacaggtgtgagctggtgggtcggatgctcagaaatgcttacccaaagccggcttgggaaggactgactttcctggggagataatgtacccataacagagacccctgagccccagggctgagctgagcagcaaggctatgcccggactcagactattcacccaccaaccaactccaccagcactcacacggtgggagaaggtgaaggtaactggggagctgaggttttgggtgtcgttgttg

SEQ ID NO: 37101 - DNA, 601 bp, Human
aagtttgccagagggtcatgtgagaagggatatgagtggcctctaggaactgaatgtgatgccttcctgacagctaagaaagtgagacttcagtcctacaatcacaagaaactgaattctgccagcaaccagggagcttggagaaggacctcaagtctcagatgaaatggcagccctgggggtggggtgacatgatgatttcagtcttgtaagaccctgagcagaaaagccatcttgctatgccagcttgctgacccagagctgtgagataatgcatatattttttttaaaaggctgctaygtctctggggatttgttacacggcaataaatgcagagtgcatcccctcctaagggtctcacctgcacatcgtagtgggccatgaggacggcaaagctgctcaggtgggtgcaacggcagatggtgctggtgtctctggtgcctattgtgctgcagcctgtggtggcccagtgaccacatccattctggccatgctcccagaagacacagagcaccttctgtctcgggatcactgactgcaggaacagaacacaggtgtgggctgggcatggtggctcacgcctgtaatcccagcactttg

SEQ ID NO: 37102 - DNA, 601 bp, Human
cctccagataggaatgctagaagtttgccagagggtcatgtgagaagggatatgagtggcctctaggaactgaatgtgatgccttcctgacagctaagaaagtgagacttcagtcctacaatcacaagaaactgaattctgccagcaaccagggagcttggagaaggacctcaagtctcagatgaaatggcagccctgggggtggggtgacatgatgatttcagtcttgtaagaccctgagcagaaaagccatcttgctatgccagcttgctgacccagagctgtgagataatgcatatattttttttaaaaggctgctatgtctctggggatttgttacacggcaataaatgcagagtgcatcccctcctaagggtctcacctgcacatcgtagtgggccatgaggacggcaaagctgctcaggtgggtgcaacggcagatggtgctggtgtctctggtgcctattgtgctgcagcctgtggtggcccagtgaccacatccattctggccatgctcccagaagacacagagcaccttctgtctcgggatcactgactgcaggaacagaacacaggtgtgggctgggcatggtggctcacg

SEQ ID NO: 37103 - DNA, 601 bp, Human
ggcctagcctcccagcctacatctttctcccgtgctggatgcttcctgcccttgaacatcagactccaagttcttcagttctgggactcggactggctctccttgctcctcagcctgcagacggcctatcgtgggaccttgtgatcatgtgagttaatacctaataaactcccctttatatatatctatatatatagatctctctctatatatctctatatatgtatatatttgagtcagtgggttgggaaaggcagatccactcttaatctgggtgggcaccatctaatcagctgccagygtggctagaatataagcaggcagaaattatctatctatctatctatctatctatctatctatctatctatctatctatctatctatctattccattagttctgtccctctagagaacctcgactaatacaaagcttaagagggattctgcgtgaggaaatttttttccttgtcctccagataggaatgctagaagtttgccagagggtcatgtgagaagggatatgagtggcctctaggaactgaatgtgatgccttcctgacagctaagaaagtgagacttcagtcctacaatcacaag

SEQ ID NO: 37104 - DNA, 601 bp, Human
taatcagatgagtctttataagctctgggctcttcctggagaatcagattcaaaacttgtgacggttaatactgggtgtcaacttgattggattgaaggatacaaagtattgatcctgggtgtgtctatcagggtgttgccaaaggaaattaacatttgagtcagtggactgggaaaggcagatccactcttaatctgggtgggcactgtctaatcagctgccagcgtggctagaatataagcaggcagaaaaatgtgaaaagagagactggcctagcctcccagcctacatctttctccygtgctggatgcttcctgcccttgaacatcagactccaagttcttcagttctgggactcggactggctctccttgctcctcagcctgcagacggcctatcgtgggaccttgtgatcatgtgagttaatacctaataaactcccctttatatatatctatatatatagatctctctctatatatctctatatatgtatatatttgagtcagtgggttgggaaaggcagatccactcttaatctgggtgggcaccatctaatcagctgccagtgtggctagaatataagcaggcagaaattat

SEQ ID NO: 37105 - DNA, 601 bp, Human
gccaggctggtcttgaactcctgacctcatgatccacccgcctcggcctcccaaagtgctgggattacagtcgtgagccaccacacccgtcctaatttttttttttatttttgtagagacagggtctttctgtgttgcacaggctggtctcgaattcctgggctcaagtgatcctcccgtttcagcctcccaaagcacagagattccaggtgtgggcccgttaggttttgaagggaaagtgagagttaaagaaagacagagagttggcagctctacagcaatgcaggtttatgtccagcasgagacttgtggaggggggagctagcttcgtgccagaacccactgccgcttacaggctggggtaattacaggtctgggcgggaggggctgggcggtatggcttgctgcctgggaggatattgataagatgttcctgtcatggaaaacaaaagggtggtttggccctttctcccgcaggatatgatgatgatgtcccttggatctactctaagtgatgagataagaaagtcaggtgggcgaggtgtggtggttcctgcctgtaataccagcactttgggaggccgaggcgggtggattactt

SEQ ID NO: 37106 - DNA, 601 bp, Human
cattcaagaatgagggagccaggtaaatttgtgaagatgtcaccaatttaatttaatttgcgaaggtgtcacccgagcctcatgggtggctaggaatacaggcgtagtcatgtaggtgacaacgggtgtgcattatagtcatgtatggcaccatgccctgctaattttttttttttgacagtcttgctctgtcgcccaggctggagtgcagtggtgcgatctctgctcactgcagcctctgtctcctcggttcaagcgattctcgtgtctcagcctcccaagtagttgggattacaggcaygtgcctccatgccaggctaatttttatacttttagtagagacagggtcacaccatgttggccaggctggtcttgaactcctgacctcatgatccacccgcctcggcctcccaaagtgctgggattacagtcgtgagccaccacacccgtcctaatttttttttttatttttgtagagacagggtctttctgtgttgcacaggctggtctcgaattcctgggctcaagtgatcctcccgtttcagcctcccaaagcacagagattccaggtgtgggcccgttaggttttgaagggaaagtg

SEQ ID NO: 37107 - DNA, 601 bp, Human
tatatatacgtatacacacacacacacacacacatatatatatatatatttttttttttttttgagacggaatttcactcttgttgcccaggctggcatgcaatggtgcgatctcggcttaccacaacctccacctcctgggttcaagagattctcttgcctcagcctcctgagtaactgggattacaggtatgcgccaccatgcctggctaattttgtatttttagtagagacggggtttctccatgttggtcaggctggtctcaaactcccgacctgaggtgatccgcccacctcagtytcccaaagtgctgggattacaggcatgagccaccacgcccagccgggctattatattaaggaatcaaatgccgcatcattccatgagccagcgtgtcctgcgtcaaggaagggagccctctggaacaccgctgtcaataccttgtgtccggtttgatcaattgccacgaggaagaggaggtgggccaggaagaggcagagcgagagctgcagatgcagtgaggtgctggtgttctggatggctttacacaggagaaaagtgagggccgccaggaggaggcacagcagagagacgctcagc

SEQ ID NO: 37108 - DNA, 601 bp, Human
gtgaaggtggccaggtagagatagtgcaaggtaccggcgatgatggagcacagcacctggcggagaagtaaaagacgcccagagcggcgatcagatttgagtgtggcccatggcttctcctgtaccaagttgttggggagaattctgagatatttgatggcattatagagaatatttgctgtgtagttgagtcaggcaatgggaaattggtggtgttctcttctaatattccccaggactcaagggcctatatatatatatacatgtatatatacgtatacacacacacacacacacacayatatatatatatatttttttttttttttgagacggaatttcactcttgttgcccaggctggcatgcaatggtgcgatctcggcttaccacaacctccacctcctgggttcaagagattctcttgcctcagcctcctgagtaactgggattacaggtatgcgccaccatgcctggctaattttgtatttttagtagagacggggtttctccatgttggtcaggctggtctcaaactcccgacctgaggtgatccgcccacctcagtctcccaaagtgctgggattacaggcatgagccacc

SEQ ID NO: 37109 - DNA, 601 bp, Human
gcagtgaggaagaggtacagggcctccagcagcatccaggtgaaggtggccaggtagagatagtgcaaggtaccggcgatgatggagcacagcacctggcggagaagtaaaagacgcccagagcggcgatcagatttgagtgtggcccatggcttctcctgtaccaagttgttggggagaattctgagatatttgatggcattatagagaatatttgctgtgtagttgagtcaggcaatgggaaattggtggtgttctcttctaatattccccaggactcaagggcctatatatatatatrcatgtatatatacgtatacacacacacacacacacacatatatatatatatatttttttttttttttgagacggaatttcactcttgttgcccaggctggcatgcaatggtgcgatctcggcttaccacaacctccacctcctgggttcaagagattctcttgcctcagcctcctgagtaactgggattacaggtatgcgccaccatgcctggctaattttgtatttttagtagagacggggtttctccatgttggtcaggctggtctcaaactcccgacctgaggtgatccgcccacct

SEQ ID NO: 37110 - DNA, 601 bp, Human
gtgttccataaaggtgaggcctggaggctgcagaaatggccactgtcacagctgggactccgtagcccacagggaacatgagcttcttcatgaatctgttgatgcttgagtagttgaccaccgtcaggttccgtgcagtgaggaagaggtacagggcctccagcagcatccaggtgaaggtggccaggtagagatagtgcaaggtaccggcgatgatggagcacagcacctggcggagaagtaaaagacgcccagagcggcgatcagatttgagtgtggcccatggcttctcctgtaccawgttgttggggagaattctgagatatttgatggcattatagagaatatttgctgtgtagttgagtcaggcaatgggaaattggtggtgttctcttctaatattccccaggactcaagggcctatatatatatatacatgtatatatacgtatacacacacacacacacacacatatatatatatatatttttttttttttttgagacggaatttcactcttgttgcccaggctggcatgcaatggtgcgatctcggcttaccacaacctccacctcctgggttcaagagattctcttgcct

SEQ ID NO: 37111 - DNA, 601 bp, Human
gaagataaggattgtgagaatttgcactaaccgggaaggtgttccataaaggtgaggcctggaggctgcagaaatggccactgtcacagctgggactccgtagcccacagggaacatgagcttcttcatgaatctgttgatgcttgagtagttgaccaccgtcaggttccgtgcagtgaggaagaggtacagggcctccagcagcatccaggtgaaggtggccaggtagagatagtgcaaggtaccggcgatgatggagcacagcacctggcggagaagtaaaagacgcccagagcggcgrtcagatttgagtgtggcccatggcttctcctgtaccaagttgttggggagaattctgagatatttgatggcattatagagaatatttgctgtgtagttgagtcaggcaatgggaaattggtggtgttctcttctaatattccccaggactcaagggcctatatatatatatacatgtatatatacgtatacacacacacacacacacacatatatatatatatatttttttttttttttgagacggaatttcactcttgttgcccaggctggcatgcaatggtgcgatctcggcttacca

SEQ ID NO: 37112 - DNA, 601 bp, Human
caaaggacatgatcttgttattttattttattttatttttttgagatggagtctcgctctgtggccaggctgaagtgcaatggagccatcttggctcactgcaaactccacctcccaggttcaagcgattcttgtgcctcagcctcccaagtagctgggattacaggcacccaccaccacgcccagctaacttttgtatttttagtagagacggggtttcaccatgttggccaggatggtctcaatctcttgaccttgtgatctgctcgcctcggcctcccaaagtgctgggattccaggygtgagccaccgcacccggccgatctccttattctttatggctgcatcatgtacaagtttttttgtggacatcgttttcatttgttttgggtatatacctgggtcatatggtagctctatggttaacttttggaggattagtgttaatagttcacaaaaccaaaaacggaaaaagaggaagcactttccaaatcttctacgaggccagtgttactctgacaccaaacccagaaatagacatcacaagaaaagaaaactgcagaccaaaatcccttatgaaaatgaatgcaaaaatcctcaa

SEQ ID NO: 37113 - DNA, 601 bp, Human
cttgtttgtgtccatgggtacccaatgtttagctcctacttataagtgagaacatgcggtatttgattttctgttcctgcattaattcacttaggataatggcctccagctccatccatattcctgcaaaggacatgatcttgttattttattttattttatttttttgagatggagtctcgctctgtggccaggctgaagtgcaatggagccatcttggctcactgcaaactccacctcccaggttcaagcgattcttgtgcctcagcctcccaagtagctgggattacaggcacccacsaccacgcccagctaacttttgtatttttagtagagacggggtttcaccatgttggccaggatggtctcaatctcttgaccttgtgatctgctcgcctcggcctcccaaagtgctgggattccaggcgtgagccaccgcacccggccgatctccttattctttatggctgcatcatgtacaagtttttttgtggacatcgttttcatttgttttgggtatatacctgggtcatatggtagctctatggttaacttttggaggattagtgttaatagttcacaaaaccaaaaacggaaaaag

SEQ ID NO: 37114 - DNA, 601 bp, Human
tcatcctagcctgtctaatatgaattatacacgtaagtctttttcttaaatattgagtaacagtgttgagtttgaagattcaagagtggtcttaggaaacctaacccaacccatgacaacccaggggacattcctgctcttgtcaccatctttattatcttgtttttctaatgaccctcagcggggcagcgaggatgctcagatgatgtcactcacagagaagatggcgcagacaggtccaaggaagccccatataaatcccttttctggttggagccagcagctgaaaaaagagagattaaaaaaaaatgcatcagtttttggagatatggaacagttatgtaaatctattccatccctcctcaccacttcctcacttccttcctacgtcaacaatattaagtgtttctttagtgatagggtctgtggttggctctgaagatacagtggtggagaaaatgaacacggtcttagatccccaaaatttcaactcaaggaagatacacacaatcagacacattcaaacaatgaaacaaaaatggaaggttgtgccaggcacagtggctcacaccaggactttgggaggccgaggtgggaggat

SEQ ID NO: 37115 - DNA, 601 bp, Human
aacctgtggtatttgtctttttgtgcctggcttatttcacttaagagagtgacctccagtttcatccatgttgctgcaaatgacatggtttcattctgttttgtgatcgaatcgtatcctattttgtatatataccatttaccagtcaatgaagattcttcctgttgctctgggattcacaaactgagattagacatggacaaaacatgttgcatggggtctcaacaggataccactgaatctgtgatggctgccatagaaggatggctgcgtctgttttttctgggtcccttcaaaagamcctgagaagggacctcagtggctgctgaggcacatggcttggctcttgggaaccatacatgtctgtgtggttatcacccccttctccatcttaccttgtgttccggagggtggacacttcactattgagggaggagagtctgtttttcaaaatccagagagtcaccagaaagagaactaaattcaccttcagaaaaccacagaagatttgttgaatagattttgaaacctgttatctctttttttttttttttccagacagggtcttgctctgttgcccaggctggagtgtggcggtgca

SEQ ID NO: 37116 - DNA, 601 bp, Human
ccttttagtttattgattcgtaatgtttgtacatctttgtggggacatatgtgatattttgttaacatgcatagagtgtgtcatgattaagtcagagtatttggggtatccgtcacttcgcgtgtctaccatttgtatgtgttgggaacacttcaaattctcccctctagctattttgaaatatacaacatattgtgaactagagtcaccctactctgccatccaatattataacttattccttctatctgactgtatgttgtacccattaaccaacctctcttcatcaccttgcccactsacataccctttccagactctggaatctatcattctactttatttttatttttagtttttgaggcagagtctcactctattgcccaggctggagtgcagtggtgtgatctcggctcaccgcaacctccgcctcctgggttcaagcggttctcctgcctcagcctcccgagtagctgggactacaggtgcctgccaccatgcccggctaacttttatcattctactttctgcctccacaagatcagcttcttcggctcctctctatgtaagtgacaacctgtggtatttgtctttttgtgcc

SEQ ID NO: 37117 - DNA, 601 bp, Human
agaagtttttaaccttttagtttattgattcgtaatgtttgtacatctttgtggggacatatgtgatattttgttaacatgcatagagtgtgtcatgattaagtcagagtatttggggtatccgtcacttcgcgtgtctaccatttgtatgtgttgggaacacttcaaattctcccctctagctattttgaaatatacaacatattgtgaactagagtcaccctactctgccatccaatattataacttattccttctatctgactgtatgttgtacccattaaccaacctctcttcatcrccttgcccactcacataccctttccagactctggaatctatcattctactttatttttatttttagtttttgaggcagagtctcactctattgcccaggctggagtgcagtggtgtgatctcggctcaccgcaacctccgcctcctgggttcaagcggttctcctgcctcagcctcccgagtagctgggactacaggtgcctgccaccatgcccggctaacttttatcattctactttctgcctccacaagatcagcttcttcggctcctctctatgtaagtgacaacctgtggtatttg

SEQ ID NO: 37118 - DNA, 601 bp, Human
atagagccactgcactccagcctgggagtgacagagcgagactctgtctcaaaaaaaaaaaaggattatttttgaatatgcaaagagatttctgtgttcatgaactacacagtctcttcaaatcaccaatacaaccaggcatgagacacaaaatttggaaaggataatgataggaatctagaagaaagttcattaattttgcacaagggtgcctggaacaacaaactgctcaaaccctgtagaggaattatttttatttttatttatttatttttttgagatggaatctcgctctgtcacycaggctggagtgcagtggcgtgatcttggctcactgcaacctccgcctcccaggtgaagtgactctcccacctcagcctcctgagtagctgggattatagacgcccaccaccatgcctggctaatttttgtatttttagtagagatggggtttcaccatgttggccaggctggtcttgaactcatgacctcaagtgatccgcctacctcggcctcccaaagtgttaggattacaggcgtgagccaccatgcctggcccccgtaaaggatttaatgttgattaggattttcccagagggag

SEQ ID NO: 37119 - DNA, 601 bp, Human
gtgagtcgagatagagccactgcactccagcctgggagtgacagagcgagactctgtctcaaaaaaaaaaaaggattatttttgaatatgcaaagagatttctgtgttcatgaactacacagtctcttcaaatcaccaatacaaccaggcatgagacacaaaatttggaaaggataatgataggaatctagaagaaagttcattaattttgcacaagggtgcctggaacaacaaactgctcaaaccctgtagaggaattatttttatttttatttatttatttttttgagatggaatctcsctctgtcactcaggctggagtgcagtggcgtgatcttggctcactgcaacctccgcctcccaggtgaagtgactctcccacctcagcctcctgagtagctgggattatagacgcccaccaccatgcctggctaatttttgtatttttagtagagatggggtttcaccatgttggccaggctggtcttgaactcatgacctcaagtgatccgcctacctcggcctcccaaagtgttaggattacaggcgtgagccaccatgcctggcccccgtaaaggatttaatgttgattaggattttc

SEQ ID NO: 37120 - DNA, 601 bp, Human
aactcaggaggcggaggttgcagtgagtcgagatagagccactgcactccagcctgggagtgacagagcgagactctgtctcaaaaaaaaaaaaggattatttttgaatatgcaaagagatttctgtgttcatgaactacacagtctcttcaaatcaccaatacaaccaggcatgagacacaaaatttggaaaggataatgataggaatctagaagaaagttcattaattttgcacaagggtgcctggaacaacaaactgctcaaaccctgtagaggaattatttttatttttatttattyatttttttgagatggaatctcgctctgtcactcaggctggagtgcagtggcgtgatcttggctcactgcaacctccgcctcccaggtgaagtgactctcccacctcagcctcctgagtagctgggattatagacgcccaccaccatgcctggctaatttttgtatttttagtagagatggggtttcaccatgttggccaggctggtcttgaactcatgacctcaagtgatccgcctacctcggcctcccaaagtgttaggattacaggcgtgagccaccatgcctggcccccgtaaagga

SEQ ID NO: 37121 - DNA, 601 bp, Human
gtgcagcccaggatgaacagctgagctgtcgctttaaatgccagcatcctggattgagtaagaaaggaggctggtgatgcacccagagaaagagaatcaaggctatttcatctgtgcccatggagtcccctgccctcccctgtagatgatttctcagactgggctgtggtcagcttagatatttactgtcaactatagcccacagtagaaatgccacctggggttggccacgttggctcatgcctgtaatcccagcactttggggggccaaggcaggcagatcacctgaggtcaggagttygagaccagcccgaccaacatggtgaaacctggtctctactaaaaaaatacaaaaattagccaggtgtggtcgggggggcgcctgtaatcccagctactcaggaggctggggcagtagaattgcttgaactcaggaggcggaggttgcagtgagtcgagatagagccactgcactccagcctgggagtgacagagcgagactctgtctcaaaaaaaaaaaaggattatttttgaatatgcaaagagatttctgtgttcatgaactacacagtctcttcaaatcaccaatacaaccaggcat

SEQ ID NO: 37122 - DNA, 601 bp, Human
tgatgatggtgaagaggtaggccatgacccgggcagccggacccacctgcaagatgcccagacaccacgtgcagcccaggatgaacagctgagctgtcgctttaaatgccagcatcctggattgagtaagaaaggaggctggtgatgcacccagagaaagagaatcaaggctatttcatctgtgcccatggagtcccctgccctcccctgtagatgatttctcagactgggctgtggtcagcttagatatttactgtcaactatagcccacagtagaaatgccacctggggttggccacgktggctcatgcctgtaatcccagcactttggggggccaaggcaggcagatcacctgaggtcaggagttcgagaccagcccgaccaacatggtgaaacctggtctctactaaaaaaatacaaaaattagccaggtgtggtcgggggggcgcctgtaatcccagctactcaggaggctggggcagtagaattgcttgaactcaggaggcggaggttgcagtgagtcgagatagagccactgcactccagcctgggagtgacagagcgagactctgtctcaaaaaaaaaaaaggattatttttg

SEQ ID NO: 37123 - DNA, 601 bp, Human
aaggatttttttttttttttaaatttttgggatagggtctcactctgttgcctgggctggagtgcagtggcatgatcatggctcactacagcctcaacctactgggctcaagtgattgtcccacctcagcctcccgaggagtagctgggactacaggtgtatgccaccatgtctggctaatttttatttttattttttgtagagatgggatcttgctatgttgcccagggtcatcttgcactcctggcctcaggtgatcctcttgcctaggcctcccaaatgctgggatgacagtgatgcygggatgacaggctatgactgattaaaaaaaaacatttaaactgagatcattgctaatggttaatgagtcaaggcgtactcagatgcgagcctttctagggcattgcctgctgtattcccaggtttccttgtgtgataggcacatgctcctcaggtgggtcggttagtgaagtgctctggagcaatgcgtgatcttaccgtgctgggtttggaggtgtcagccttagcactgctggagagtgtgtgcatctcagactcagttttcaatttcctgatccctttggaccatttcccatattgc

SEQ ID NO: 37124 - DNA, 601 bp, Human
aatgcttctaggtagaatgtgcatcactgcttcagatcaattcctgctcatttagttaaccatgcatggcacatagtaggtgtccaataggagtgtttgtgtgtgagagtcaaactaagcacagttccctaaggagtaagagccaaggatttttttttttttttaaatttttgggatagggtctcactctgttgcctgggctggagtgcagtggcatgatcatggctcactacagcctcaacctactgggctcaagtgattgtcccacctcagcctcccgaggagtagctgggactacagrtgtatgccaccatgtctggctaatttttatttttattttttgtagagatgggatcttgctatgttgcccagggtcatcttgcactcctggcctcaggtgatcctcttgcctaggcctcccaaatgctgggatgacagtgatgccgggatgacaggctatgactgattaaaaaaaaacatttaaactgagatcattgctaatggttaatgagtcaaggcgtactcagatgcgagcctttctagggcattgcctgctgtattcccaggtttccttgtgtgataggcacatgctcctcaggtg

SEQ ID NO: 37125 - DNA, 601 bp, Human
agcctaaatcccagttaacacttatttctgtttaattcataaatatgtacagcatttcctcccatgcttgccttattgggtggtggtgccaagtgactgtgagatagacttgtatgtagaggaaagggatagggtaaatgcttctaggtagaatgtgcatcactgcttcagatcaattcctgctcatttagttaaccatgcatggcacatagtaggtgtccaataggagtgtttgtgtgtgagagtcaaactaagcacagttccctaaggagtaagagccaaggatttttttttttttttwaatttttgggatagggtctcactctgttgcctgggctggagtgcagtggcatgatcatggctcactacagcctcaacctactgggctcaagtgattgtcccacctcagcctcccgaggagtagctgggactacaggtgtatgccaccatgtctggctaatttttatttttattttttgtagagatgggatcttgctatgttgcccagggtcatcttgcactcctggcctcaggtgatcctcttgcctaggcctcccaaatgctgggatgacagtgatgccgggatgacaggctatgactg

SEQ ID NO: 37126 - DNA, 601 bp, Human
ccactactaagtggtagttggtagaggcagacttgttaagaaagcctaaatcccagttaacacttatttctgtttaattcataaatatgtacagcatttcctcccatgcttgccttattgggtggtggtgccaagtgactgtgagatagacttgtatgtagaggaaagggatagggtaaatgcttctaggtagaatgtgcatcactgcttcagatcaattcctgctcatttagttaaccatgcatggcacatagtaggtgtccaataggagtgtttgtgtgtgagagtcaaactaagcacwgttccctaaggagtaagagccaaggatttttttttttttttaaatttttgggatagggtctcactctgttgcctgggctggagtgcagtggcatgatcatggctcactacagcctcaacctactgggctcaagtgattgtcccacctcagcctcccgaggagtagctgggactacaggtgtatgccaccatgtctggctaatttttatttttattttttgtagagatgggatcttgctatgttgcccagggtcatcttgcactcctggcctcaggtgatcctcttgcctaggcctcccaa

SEQ ID NO: 37127 - DNA, 601 bp, Human
ctgcctcctgggttcacaccattctcctgccacagcctcccgagtagctgggactacagtcgcccaccaccacgcctggctattttttttttttttttgtatttttagtagagatggggtttcaccgtgttagccaggatggtctcgatctcctgactttgtgatccacctgcctcggcctcccaaagtgctgggattacaggcatgagtcactgtgcctggccgagactctgtacatttgacacaaatccaagtagtcttactttgctcatcagtgaaatggggttagaattacacatayaatctggagaagatggaagaagaggtgagaaaaatacaacagaactttgtatgtctacattaataaatgttggttattagtcatcaatgtcatgaattatcccatgccattgaggcataggataatatggcttcaagtgatccccaagttgtcccgggctcaagtgatcttcctgctttggcctcccagagtgctggcattacaagcttgaaccactgttcctggctgatttataaaaaagcatttaaactgagatcattgctaatggttaatgagtcaaggagtcgctcaaatgtgaac

SEQ ID NO: 37128 - DNA, 601 bp, Human
ccgtctctagtaaaaatacaaaattagccaggcttggtggcacatgcctgtaatcccagctacttgggaggtggaggcaggagaatcgctttaacccaggaggcggaggttgcggtgagctgagatagcaccattgtactccagcctgggtaataagagcgaaactccgtctcaaaaaaaaaaaaaagaaaaataaaaaaggaaaaaggtaatgagagaaatgcaaatgtggaaaaagtgcctggcagcatggtgggcttcttttcaagactttaaaaaatttattatttatgtatttactttacacaaggggtcttgctctgtcacccaggctgtagtgcagtggcataatcgtagctcaccgtggccttgaactcctgggctcaagtgatcctcctgcctcagcctcccaagcagctgggattataggcatgcaccaccatgcccagctagtttttatattttgtgtagagatgggattttgccatgttgcacaggttggtctccaactcctgggctcaagcgatcctctcgcctcccaagtagctgggactacaggcatgtgccaccacgcccagcgaatttttaaaacttttttata

SEQ ID NO: 37129 - DNA, 601 bp, Human
ggctgaggcgggcagatcacctgaggtcgggaatttgagaccaacctgaccaacatggagaaatcccgtctctagtaaaaatacaaaattagccaggcttggtggcacatgcctgtaatcccagctacttgggaggtggaggcaggagaatcgctttaacccaggaggcggaggttgcggtgagctgagatagcaccattgtactccagcctgggtaataagagcgaaactccgtctcaaaaaaaaaaaaaagaaaaataaaaaaggaaaaaggtaatgagagaaatgcaaatgtggaaaragtgcctggcagcatggtgggcttcttttcaagactttaaaaaatttattatttatgtatttactttacacaaggggtcttgctctgtcacccaggctgtagtgcagtggcataatcgtagctcaccgtggccttgaactcctgggctcaagtgatcctcctgcctcagcctcccaagcagctgggattataggcatgcaccaccatgcccagctagtttttatattttgtgtagagatgggattttgccatgttgcacaggttggtctccaactcctgggctcaagcgatcctctcgcc

SEQ ID NO: 37130 - DNA, 601 bp, Human
atggcagagactgcagaataagagcaagacacacattttcttttcttttcttttcttttttttttttttttgagacatagtctcactctgtcacccaggctggagtgcagtggctcgatcttggctttactgcaacctctgcctcctgggttcgagtgattcttgtgcctcagcctcccaagtagctggaattacaagcatccaccaccatgcctggctagtttttgtgtttttagtagaggtggggtcttgccatgttggccaggctggtctcgaactcctgacctcaagtgctctgccygccttggcctcccaaagtgttgggattacaggtgtgagccagcgtgtccggccaaggcacatacattttcaaacaccagagataacaagttttaggaaacagtagaagataaaatgacattaagtaatgcaatggattttcttggtcctttgtcagtagctggtagaaatatctgatcacacaccttaaatttcagaagcctttgttggctatctgatgacctaactctaattccctacacaaaagtacatgtttcctttcttcaatgtgtatatatcatttctagtggctgtgtggggt

SEQ ID NO: 37131 - DNA, 601 bp, Human
gttagaagtgttatctattgttaaccacataagatttaaaggaaaaagcactgaattccttttttttcccctgagacaggggtcttgctttgttgcccaggctggagtgcagtgatgggatcatagctcactggatacttgacctcctgggctcaagcaatactccaatcttagcctcccggtagctgggactacaggcatgcaccaccatgcctggctaatttttatactttttgtagaaacggaattttgccatgttacccaggctggtcttgaagtcctgagctaaagtgatctgccygcctcggcctcccaaagtgctgggattacaagcgtgagccactgcgcccagcctgaattccttttttccatatcttttccatctccaatatgagttatttattcctaggttcataggaaactcagtgtaatttctatggttcgagatggtcagcttcacttgcttatatagttagtatttaatgcataattaatatgtgctcaagagattaataaatattgtgcttcaggagattattcagtagtgatcacaagacattttgtttttatgaaacaagactgcagaaagccatggcagaga

SEQ ID NO: 37132 - DNA, 601 bp, Human
atatatatatttctaaatatatttagaaacatagatatatttagaagtatatagatatttagaaatatatagatatttagaaatacatagatatttctaaatatatatatttagaaatatatagatatttagaaatatatagatatttagaaatatatagatatttagaaatatagatatttagaaatatatagatatttagaaatatagatatttagaagtatagatatttagaaatatatagatatttagaaatatatagatatttaatatctatatatttagaaatatatagatattwaatatctatatatttagaaatatatatatttaatatctatatatttagaaatatatatatatttagaaatatatatgactatagaaagaaaacctataatttccattttgaaaaagaaataagaaattagttaaataagtagattatagctgcttgtgccacaaaaataagtaactatgtgagatgatagatatattaatttgcttcacatatagataaccattttattatctatatgtatcccataacttcatgggttaaacctcaattgtgtgtatacacaataaaatttattaaaaa

SEQ ID NO: 37133 - DNA, 601 bp, Human
agctggcctgaaatatatatatatatttctaaatatatttagaaacatagatatatttagaagtatatagatatttagaaatatatagatatttagaaatacatagatatttctaaatatatatatttagaaatatatagatatttagaaatatatagatatttagaaatatatagatatttagaaatatagatatttagaaatatatagatatttagaaatatagatatttagaagtatagatatttagaaatatatagatatttagaaatatatagatatttaatatctatatatttakaaatatatagatatttaatatctatatatttagaaatatatatatttaatatctatatatttagaaatatatatatatttagaaatatatatgactatagaaagaaaacctataatttccattttgaaaaagaaataagaaattagttaaataagtagattatagctgcttgtgccacaaaaataagtaactatgtgagatgatagatatattaatttgcttcacatatagataaccattttattatctatatgtatcccataacttcatgggttaaacctcaattgtgtgtatacacaa

SEQ ID NO: 37134 - DNA, 601 bp, Human
gagctggcctgaaatatatatatatatttctaaatatatttagaaacatagatatatttagaagtatatagatatttagaaatatatagatatttagaaatacatagatatttctaaatatatatatttagaaatatatagatatttagaaatatatagatatttagaaatatatagatatttagaaatatagatatttagaaatatatagatatttagaaatatagatatttagaagtatagatatttagaaatatatagatatttagaaatatatagatatttaatatctatatatttmgaaatatatagatatttaatatctatatatttagaaatatatatatttaatatctatatatttagaaatatatatatatttagaaatatatatgactatagaaagaaaacctataatttccattttgaaaaagaaataagaaattagttaaataagtagattatagctgcttgtgccacaaaaataagtaactatgtgagatgatagatatattaatttgcttcacatatagataaccattttattatctatatgtatcccataacttcatgggttaaacctcaattgtgtgtatacaca

SEQ ID NO: 37135 - DNA, 601 bp, Human
acaggtgtgagccactgagctggcctgaaatatatatatatatttctaaatatatttagaaacatagatatatttagaagtatatagatatttagaaatatatagatatttagaaatacatagatatttctaaatatatatatttagaaatatatagatatttagaaatatatagatatttagaaatatatagatatttagaaatatagatatttagaaatatatagatatttagaaatatagatatttagaagtatagatatttagaaatatatagatatttagaaatatatagatattwaatatctatatatttagaaatatatagatatttaatatctatatatttagaaatatatatatttaatatctatatatttagaaatatatatatatttagaaatatatatgactatagaaagaaaacctataatttccattttgaaaaagaaataagaaattagttaaataagtagattatagctgcttgtgccacaaaaataagtaactatgtgagatgatagatatattaatttgcttcacatatagataaccattttattatctatatgtatcccataacttcatgggttaaacctca

SEQ ID NO: 37136 - DNA, 601 bp, Human
tagaggcatgtgccaccacacccggctaattttgtatttttagtagagacagggtttcaccacgtaggccaggctggccttgaactcctgacctcaggtgatctgcctgcctcagcctcccaaagtgctgggattacaggtgtgagccactgagctggcctgaaatatatatatatatttctaaatatatttagaaacatagatatatttagaagtatatagatatttagaaatatatagatatttagaaatacatagatatttctaaatatatatatttagaaatatatagatatttagcaatatatagatatttagaaatatatagatatttagaaatatagatatttagaaatatatagatatttagaaatatagatatttagaagtatagatatttagaaatatatagatatttagaaatatatagatatttaatatctatatatttagaaatatatagatatttaatatctatatatttagaaatatatatatttaatatctatatatttagaaatatatatatatttagaaatatatatgactatagaaagaaaacctataatttccattttgaaaaagaaataagaaattagtt

SEQ ID NO: 37137 - DNA, 601 bp, Human
gatttggaggagtctttgtaggaaggagaggctgtgaaagaggtcttaacgttctatagcttcataaatattgtgcttcagagtgaccaagatatgggccacagctggccgtccatatgctgagagtttgatgagcacattgcagggcatggaagatttccggtttctgcaggaattgaatgccaagcacgccttccataacatccttcatattgctgacatggtgaatttcttgaaacacacagaacaaagtcttttctttcccctctagatggctcaaagattgttcagattttccacsggcaaagagggaagatcttattcagaagatttttctagttaacctgaaatatatatatatgtatgtattttgttgttgagacagagtttcactcttgttgcctgggctggagtgcaatggcgcagcctcgactcactgtaacccccgcctcccaggttcaagcaattctcctgtctcagcctccagagtagccaggattagaggcatgtgccaccacacccggctaattttgtatttttagtagagacagggtttcaccacgtaggccaggctggccttgaactcctgacctcaggtgat

SEQ ID NO: 37138 - DNA, 601 bp, Human
caacaaaaacaaaaacaaaaaattaagaaatccagatcgtggtgtgaacattctagtcctttcagatgttgtcggtatgaaagtcctcttaggctcgttttcctgcttcattttaagatttggaggagtctttgtaggaaggagaggctgtgaaagaggtcttaacgttctatagcttcataaatattgtgcttcagagtgaccaagatatgggccacagctggccgtccatatgctgagagtttgatgagcacattgcagggcatggaagatttccggtttctgcaggaattgaatgccwagcacgccttccataacatccttcatattgctgacatggtgaatttcttgaaacacacagaacaaagtcttttctttcccctctagatggctcaaagattgttcagattttccacgggcaaagagggaagatcttattcagaagatttttctagttaacctgaaatatatatatatgtatgtattttgttgttgagacagagtttcactcttgttgcctgggctggagtgcaatggcgcagcctcgactcactgtaacccccgcctcccaggttcaagcaattctcctgtctcagcctcc

SEQ ID NO: 37139 - DNA, 601 bp, Human
acatgactaaataatcaaacccgtagaactagagaacaacaaaaacaaaaacaaaaaattaagaaatccagatcgtggtgtgaacattctagtcctttcagatgttgtcggtatgaaagtcctcttaggctcgttttcctgcttcattttaagatttggaggagtctttgtaggaaggagaggctgtgaaagaggtcttaacgttctatagcttcataaatattgtgcttcagagtgaccaagatatgggccacagctggccgtccatatgctgagagtttgatgagcacattgcagggcrtggaagatttccggtttctgcaggaattgaatgccaagcacgccttccataacatccttcatattgctgacatggtgaatttcttgaaacacacagaacaaagtcttttctttcccctctagatggctcaaagattgttcagattttccacgggcaaagagggaagatcttattcagaagatttttctagttaacctgaaatatatatatatgtatgtattttgttgttgagacagagtttcactcttgttgcctgggctggagtgcaatggcgcagcctcgactcactgtaacccccgc

SEQ ID NO: 37140 - DNA, 601 bp, Human
ttataaaatagtttatacttcaattgcctagcagtagaaacctgatttctaggaatttcggcttctgagtcaactctagctgcaagagccacttcattttcccctaaaagctccatgaaggcaggagccgtgtctctcttgatctatgtgtgagtaatcaatatttttcacatgactaaataatcaaacccgtagaactagagaacaacaaaaacaaaaacaaaaaattaagaaatccagatcgtggtgtgaacattctagtcctttcagatgttgtcggtatgaaagtcctcttaggctygttttcctgcttcattttaagatttggaggagtctttgtaggaaggagaggctgtgaaagaggtcttaacgttctatagcttcataaatattgtgcttcagagtgaccaagatatgggccacagctggccgtccatatgctgagagtttgatgagcacattgcagggcatggaagatttccggtttctgcaggaattgaatgccaagcacgccttccataacatccttcatattgctgacatggtgaatttcttgaaacacacagaacaaagtcttttctttcccctctagatggctcaa

SEQ ID NO: 37141 - DNA, 601 bp, Human; identical to SEQ ID NO: 30522

SEQ ID NO: 37142 - DNA, 601 bp, Human; identical to SEQ ID NO: 30523

SEQ ID NO: 37143 - DNA, 601 bp, Human; identical to SEQ ID NO: 30524

SEQ ID NO: 37144 - DNA, 601 bp, Human; identical to SEQ ID NO: 30525

SEQ ID NO: 37145 - DNA, 601 bp, Human; identical to SEQ ID NO: 30526

SEQ ID NO: 37146 - DNA, 601 bp, Human; identical to SEQ ID NO: 30527

SEQ ID NO: 37147 - DNA, 601 bp, Human; identical to SEQ ID NO: 30528

SEQ ID NO: 37148 - DNA, 601 bp, Human; identical to SEQ ID NO: 30529

SEQ ID NO: 37149 - DNA, 601 bp, Human; identical to SEQ ID NO: 30530

SEQ ID NO: 37150 - DNA, 601 bp, Human; identical to SEQ ID NO: 30531

SEQ ID NO: 37151 - DNA, 601 bp, Human; identical to SEQ ID NO: 30532

SEQ ID NO: 37152 - DNA, 601 bp, Human; identical to SEQ ID NO: 30533

SEQ ID NO: 37153 - DNA, 601 bp, Human; identical to SEQ ID NO: 30534

SEQ ID NO: 37154 - DNA, 601 bp, Human; identical to SEQ ID NO: 30535

SEQ ID NO: 37155 - DNA, 601 bp, Human; identical to SEQ ID NO: 30522

SEQ ID NO: 37156 - DNA, 601 bp, Human; identical to SEQ ID NO: 30523

SEQ ID NO: 37157 - DNA, 601 bp, Human; identical to SEQ ID NO: 30524

SEQ ID NO: 37158 - DNA, 601 bp, Human; identical to SEQ ID NO: 30525

SEQ ID NO: 37159 - DNA, 601 bp, Human; identical to SEQ ID NO: 30526

SEQ ID NO: 37160 - DNA, 601 bp, Human; identical to SEQ ID NO: 30527

SEQ ID NO: 37161 - DNA, 601 bp, Human; identical to SEQ ID NO: 30528

SEQ ID NO: 37162 - DNA, 601 bp, Human; identical to SEQ ID NO: 30529

SEQ ID NO: 37163 - DNA, 601 bp, Human; identical to SEQ ID NO: 30530

SEQ ID NO: 37164 - DNA, 601 bp, Human; identical to SEQ ID NO: 30531

SEQ ID NO: 37165 - DNA, 601 bp, Human; identical to SEQ ID NO: 30532

SEQ ID NO: 37166 - DNA, 601 bp, Human; identical to SEQ ID NO: 30533

SEQ ID NO: 37167 - DNA, 601 bp, Human; identical to SEQ ID NO: 30534

SEQ ID NO: 37168 - DNA, 601 bp, Human; identical to SEQ ID NO: 30535

SEQ ID NO: 37169 - DNA, 601 bp, Human; identical to SEQ ID NO: 26644

SEQ ID NO: 37170 - DNA, 601 bp, Human; identical to SEQ ID NO: 26645

SEQ ID NO: 37171 - DNA, 601 bp, Human; identical to SEQ ID NO: 26646

SEQ ID NO: 37172 - DNA, 601 bp, Human; identical to SEQ ID NO: 26647

SEQ ID NO: 37173 - DNA, 601 bp, Human; identical to SEQ ID NO: 26648

SEQ ID NO: 37174 - DNA, 601 bp, Human; identical to SEQ ID NO: 26644

SEQ ID NO: 37175 - DNA, 601 bp, Human; identical to SEQ ID NO: 26645

SEQ ID NO: 37176 - DNA, 601 bp, Human; identical to SEQ ID NO: 26646

SEQ ID NO: 37177 - DNA, 601 bp, Human; identical to SEQ ID NO: 26647

SEQ ID NO: 37178 - DNA, 601 bp, Human; identical to SEQ ID NO: 26648

SEQ ID NO: 37179 - DNA, 601 bp, Human; identical to SEQ ID NO: 26644

SEQ ID NO: 37180 - DNA, 601 bp, Human; identical to SEQ ID NO: 26645

SEQ ID NO: 37181 - DNA, 601 bp, Human; identical to SEQ ID NO: 26646

SEQ ID NO: 37182 - DNA, 601 bp, Human; identical to SEQ ID NO: 26647

SEQ ID NO: 37183 - DNA, 601 bp, Human; identical to SEQ ID NO: 26648

SEQ ID NO: 37184 - DNA, 601 bp, Human; identical to SEQ ID NO: 30379

SEQ ID NO: 37185 - DNA, 601 bp, Human; identical to SEQ ID NO: 30380

SEQ ID NO: 37186 - DNA, 601 bp, Human; identical to SEQ ID NO: 27288

SEQ ID NO: 37187 - DNA, 601 bp, Human; identical to SEQ ID NO: 27289

SEQ ID NO: 37188 - DNA, 601 bp, Human; identical to SEQ ID NO: 27290

SEQ ID NO: 37189 - DNA, 601 bp, Human; identical to SEQ ID NO: 27291

SEQ ID NO: 37190 - DNA, 601 bp, Human; identical to SEQ ID NO: 27292

SEQ ID NO: 37191 - DNA, 601 bp, Human; identical to SEQ ID NO: 27293

SEQ ID NO: 37192 - DNA, 601 bp, Human; identical to SEQ ID NO: 27294

SEQ ID NO: 37193 - DNA, 601 bp, Human; identical to SEQ ID NO: 27295

SEQ ID NO: 37194 - DNA, 601 bp, Human; identical to SEQ ID NO: 27296

SEQ ID NO: 37195 - DNA, 601 bp, Human; identical to SEQ ID NO: 27297

SEQ ID NO: 37196 - DNA, 601 bp, Human; identical to SEQ ID NO: 27298

SEQ ID NO: 37197 - DNA, 601 bp, Human; identical to SEQ ID NO: 27299

SEQ ID NO: 37198 - DNA, 601 bp, Human; identical to SEQ ID NO: 27300

SEQ ID NO: 37199 - DNA, 601 bp, Human; identical to SEQ ID NO: 27301

SEQ ID NO: 37200 - DNA, 601 bp, Human; identical to SEQ ID NO: 27302

SEQ ID NO: 37201 - DNA, 601 bp, Human; identical to SEQ ID NO: 27303

SEQ ID NO: 37202 - DNA, 601 bp, Human; identical to SEQ ID NO: 27304

SEQ ID NO: 37203 - DNA, 601 bp, Human; identical to SEQ ID NO: 27305

SEQ ID NO: 37204 - DNA, 601 bp, Human; identical to SEQ ID NO: 27306

SEQ ID NO: 37205 - DNA, 601 bp, Human; identical to SEQ ID NO: 27307

SEQ ID NO: 37206 - DNA, 601 bp, Human; identical to SEQ ID NO: 27308

SEQ ID NO: 37207 - DNA, 601 bp, Human; identical to SEQ ID NO: 27309

SEQ ID NO: 37208 - DNA, 601 bp, Human; identical to SEQ ID NO: 27310

SEQ ID NO: 37209 - DNA, 601 bp, Human; identical to SEQ ID NO: 27311

SEQ ID NO: 37210 - DNA, 601 bp, Human; identical to SEQ ID NO: 27312

SEQ ID NO: 37211 - DNA, 601 bp, Human; identical to SEQ ID NO: 27313

SEQ ID NO: 37212 - DNA, 601 bp, Human; identical to SEQ ID NO: 27314

SEQ ID NO: 37213 - DNA, 601 bp, Human; identical to SEQ ID NO: 27315

SEQ ID NO: 37214 - DNA, 601 bp, Human; identical to SEQ ID NO: 27316

SEQ ID NO: 37215 - DNA, 601 bp, Human; identical to SEQ ID NO: 27317

SEQ ID NO: 37216 - DNA, 601 bp, Human; identical to SEQ ID NO: 27318

SEQ ID NO: 37217 - DNA, 601 bp, Human; identical to SEQ ID NO: 27319

SEQ ID NO: 37218 - DNA, 601 bp, Human
tataagcacatttgtcatacttctaagtggaagaaactcccctagcgagtcgtaagttagataccataagactatagccaccctcaagttattatctctaagacaaataacagattgcacgatgttttactgtgtgccaagaacttttccagttaacattttcacttgaaaaaatagatcacatacttgtaaaatcatacccagcattgacttcataaggcatgtggctttagagtgctttttacaattattaattctattagtcaactagcaggaggctaatgcaattgtcttagaagaygctcagaagacacagaagacattttgagagctgatctgtacatctgcaaaacaaagcaaaagaaaaattttccttcctaaatgatgtaaacatattttcatgtatcacacctaaaatatattaatatgctggcatcataggctgcctgaaagatataaaagcatgagcaaatctggagcaagatcctctccctccccagggttttaataaagcaacaagagaaggaggaacatgatataaaaggttacaggacataagtcattttcataacagactgtgatgttggtgaaattatttaac

SEQ ID NO: 37219 - DNA, 601 bp, Human
tgctgagaaaatctaaattaataacatgaggtttagtcattttcatctataatttctcacaagtactgaagtaccacactggctttggatagacaagtgtacctttgcttctgaaaagctggtcatgcaaaatttttatatgaatcactgaacaaggatagtgcactagagtataaggaatcatttataaagtaaaaatgtgccacagtgaataatgtgaaaaatagcataatggtacttaagaaagtacactgggccaagcacaggggctcacgcctgtaatcccagcactttgggaggycacggcgggtggatcacctgaggtcaggagttcaagaccagctgaccaacatggcgaaattccatctctacaaaaaaaatacaaaaattagctgggtgtggtggtgcatgcctgtaatcccagctactagggaggctgaggcaggagaactgcttgaacccaggaagcggaggttgcagtgagccaagatcatgccattgcactccagcctgggcgacaagagtgaaactccatctcaaaaaaaaaaacaaaagcaaaaacaaaaacaaaaagaaagaaagtacactgttcttcttacac

SEQ ID NO: 37220 - DNA, 601 bp, Human
cattaacaaaggctggtcgaggactgggttccgtggctgctgtttcttaatcactcagcttaaaaagctgtcgagtgctgtgtaagtcatcaccccaaatgtctcttggaaaattccacctgtgacattctgattaaacaagacttctttgttagttgacttcgccataaggactaacagttagttataccgcaattatccaaaacatgctgagaaaatctaaattaataacatgaggtttagtcattttcatctataatttctcacaagtactgaagtaccacactggctttggatagayaagtgtacctttgcttctgaaaagctggtcatgcaaaatttttatatgaatcactgaacaaggatagtgcactagagtataaggaatcatttataaagtaaaaatgtgccacagtgaataatgtgaaaaatagcataatggtacttaagaaagtacactgggccaagcacaggggctcacgcctgtaatcccagcactttgggaggccacggcgggtggatcacctgaggtcaggagttcaagaccagctgaccaacatggcgaaattccatctctacaaaaaaaatacaaaaattagct

SEQ ID NO: 37221 - DNA, 601 bp, Human
tggttttaggaataatgaaggatttatttttattactaggtttaccctccctattacttattctttcctgaaaatatatttttgcccaatttcttcctttgattgtagctaacaatatatatgcatgcttatatatttatatatggtctatattatatataacatgtacacatgttatgtttataaaatacatatatgtgtttatggttatagaatacatcacatttatttatatggtacatatatgtatacataaataacataaattggaattcgatattgttaccctatgtaaccgggwtgtaaatatagtttcaaacaaaatatcttcatagtcaaaaagacagaaacagctatgttataaacagagtgaaaactgcctcatcactttcaggaagcggaggatgacaaacgttccagctctgacctaccaacaaatttctttgagccacatttggggcttgcctgaaagtcagaagaaagacctgctatgcatcacagtggtcagatcaggttttcctaggactctgtccagcatgctggggaacctaataagctctgggtgtccatatgcagcctggtgaaaacagtacctgttcca

SEQ ID NO: 37222 - DNA, 601 bp, Human
agaaagaaaatgcaacatagcttagttatgccatgtgcatttcttttgctcagaatatccaggtttacaaagagttcatattagcattataaacatatgcattatttaatctatacactgtaaagaacctgaaatttgcataaattccttttttaaactgtcataacttttgtgtcagtttttgacacgaaatgtgaacataacctttatgtatttcaatgtatggttttttaaaaaacctgaaaactgaaaacatcttacctctggagagatgaatattaaaataatttttagaaaatastttagtttatatctcagtggttaagttcccataatctggcagagcagtattttaattaatttttgccctatgattggccagacttcaattaaaatcattaatgtcagttcccattaaatagaaacttattgctatgcttaaatggtgaaggttaaaaaaaataagttggtatgtggtggggggtggaatctttctacttgctacatgctaataactaaggtttttacagtttactgccaattagtagtgttagcagcatgcattttttaaagagtgcttctaatggtccatatatgagaa

SEQ ID NO: 37223 - DNA, 601 bp, Human
atcttaaataagtacaactataaatcttttttggaacatttctgttgttacaaacatacttccaagtgaagaaagataacacagttgttattgacaattcattgttagtttaagaaagaaaatgcaacatagcttagttatgccatgtgcatttcttttgctcagaatatccaggtttacaaagagttcatattagcattataaacatatgcattatttaatctatacactgtaaagaacctgaaatttgcataaattccttttttaaactgtcataacttttgtgtcagtttttgacacraaatgtgaacataacctttatgtatttcaatgtatggttttttaaaaaacctgaaaactgaaaacatcttacctctggagagatgaatattaaaataatttttagaaaatactttagtttatatctcagtggttaagttcccataatctggcagagcagtattttaattaatttttgccctatgattggccagacttcaattaaaatcattaatgtcagttcccattaaatagaaacttattgctatgcttaaatggtgaaggttaaaaaaaataagttggtatgtggtggggggtggaa

SEQ ID NO: 37224 - DNA, 601 bp, Human
ttaagatgtttgtcagccgggcgtggtggcgcatgcctgtaatctcagcactttgggaggctgacgcgggcggatcacagggtcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagccgagattgtgcccctgcactccagcctgggcaacagagcaaaactgcctcaaaaaaaamaacaacgaaaaaaagatgtttgtcacagtattatacatcctaggagaaaaggataacactatacatacaaaagcagcagaacggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaaca

SEQ ID NO: 37225 - DNA, 601 bp, Human
tcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagccgagattgtgcccctgcactccagcctgggcaacagagcaaaactgcctcaaaaaaaacaacaacgaaaaaaagatgtttgtcacagtattatacatcctaggagaaaaggataacactatacatacaaaagcagcagaayggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaacagcaattattactaatgggatgagtgctattgcactgtacgactggcagaaatggggatcagatttgccaatggcattctaat

SEQ ID NO: 37226 - DNA, 601 bp, Human
aagtattttatccctccccctaaaaaaaactcttaaaagcaaactgattgttaaaagaaaatgtatgtgaacatcccagaaatttctatcttctctaaattagtatgtgtcttggctcatgtgacttatctcccaatgtatgagagatcttaaagatgaattattcatcctctgttaataaactttgaagtaccatagaagaggtgaaaattctggaacattaagaatgaagaaatataattctaattttcaaaaaaccaaattaaaaatttggggtcataaaccctgttgagtgtgtgaygaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgacaaagaatcagggtagacttaccatttctggctactgccagattatggtcctcttagagactgcaattattggcatgaaatgtaataaaagtggctgtgcttacctttatattgctacacttttc

SEQ ID NO: 37227 - DNA, 601 bp, Human
taataaactttgaagtaccatagaagaggtgaaaattctggaacattaagaatgaagaaatataattctaattttcaaaaaaccaaattaaaaatttggggtcataaaccctgttgagtgtgtgacgaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgrcaaagaatcagggtagacttaccatttctggctactgccagattatggtcctcttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctcca

SEQ ID NO: 37228 - DNA, 601 bp, Human
gaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcraatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcg

SEQ ID NO: 37229 - DNA, 601 bp, Human
tcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagwtaaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcac

SEQ ID NO: 37230 - DNA, 601 bp, Human
aaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccag

SEQ ID NO: 37231 - DNA, 601 bp, Human
attttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgygattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctct

SEQ ID NO: 37232 - DNA, 601 bp, Human
caaatcactcaaagacggctgctaacatttcactttgcacttcagctagcaagaaggaagagagagtaaacaagactgtgtcctccccctcttaatgacagttcttagaatcgcatacagcccttccacttaaatatcatgagaccaaaactggcttcaaagaagttgataatttattatattgactggggagcaatgtgcccagctgaaaagcattattttttttccctaatgagggtaggaagaaaggatatgtagaggtatccaatagtccctgcgacattttgtgtacacttgaaarctaacaaaatcgttactgcagttatttctttagaggcaaggttattggatggcaaggtcattaataaatgtatcatatgagccacaggaataattgaatattaatcggacaactgcaacaatatttgttactatcagcttcgttaaagtgtcagaaaatattctgtggtccaaccagtttattttaccaatgagaattttattttattattattaatatttgagacggactctttctctgtatgcccaggctggagtgcaatggcaagatctcagctcaccgcaatctccgcctcctggg

SEQ ID NO: 37233 - DNA, 601 bp, Human
cacttaggtagtacctaatatgttcatttcagtgcaacttgaaaacattttcccaataattctactttagattactatttcttctttgtagttttctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccrtaacactaaatcatagaacataatttgttcatggaccttccagaacacagaatatttgacttatgcttcaaatatgaagtcgtgatttttaaaaatgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctg

SEQ ID NO: 37234 - DNA, 601 bp, Human
ctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccataacactaaatcatagaacataatttgttcatggaccttccagaacacagaatatttgacttatgcttcaaatatgaagtcgtgatttttaaaamtgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctgacattttaatgaagctgatagtaaaaaaaatagataatggtaatattgtatgataatttaaaagatatatattacaagtattgtatatcttgata

SEQ ID NO: 37235 - DNA, 601 bp, Human
acatttaatttctttttctcaaagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtggtaaggattttcacccgcaaaatattggtctataaaatatcaagtaacatttttgttttttggattattgaacaacaacaaaatcatgacatttttcatcatatttgtgtttgggcaaaatgatgtaaaacaracattagagttatcagaattagtatagatacttgctattctttgagaatagctaatgggactagcttgaagtaggtggttggttttattcccacggagcacagaatgttagactcaatatttctggatgactcgtggcacgtgcttcatcccagcagttagcagcccttaaaccggcagcatcgtgttttcaaatatctcatcacatgtgctctaagttacttgcttatggtttaatttaatatttttaaagtttttaaatcagggactttattatatttactcctgtgcttccaaagat

SEQ ID NO: 37236 - DNA, 601 bp, Human
attagattttggaaggagagcaaaagtcaaagaaagccccagcacacatgcttccaaacgacactactccacatccctaaaagacacttagtttgcaattttagtatgagagttccctatggctctgcaagaccaggagctgctttagcccagagaggctatttgggagagcttagaattccagagacccatacaataagaagatattatgcactataagtacaataatgtcatgagtgtttgcactgtgctccaaaagagctctgatggtctcgttgcctcaaatttgagcccagggttycataaaatgatttgacaaatggaaatccctgaatgaataaacagttcaggttgaatatggaaggtttaaaacaataacttcatgcaaatgattatttaataaataattttcttaaagtaatcataaatttatactagaaattaaaacttgaactttggttaaattttctcataaagtatattgactatggaaaaataataatagctccatttataggcaacaggtattgtgctaggcaagtcgtattttatatttaggatgatctgagaacaatactgcaagaaggatacaaacattttg

SEQ ID NO: 37237 - DNA, 601 bp, Human
acaatatgtgagtttgattatgctctataattacattttattttaacaaataattgcagtgagaaaacatagaataaacttttgaatcaaaatatacatacatacagaaaatcttagatgggatagagacaaataggacattttgcaagcaaccctgcaaagacaagtgtttatataagaaatgtactttcaaagatgttgggtgctggtatttcagtgaaattgactgagcactcattctacctcctcttcccccacatactcattccctcattatgcattgactccaaagtcagcaccrttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtatatatatgtgtatatata

SEQ ID NO: 37238 - DNA, 601 bp, Human
aagtcagcaccgttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtatatatatgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaatatcatccaattacattccttaaaatattatgataggata

SEQ ID NO: 37239 - DNA, 601 bp, Human
acacatatatatatgtgtatatatatgtgtatatatatgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaataycatccaattacattccttaaaatattatgataggataaaagaagttagaagcaaatacagatttttagacctgtaaagagaatgtagttaggcactgaaatatacaatttagtgtatctgaatgataaatatttttttcttttttttcttttgcttataccaaggaggaggagtatagaaggggaggggaaagcctgaattattgcaaattttatctccatttagcccatttatagtgctagttatacaggaattaatgcattgtgatataagcacaattcatgggaatttaaatgggat

SEQ ID NO: 37240 - DNA, 601 bp, Human
gcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgyattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacac

SEQ ID NO: 37241 - DNA, 601 bp, Human
agactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagmtactcgggagcctgagacaagagaattgcttgagcctgggaggtagaggttgcagtgagctgagatcacaccactgtactccagtctaggtgacagattgagacctttctcaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaaga

SEQ ID NO: 37242 - DNA, 601 bp, Human
caggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagytaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaacta

SEQ ID NO: 37243 - DNA, 601 bp, Human
tcaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttcmgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgt

SEQ ID NO: 37244 - DNA, 601 bp, Human
aaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttrctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccatt

SEQ ID NO: 37245 - DNA, 601 bp, Human
aaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtacccygtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtct

SEQ ID NO: 37246 - DNA, 601 bp, Human
acttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcrcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaat

SEQ ID NO: 37247 - DNA, 601 bp, Human
tgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctrcccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttcct

SEQ ID NO: 37248 - DNA, 601 bp, Human
catgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtyattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctc

SEQ ID NO: 37249 - DNA, 601 bp, Human
cctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccac

SEQ ID NO: 37250 - DNA, 601 bp, Human
accgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatrtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccagg

SEQ ID NO: 37251 - DNA, 601 bp, Human
gttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggcttyttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccac

SEQ ID NO: 37252 - DNA, 601 bp, Human
tagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatttttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatcttt

SEQ ID NO: 37253 - DNA, 601 bp, Human
atcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctytgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaa

SEQ ID NO: 37254 - DNA, 601 bp, Human
gtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcratctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtgg

SEQ ID NO: 37255 - DNA, 601 bp, Human
tcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcat

SEQ ID NO: 37256 - DNA, 601 bp, Human
accaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacrtggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgt

SEQ ID NO: 37257 - DNA, 601 bp, Human
ctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctataygtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcacc

SEQ ID NO: 37258 - DNA, 601 bp, Human
accatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacrtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaata

SEQ ID NO: 37259 - DNA, 601 bp, Human
cttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgrccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttc

SEQ ID NO: 37260 - DNA, 601 bp, Human
gcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctaracaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgcttttt

SEQ ID NO: 37261 - DNA, 601 bp, Human
gttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatytgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataata

SEQ ID NO: 37262 - DNA, 601 bp, Human
taactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtwtgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttc

SEQ ID NO: 37263 - DNA, 601 bp, Human
tttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataayacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatc

SEQ ID NO: 37264 - DNA, 601 bp, Human
tggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccrggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaaaaaaaaaaaaat

SEQ ID NO: 37265 - DNA, 601 bp, Human
gtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcrgctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaaaaaaaaaaaaatatatatata

SEQ ID NO: 37266 - DNA, 601 bp, Human
ttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacrgtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaaaaaaaaaaaaatatatatatatatatatatatatatatattgctccatagttttcttgtaacatttttctggttttagtgtcaggataatgctggtctcataaaatga

SEQ ID NO: 37267 - DNA, 601 bp, Human
ggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaaygtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtccccccccccctcacacaagctggagtgcagtggcacgatcttggctcactgcagcctccgcctcc

SEQ ID NO: 37268 - DNA, 601 bp, Human
gaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatrgtaggcatcttttttatccactgtctctactttttaattggagtgtttagatcagttatatttacttctgttttatctaatctgtattatttcatccagtatttttttctttttccattttttttttttagacagagtccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaa

SEQ ID NO: 37269 - DNA, 601 bp, Human
ttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggamagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccatt

SEQ ID NO: 37270 - DNA, 601 bp, Human
tctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttyttgtgctgcccctccctacactgctgtccaaaaatcgctgccagccagaaaactaggaaaaatgtaggattcctcctttttgtttctctgttctcagacatcatggttcctttccgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctg

SEQ ID NO: 37271 - DNA, 601 bp, Human
aaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtamtatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccag

SEQ ID NO: 37272 - DNA, 601 bp, Human
cacggcaccagaatcagtcccaggtctctgggattccacagccccggccctcaggccttgagtgactcgcagaagtggctccctcctcccgggctgccaggttctgagttaggcggatctactcacgttaataactacgctcgtgcttccatctgggaacacccaagcaactcacacacagaggaaccactgggtggttaaaggggctggtggaaggcgggcaggcagatactggggctgaggggggcctggggaccaacgctgctgctctcgagccttcctgctccctccctggcctggyacatcctggagggtgctgccagcaccaggcacagagcccaggtaggctgcggcaggagggccaacacccacaggaagactacgtgagggctcctgatttcagacaactgacaacgggacggcgggctgtctccacactccttcccatcacagcatgtgctgcgctacgctgacactgtctgctgatacttccccggaagtgcaggccagggataaagagcagtacataacccaggaaaggcccatgctgctgcatcttccccttttagtcgtgagctctggggagcatttctgttggtgg

SEQ ID NO: 37273 - DNA, 601 bp, Human
gggcaagtaccagggcagctggttccggcagctcatccaacagtccacccaggcaaccctggcagtgacccctcatccttcacagaagccgctaacgtctccagtcacaaatgtgatactctgggtggctgggtaatttgccaaagtcgcacaaatggcaacacacggcaccagaatcagtcccaggtctctgggattccacagccccggccctcaggccttgagtgactcgcagaagtggctccctcctcccgggctgccaggttctgagttaggcggatctactcacgttaataactaygctcgtgcttccatctgggaacacccaagcaactcacacacagaggaaccactgggtggttaaaggggctggtggaaggcgggcaggcagatactggggctgaggggggcctggggaccaacgctgctgctctcgagccttcctgctccctccctggcctggtacatcctggagggtgctgccagcaccaggcacagagcccaggtaggctgcggcaggagggccaacacccacaggaagactacgtgagggctcctgatttcagacaactgacaacgggacggcgggctgtctccacac

SEQ ID NO: 37274 - DNA, 601 bp, Human
ctcaaaaacaaaacaaaaacccaaataaaagagttctgagaacataaaatgaagacagagtggtttagcagaaatggtcctggttttggttgagtctcgggctgggagattcagaggccgggagtgcgcgggctgggatgcagacgaggactcccgatcagaagcacctgctgccctatctaaagccagccatgcacagtgctattttctgcccctgctgtacttggcttccccgggtacccctggaatctgtgagaagcttgtcccccaacctctgccgatctggtggacagtgtccacmccagagggcacgtccctgcaatgctaacatgccccgtctgcacagagagtccgctggggtctctgagtacatgggacgtggtggcacaccttgccggcagtggacccagacagccggctggggagtagagggaggggcacctgtacaaacatcctggagccaggcggctagaatgaggagtgatttatagcttcccctgagcgtgctgaccccatacttgagggctgagagtcccgaggcccatcaggggcatcctgagaggggtgcacctggatccagaacccccatccccttcagcaa

SEQ ID NO: 37275 - DNA, 601 bp, Human
gggaaaaaggtccctgacaggaggatctggtaggggctggggtagggagtgcaggggggcagctgccaaaaccctctcagccccggccagcacgggctctgcacagggtctgctctaaggacagaggggtgggccctaggcctagccgatccagctgctggtgccagggtcatggctaatccctcagcccgcagggccccaggaaggagccaccagacggctggggctgctgagcagggataatgggccccggagagctggctgcctccccagctgccaccccttgtgtcagctgtcacgragcgccggccctacgtgcctggagctcagctgggcaggacagacgtggaaatccaggccacatgggaaaaacaaaaagtgtgtgtctgtgctgggggcgttggggggcagtgaacatctcctcagccttctgacaagaataaaggacaggaaaaacacgagcagctctggagtcaggcaggggctggaatgcctgctgagcacttgctgtgtgagccgaggctgggcccccaccctgcttaagcgccactgtcttcctctgcaaaatcatgggtggcttcagggatgctttgagcttttg

SEQ ID NO: 37276 - DNA, 601 bp, Human
ccgggccctgttctgagcacgtacaccagttacctagtgtctccctcacaatgcacatctgaggtgagcatacaacctttcacagatgaggacgatgaggcgctgagaggttcagtgactgctggacagtgagtgagcccgggatggaactgggtctgcacagcacccagccgcgcccctacacacggagccatgtgatactccgcaaacaacaggcctttgtgctcctggtccccgactcctctggggaaaaaggtccctgacaggaggatctggtaggggctggggtagggagtgcagkggggcagctgccaaaaccctctcagccccggccagcacgggctctgcacagggtctgctctaaggacagaggggtgggccctaggcctagccgatccagctgctggtgccagggtcatggctaatccctcagcccgcagggccccaggaaggagccaccagacggctggggctgctgagcagggataatgggccccggagagctggctgcctccccagctgccaccccttgtgtcagctgtcacggagcgccggccctacgtgcctggagctcagctgggcaggacagacgtggaaatcc

SEQ ID NO: 37277 - DNA, 601 bp, Human
tgggtcaaagcctgtctgatgacaacggctgcctcttgtcaagcagttgtgacaagccgggccctgttctgagcacgtacaccagttacctagtgtctccctcacaatgcacatctgaggtgagcatacaacctttcacagatgaggacgatgaggcgctgagaggttcagtgactgctggacagtgagtgagcccgggatggaactgggtctgcacagcacccagccgcgcccctacacacggagccatgtgatactccgcaaacaacaggcctttgtgctcctggtccccgactcctcyggggaaaaaggtccctgacaggaggatctggtaggggctggggtagggagtgcaggggggcagctgccaaaaccctctcagccccggccagcacgggctctgcacagggtctgctctaaggacagaggggtgggccctaggcctagccgatccagctgctggtgccagggtcatggctaatccctcagcccgcagggccccaggaaggagccaccagacggctggggctgctgagcagggataatgggccccggagagctggctgcctccccagctgccaccccttgtgtcagctgtcac

SEQ ID NO: 37278 - DNA, 601 bp, Human
cctgtaacccggcagctgctgcttctcacagtctgatttaccctggcagctatgcaggtagcagcaggcaactctgtctcaggctccccaggggaaaatgagacccaaggtaaagatggctcagcgggagacagcaggcagcacctgccctggcttccctggaaggccaatccacgccatgctggccacacctgtcccagcgtattcctccatgaatatcattattgtgtgggtcccccagaagcatgctggggacagaacacttctggatgcatcctggagtctacggtggttcaggtgrgtggggccccctacaatgacccagggaatagggacattttactagttccccaagacctctttatccaccgtacacaactgtttccacctttagagcacctctccatcccaccaagaacacagggtggttggggcagtgccgaaggacagacagctgctgccacatcccagctgggcccctgagtcttgctcagcccaagatggtgagaagagcagttacctgatgtgcctgcggagaagttcttgagtgagggcctctggaccacggtgtaggactcgccaaccacgaacaccttgtaca

SEQ ID NO: 37279 - DNA, 601 bp, Human
gagaacgccctatgtgacacccacgggactcctagaccaccgtccactgactcaaaacacgctcactggcacggtaggagtcctgcacctaagaagacctgtaacccggcagctgctgcttctcacagtctgatttaccctggcagctatgcaggtagcagcaggcaactctgtctcaggctccccaggggaaaatgagacccaaggtaaagatggctcagcgggagacagcaggcagcacctgccctggcttccctggaaggccaatccacgccatgctggccacacctgtcccagcgtrttcctccatgaatatcattattgtgtgggtcccccagaagcatgctggggacagaacacttctggatgcatcctggagtctacggtggttcaggtgagtggggccccctacaatgacccagggaatagggacattttactagttccccaagacctctttatccaccgtacacaactgtttccacctttagagcacctctccatcccaccaagaacacagggtggttggggcagtgccgaaggacagacagctgctgccacatcccagctgggcccctgagtcttgctcagcccaagatgg

SEQ ID NO: 37280 - DNA, 601 bp, Human
ctgagctgccctttccaagtggctcccctcacccagtggtatcccaggacatattctcttcccctcagaaccccttatctcaggccacagttgacccttttcttatttctctccttgtgtgcagtttctcccaccagaatacaagctcatgagggcaggaagctgggtgcctgcctagtccctgactggatccccagcagctcacgcagggctgggcacatggtaggtttgataaatgctgtatcactgactattaagaggctctggagaggagctcagcagactataggctgtaagcccsgccacctgcacttgtaaataaagtttcatttgaacacagccgtgccactcatttacatatctacagctgcttttgcactacaacggcagcattaaataattgggatggagctggaaatgtttataatttggccttttgcaaaaaaaagtttgctgcctcccgctctacatggtgagaggtaccactcatgcatgcctaagagaaacaaggctcaagctggagagaataatggagggaacctgcataaagctgggagcctgcgctgcgtcctcagggtaaagacgagcaagaaataaaccc

SEQ ID NO: 37281 - DNA, 601 bp, Human
gagcctcaggccgagttctggaaaaggctgtctgtcaccatcccacgacttcccccaaggctggcacgggaccgtcctgggccgccagccccagcagcccctccttgagtccttgcagggtgaggcattgtggctcccacccccaggatgcaatgcacacccctggcacccaggcgcctatgtgcgaggacaggagggcactggctgagggccgctgcgtgctgggggccatgccaatggggcacctgatctggctgccaacgacccatcagctccaggacttcacagcgccgcaacaatyatgcatgagggagtgattcgggcggaagccaagcaggcaggcgctgagatgtacccggcgtccctcccgctagcggggcacagaggcccctggctgccctggtgtgcccgacagtcctcctgctgctctgaccagagccagtccagacgggggccatgaaatatggtcctggggaggagcctggggaaaataaacaccccgcaggacatgtgtcatgtggcccccaggatctctactcccaaggcaccgacagccaagaagagggagtctgtggggatggcataagccctgtgggcttgc

SEQ ID NO: 37282 - DNA, 601 bp, Human
aaatcgtcagtcctggcagattcctgactagcagccatgtgctgagggaaggaggaggtgactgcagacctcagaggtgaagggaagggccctgcagtgtctctaggctgaccccttcccgttttacagatgaggagattaaggctgaggtcaacaagtgataatccaagacagtgacttctggatgggtccttctgccatcacggctgctggccttgcccctgagaggacactcagtctgcaaatgccaaatcccctccattgcatgggctgccgaggcccccagagcaaagccatgcayggaagaagccccaggattctgaagcttagaagaaagccgtctcttgcacagaacatctcataatattctcagccaggcactgaggctctgttgaaatctgttcccaaagcctgatatgttcccaggggacatgtgtcaacatcctgagggatggcgatgttccctccaggtcctgcccacgcctgtgctctgtctaatcctcagcacactgctggctcctcagaggaccctgacacaaaagacagacagacagacaggccatctgggttctggggcagccccccgagggacacgagcact

SEQ ID NO: 37283 - DNA, 601 bp, Human
aggagccccaggtgggcaggggcaggtggatgagcagcaagcgtgtttccgcacctgggaacagagctggctctgtcaggccagcctgcgggcgtccaggaggggctgatgtcccagtggaaaaggtggtgctgaccgcatttctcttttctatttttggaaatcgtcagtcctggcagattcctgactagcagccatgtgctgagggaaggaggaggtgactgcagacctcagaggtgaagggaagggccctgcagtgtctctaggctgaccccttcccgttttacagatgaggagattraggctgaggtcaacaagtgataatccaagacagtgacttctggatgggtccttctgccatcacggctgctggccttgcccctgagaggacactcagtctgcaaatgccaaatcccctccattgcatgggctgccgaggcccccagagcaaagccatgcacggaagaagccccaggattctgaagcttagaagaaagccgtctcttgcacagaacatctcataatattctcagccaggcactgaggctctgttgaaatctgttcccaaagcctgatatgttcccaggggacatgtgtcaac

SEQ ID NO: 37284 - DNA, 601 bp, Human
tggtgccgacgacgggaggagctgctgcctcaggctgacagcacaggcccagcagcaagggagcttggctgctgcactgccacacgccccatggcacgccatttacaaaagtgctctcggcctggttgcagaatctcagaaatccttccgaagttgtctggttatccaaaaccaaatagccatcctaggacaagatgcctggggccctcaaagcaagtgatctgatgacgttctggaaagcaaggaggtgacagaggaactgggaaggcgttcatgggtccccagtgggcctcggcacccrgctgccgagaccgtgcccatactgcacacctggcaactgcggtgggtgcttctcacccaggaactccctggactccggaatccttctggggcaggaagaagaaaccaaggctcagagaggcgacgcgactcgccttagcttgggccggaccccaggcagtcccgtcagagtctgtgctcttaactaataccctagactgaatttcgaaaagcaaaaaatgtatggggccctccaagttcggtggggctaggcccatccgcaggggcatcccactgggaagggagggggtgctttaaggcc

SEQ ID NO: 37285 - DNA, 601 bp, Human
tttattttatttagagacaatgtttcactctgtcacccaggctggagtgtagtggtgcaatcacggctcactgcagccttgaactcctgggcctcagcctctggggtagctgggactacaggcgtgtgccaccatgcctggctaattttatttgttttttgtagggacagggtctcactatctttcccaggctggtctcaaactcctggcctcaagtaatcctccctccttggcctcccaaaatgctgggattacaggtgtgagccgctgtgccaggtgcacctgaattaaaaaaaaaaaagtgaaagcagatcgacagggctggggacagagccctggtcaccaagaaaaatggcccttacccaagcacaggaggctgaagtaaccactgggaacttccagggagggaagcgctgagcagggacccacgcccgggcgccgcccacgctccgagggacccatgcccgggcaccacccacgctccaagtccgggcgccgcccacgctccgagggacccacacccggatatcacccacgctctgagggacccacgcctggatatcacccacgctctgaggcctacaccagcgcatctcccacc

SEQ ID NO: 37286 - DNA, 601 bp, Human
ggcccagggttttcttctcagtgatgaaaatgttttggaaccagatagaggtggtgattggacaacactgtgaaggtactaattgccactgaattattcgctttaaaatggttaatcttatgtatgtgaatttacctcaattttattttatttagagacaatgtttcactctgtcacccaggctggagtgtagtggtgcaatcacggctcactgcagccttgaactcctgggcctcagcctctggggtagctgggactacaggcgtgtgccaccatgcctggctaattttatttgttttttgtagggacagggtctcactatctttcccaggctggtctcaaactcctggcctcaagtaatcctccctccttggcctcccaaaatgctgggattacaggtgtgagccgctgtgccaggtgcacctgaattaaaaaaaaaaaagtgaaagcagatcgacagggctggggacagagccctggtcaccaagaaaaatggcccttacccaagcacaggaggctgaagtaaccactgggaacttccagggagggaagcgctgagcagggacccacgcccgggcgccgcccacgctccgagggaccc

SEQ ID NO: 37287 - DNA, 601 bp, Human
agatggagagtgtgtcagggacccgggaagacatggtgcagagcaccgaagccggaacttggaggcaggaggatgtgggcccctgggaggggtgggagaaggagagcggccccagggaggacacaggggaggcaaaggtgctgaggccagcagctgtgggacatggctaggagcagctggggcgcagagccgggcacaagtgaggagttctgatcagacccccacttgcctgccatcacagagacccccaaggaggtgagggtgagggccctgtggcccagcaggccagtcttccttcccmaaaaatgctgtttccaaatgaactcacaccctaaacaatgcgggctccccagagaggctgctctgctgctcctgcctgcctcctggggtccaagctcagctttcctcaaggtttccatgtgctggtcaggccaccctgctctgttctccctcccagcccggcactcccctctgccactcaagtcctgtgcctgtcgcagctggcctgggacaggcacacactgtcatgggctcagcctgcccccagccaaggcctccaaggaagtggggcactgcactgggaaggattctggagtcagag

SEQ ID NO: 37288 - DNA, 601 bp, Human
cagcactgcacattacacacagggaaaccggagctcagagagggttggggctggtctaaagtcacacagctcaaaagcacagggcagaatttggacccatattttttagcctctaaaaccaaagccttttaacagggaggaaggagatggagagtgtgtcagggacccgggaagacatggtgcagagcaccgaagccggaacttggaggcaggaggatgtgggcccctgggaggggtgggagaaggagagcggccccagggaggacacaggggaggcaaaggtgctgaggccagcagctgygggacatggctaggagcagctggggcgcagagccgggcacaagtgaggagttctgatcagacccccacttgcctgccatcacagagacccccaaggaggtgagggtgagggccctgtggcccagcaggccagtcttccttccccaaaaatgctgtttccaaatgaactcacaccctaaacaatgcgggctccccagagaggctgctctgctgctcctgcctgcctcctggggtccaagctcagctttcctcaaggtttccatgtgctggtcaggccaccctgctctgttctccctcccag

SEQ ID NO: 37289 - DNA, 601 bp, Human
cccaacatgtaaactgcagggggctgtaatcccttcaaggtccttcctgctccttaaatcgaggagggcctgggggaggggctgatccaccaatgacgcaggtggagagaggaggtgagggacatgcgtgctgtggccactgtgcctggcgctccccaggtggacgtgcagctctccctccctcctcgcacaccccgtaagcccatcgcgcaggtgaggctgaggcttctcggggctgcacctccccggacctcgtggtgagggagaaagctggctttctggcctcagtcaccccgcctcrcctgcctggtcacctgaggacagtctctggaggccggtcagtggaggtggcctggccgccactcacctgggaaggcattgatgtcaatgacggcgtgctgccctgtctggttgttgatgatgatgtcgatgccgaagagtgacacgcccagtgcctgccgcagggcccgggagagctcccggatgacctcgtcgctcggccgctcgaacacgccctcgatcttgtccagctgccaacatacacaaggaagtcaggccatgggccgaggagctgcgaagccacaccacacagacagacccc

SEQ ID NO: 37290 - DNA, 601 bp, Human
tggagaaaggaacgggggacccccatctggggaatggcaggcaccaaggcatcaagcgcggctctgtctctgagctgctgcgggaggtaaacaagccactgagccttggtgtccccagggcgaggcacgcagcctggtgaccgcgagctgtgatgtcacaccatcgttcctcatgccctgtgctggggctctgctcctgcggtccccatagggcccctcactgagagctgaggggcacatggcagagcctggctcaatgccagtgggttcctagggcccagctggcagcagggaacagacyccatagcccagggctcctccccaggcctctgcccggcgctgcagttcagggtggtggaggcaacgtgagcctgggagtctctggcctgccaccaatgtgctgtggggcctgaacagcttcctcctctctagggcctcagtttcccaacatgtaaactgcagggggctgtaatcccttcaaggtccttcctgctccttaaatcgaggagggcctgggggaggggctgatccaccaatgacgcaggtggagagaggaggtgagggacatgcgtgctgtggccactgtgcctggcgctcccca

SEQ ID NO: 37291 - DNA, 601 bp, Human
tgcacctcagcagctagcaaggctggcttcacctccacagcagatgctttacaagggtcaggatggagaaaggaacgggggacccccatctggggaatggcaggcaccaaggcatcaagcgcggctctgtctctgagctgctgcgggaggtaaacaagccactgagccttggtgtccccagggcgaggcacgcagcctggtgaccgcgagctgtgatgtcacaccatcgttcctcatgccctgtgctggggctctgctcctgcggtccccatagggcccctcactgagagctgaggggcacatggcagagcctggctcaatgccagtgggttcctagggcccagctggcagcagggaacagactccatagcccagggctcctccccaggcctctgcccggcgctgcagttcagggtggtggaggcaacgtgagcctgggagtctctggcctgccaccaatgtgctgtggggcctgaacagcttcctcctctctagggcctcagtttcccaacatgtaaactgcagggggctgtaatcccttcaaggtccttcctgctccttaaatcgaggagggcctgggggaggggctgatccaccaatg

SEQ ID NO: 37292 - DNA, 601 bp, Human
acattttgtgttgggaggcactggccttgctcaggtgcaaagcttcccaccctctcctgtctcctccctccttccagaacttctcttctaacaggcctccctgtgcccccctggccctccagccactgacgttgtccccttttcattctgccactcaaaacatgctccgtggtttagatcccacacttccttatcctgaacgtcccttgcattatcctgaatgtcccttgcgccctggttccctcatacctgccagcaaaaccccatgaaatcccagctccagctaaacccatggtttccyccccactgcacccagaggcaatggagaaaaacacgatcgtcgcacgggtctgccctttcagttcacaagcacagatctcacggtggctgctccccgactcccagggagagctccaacgtcctcagttcaccacacgcagctcccctgactctgtcctccagccttcctgccccgcagctgcacctgctgtagccacagggctccacggtgcctctcctgggacctgcccctgtgctccagtgtcaccacctcacagaggagcccgctgaccgcccgctctgtcctccgcctcctccagac

SEQ ID NO: 37293 - DNA, 601 bp, Human
aggctgctgtggcactactgagagaggctgggatgtgagtggtgtctgcttcacaaagcagctgccgccccaactgagtctgcttccttctcaccacaaaatacctgcagggaggccccctgtgtcccattctctgaggatcacagccaaggaacggaaatgctgggcatcactagcaacatccaggcctgagacaagctccagggcgcagcatcacatgctccccttaacagaggggaacagaacagaaaccatggtacctgcctggggcaagtgcttcctaacacagttgcgaacatcrgcagagccctcgggagccaccaagcaggtttcggatctcaggggaggattctgctggctcccagcaaactgctccaaaagagactcacacagggcaagcgccctgcctgcctgagccaacttggaggggcgggagttttcaaaaaccctgggctgtcctctgggacaacatttacaaccatcagccccaccagggtgggaatgaaggttcagacgggggcaccctgtgccacctcttacagtgcccaggggcctggaagatgagactgctgaatctgcccatgcccttacttattcagca

SEQ ID NO: 37294 - DNA, 601 bp, Human
cactctcacatgcaccgatcagcctcccacagcccgacatgggcaggcttcccccaagggtcccggtccacagtggccatggagaccaacagacagggatgtgcacagacactggcatggcagccatacgcacacccctcacctcccatccagacctagtgttgcaaacacaagcgtgtgtaaactcagttaggaggtctgcacagtagagagcaggcggacggccccactccccaacggtggaccacctggtactctcttccatcccccactacccctcatttagatcatgacatcagaraatcaggttaaaaattaaaaaacagaagaatcagatcactggggattcttagtagtagcatcgccgttgggagctgctggcccagcgggtgtgctctgcgccctgcgctgcccctctgggtcccggctccgtggctactgggaggaggccttggtggccagggaggccacacaatgctgctggaagctgggcgacacgccggcgttgcagccgagtctctggtgcggcagcttggcggtgccgcccgcgtcggcctcagccttccagggcgcgtcctggcccatcatgctgccgcagcag

SEQ ID NO: 37295 - DNA, 601 bp, Human
gtgctggcttaggggaaggagaccgctgtgcagggctaaatgggacgtgtgttggggggcccagaggacgcccagcttcctttccttccctttagtgagggagcacagcccagacaccagcgcggaactcccctgaggggtctgtggcctcctctggctgtggggagggaggggttagctgcacaccaggcagggtgggggctaacaaagccttggtggagaccagtaggaggaaaaacaaggaaggggcaggtcagggagtggggagtcaggcagaagggaagccactctcacatgcacygatcagcctcccacagcccgacatgggcaggcttcccccaagggtcccggtccacagtggccatggagaccaacagacagggatgtgcacagacactggcatggcagccatacgcacacccctcacctcccatccagacctagtgttgcaaacacaagcgtgtgtaaactcagttaggaggtctgcacagtagagagcaggcggacggccccactccccaacggtggaccacctggtactctcttccatcccccactacccctcatttagatcatgacatcagagaatcaggttaaaaat

SEQ ID NO: 37296 - DNA, 601 bp, Human
cagcagtgctggcttaggggaaggagaccgctgtgcagggctaaatgggacgtgtgttggggggcccagaggacgcccagcttcctttccttccctttagtgagggagcacagcccagacaccagcgcggaactcccctgaggggtctgtggcctcctctggctgtggggagggaggggttagctgcacaccaggcagggtgggggctaacaaagccttggtggagaccagtaggaggaaaaacaaggaaggggcaggtcagggagtggggagtcaggcagaagggaagccactctcacaygcaccgatcagcctcccacagcccgacatgggcaggcttcccccaagggtcccggtccacagtggccatggagaccaacagacagggatgtgcacagacactggcatggcagccatacgcacacccctcacctcccatccagacctagtgttgcaaacacaagcgtgtgtaaactcagttaggaggtctgcacagtagagagcaggcggacggccccactccccaacggtggaccacctggtactctcttccatcccccactacccctcatttagatcatgacatcagagaatcaggtta

SEQ ID NO: 37297 - DNA, 601 bp, Human
gggcttgcaatgagaggtggaccaggcctgctgggtgaggagggacccagcaggtgtgaaaaggagtgaacccactgggaagagggccccgatctccatggtgtcatgccgaggctcccgcgcctatcctcacctaggtgactttatggaaaggcaggctgcatcccaggggttagggcacaaagccagccctgtggtgctctctgatctcaaatgtccactagagacaagggggtggaggcccaaagacctggaatgatttgcccaaatcacagcacaaatcctcagcacaggcgccatyggctcgggcctccagccaggcagcctccttcccgggctccagggagcagcagtgctggcttaggggaaggagaccgctgtgcagggctaaatgggacgtgtgttggggggcccagaggacgcccagcttcctttccttccctttagtgagggagcacagcccagacaccagcgcggaactcccctgaggggtctgtggcctcctctggctgtggggagggaggggttagctgcacaccaggcagggtgggggctaacaaagccttggtggagaccagtaggaggaaaaacaaggaagggg

SEQ ID NO: 37298 - DNA, 601 bp, Human
tggggtgagtctgaggtgtgcagaagcgatggggggcgggtggctccctggcacctgctggctcagtgcttggggcttgcaatgagaggtggaccaggcctgctgggtgaggagggacccagcaggtgtgaaaaggagtgaacccactgggaagagggccccgatctccatggtgtcatgccgaggctcccgcgcctatcctcacctaggtgactttatggaaaggcaggctgcatcccaggggttagggcacaaagccagccctgtggtgctctctgatctcaaatgtccactagagacragggggtggaggcccaaagacctggaatgatttgcccaaatcacagcacaaatcctcagcacaggcgccatcggctcgggcctccagccaggcagcctccttcccgggctccagggagcagcagtgctggcttaggggaaggagaccgctgtgcagggctaaatgggacgtgtgttggggggcccagaggacgcccagcttcctttccttccctttagtgagggagcacagcccagacaccagcgcggaactcccctgaggggtctgtggcctcctctggctgtggggagggaggggtta

SEQ ID NO: 37299 - DNA, 601 bp, Human
gcactggctcgggggcctctctcgggacactcagcactttctctagcgtcctccatctcactgggcagaggacagcccggaagcctttttcactttttcaaagtaaactgctatcttaagacacaaaaacatacttgtgggggctgatgcctctcacccagcaccccacatcttccaggactgcagaggcttctccccaacccttttctctgcagagggggctgcctggatcaggggtcagacggcagagccagtgctttgctgccaaggtgatggggtgagtctgaggtgtgcagaagckatggggggcgggtggctccctggcacctgctggctcagtgcttggggcttgcaatgagaggtggaccaggcctgctgggtgaggagggacccagcaggtgtgaaaaggagtgaacccactgggaagagggccccgatctccatggtgtcatgccgaggctcccgcgcctatcctcacctaggtgactttatggaaaggcaggctgcatcccaggggttagggcacaaagccagccctgtggtgctctctgatctcaaatgtccactagagacaagggggtggaggcccaaagacctggaa

SEQ ID NO: 37300 - DNA, 601 bp, Human
ggcctctgcccctcgcccaagccctgtgcctccctcctcaaagtgggcatcctgcagcccagctgagccaggccgaaggacctccatgcactggctcgggggcctctctcgggacactcagcactttctctagcgtcctccatctcactgggcagaggacagcccggaagcctttttcactttttcaaagtaaactgctatcttaagacacaaaaacatacttgtgggggctgatgcctctcacccagcaccccacatcttccaggactgcagaggcttctccccaacccttttctctgcrgagggggctgcctggatcaggggtcagacggcagagccagtgctttgctgccaaggtgatggggtgagtctgaggtgtgcagaagcgatggggggcgggtggctccctggcacctgctggctcagtgcttggggcttgcaatgagaggtggaccaggcctgctgggtgaggagggacccagcaggtgtgaaaaggagtgaacccactgggaagagggccccgatctccatggtgtcatgccgaggctcccgcgcctatcctcacctaggtgactttatggaaaggcaggctgcatcccag

SEQ ID NO: 37301 - DNA, 601 bp, Human
tattaataaccagtcagagaaagtctaggagaagtgggcatcctaatgaacatttgtaattctgaccctgcatgagggcctttggattagcaagccctctgtcacctccttactagagtagggtgtgcctcactgcgtctccgttctttctgggcagtctttgctactgtaaacatccttgactggaagctgtaaggtgttcagaggagctttcagtcggatgtttacagcggcaggctgccacggtcgtccccagctacgcaccggctttgaaacattgcaggtttgtgcccacaggctsaattcctcctcttgggggtccttccctcctctctcagaagtcacaacaagaactcaggccatttatcttccttcagaacaaagagtatcatacacctgctttccttgttgaaattgttttctccttttgtctatcagaagccccctttaaaacaagattgtgagctctgtgatgaaatcaggccttgctcactctcattgtgctaactccttgttttctgtgggctgcctgctgaatacactggctggagagaagggtcacatcctgtcagttcctccaaattcctcagtgcttctgggt

SEQ ID NO: 37302 - DNA, 601 bp, Human
atgtttacagcggcaggctgccacggtcgtccccagctacgcaccggctttgaaacattgcaggtttgtgcccacaggctcaattcctcctcttgggggtccttccctcctctctcagaagtcacaacaagaactcaggccatttatcttccttcagaacaaagagtatcatacacctgctttccttgttgaaattgttttctccttttgtctatcagaagccccctttaaaacaagattgtgagctctgtgatgaaatcaggccttgctcactctcattgtgctaactccttgttttctrtgggctgcctgctgaatacactggctggagagaagggtcacatcctgtcagttcctccaaattcctcagtgcttctgggtctctcggggtgtcatacagctccttattccatcttagccagactcaaaatgctatgatccatctgattttaaagtgtgtctagctgaaacagcttcttgttgcttggatttagttctttgtaggtgttcgaggcattgattggcatcgtattcgggacagctgctgcctggcctttgaaaggttgagattgctgaaagctggcctgaaattctaagatag

SEQ ID NO: 37303 - DNA, 601 bp, Human
tacagcggcaggctgccacggtcgtccccagctacgcaccggctttgaaacattgcaggtttgtgcccacaggctcaattcctcctcttgggggtccttccctcctctctcagaagtcacaacaagaactcaggccatttatcttccttcagaacaaagagtatcatacacctgctttccttgttgaaattgttttctccttttgtctatcagaagccccctttaaaacaagattgtgagctctgtgatgaaatcaggccttgctcactctcattgtgctaactccttgttttctgtgggytgcctgctgaatacactggctggagagaagggtcacatcctgtcagttcctccaaattcctcagtgcttctgggtctctcggggtgtcatacagctccttattccatcttagccagactcaaaatgctatgatccatctgattttaaagtgtgtctagctgaaacagcttcttgttgcttggatttagttctttgtaggtgttcgaggcattgattggcatcgtattcgggacagctgctgcctggcctttgaaaggttgagattgctgaaagctggcctgaaattctaagatagcattt

SEQ ID NO: 37304 - DNA, 601 bp, Human
ccccattctggattgatccagtcattaaagcattgttctgccacttggggcaacctcccactgctgggaaaaggaactagtcagaaatactgaattgtgagtccaaggccctgacttctcaaagatacttgagagtttcgcttgttcttcagagaagcaagtaaagattatttgaaggtaggaggtagttgaggcctgacttctgccccactaaagctattgagttgaaagttcctgcccattgaaatgtcattatcttttcacccatttctttaaaccaagcataatcatttccttgctrgcttgacctccattggcagaatgagtcttcataatgcagaagagccttagatatgccttcttccattccagtgatttgagaacagttgtgccttgtcctaacaacacaaacctaggtgcctccacttgattctcagtgtcctagatactgtctagttcataaacagtttaagaggatgtagtaagcagcataggaggagctcttgtcctgctctcacagcttttggcaagagatattttgggttctggaaggggtttttaaagggtttgctttttgtctgacaaaaagatcatattcaat

SEQ ID NO: 37305 - DNA, 601 bp, Human
tagatcagctgtagttggggataactggagactaaacaatcacaggtcacggctagaaaatgcaggtgtctccctgctgcctagcttcctacacagctggttctgaggctctcattcctgtataccctctcattacccaagagcttttccaagttaggtctggatttcagtgatttgtgctttttgtaaaataataagggagatctcagtggaacacaagtaccttgaacctacttcaatagctttgcaaagagcagttggcttctgtttcttggctgcaaaaggtatcagtattttagcyttgccacagccaatacctagtttccaggctgacatttatttataatgatgataagttggggttgaaattgttgtggaaattgagacctagatgaaaataaaagggaatctccttttccttctgccttagcataatcatattgagggttaaaactatttgtgtctgaagcacagactatatcaacctaaaaagtcagttcatatattaacttagaaacccagaatgttacaggtatctccctaagctgggtagatggctgtcaagtaaccatgtcatgcagagacccatgtttctcagggg

SEQ ID NO: 37306 - DNA, 601 bp, Human
aaggcagtaccccagcggagagctgtccatcaggccccctgggttgcgcttctgtggctaagtacaaccagaaccagatgtgacactggatagacatgccctcagtgaccacagagctttcaacaagctgtgaaaagctgggtacttgcctaccagtgctctcgatcctgaaatttcagctcaggaaaagccctgtttcccattaacctgttctgtcccccttgaagtggtggggctaaaacgagaagagtgctgcctatttgggagattgggaccaggcctgagaggcatgatgtttggrtagcatcttcccaacacttgcaattagcactgttctcagatcacaggccttgacagcatttactgacaagcactgctggtgtgtggtttttagttacggtacttatttgcccgtttgcaacttatcatgcaatgggtgattatttcgtacttcagaaattggctgtatgttttgtgaagcctataggatctgttatttttagtttgatttagcataactggtctctttgaattccactttcctttggcttcaaatgtggagagctcagcattcagcaggcaactgcacatagcctgtttg

SEQ ID NO: 37307 - DNA, 601 bp, Human
ctgtttgggggaagagtggaaattcactgtggcggctgctgagttggttcttttcctcttacctgcctctctttccacccaacaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccaggtctgtgagctgctgaggatgcccatccagcaagacagtgcyccttaggtttttggatgggcagagcttgatgagggcagagaggcagccagatcattatagagcactggatttaaagtctggaaactggaacttttccccagattcagctactggggtgagatgttaccctaatctctctggaccctgtttttctcaaaggtcaaatgaggaaagtgtactagacagtatgttctccaggatccctattagctcagaaattttagaagggaaaaaaaaatgtctgaaatgccttatgaagagtagaggtgctaaagtgaactccatgcctgctgtctgtgt

SEQ ID NO: 37308 - DNA, 601 bp, Human
ttggggatacaagcatgaataaaacagtccttattttcaaggaattcacaatttagttggggatacaaatacttaaaggttgtaccaccacgtgggaatgtgtacagggtgttaaaggaacacattaaaagaagtaccttggctcagcgcagtggctcatgcctgtaatcccaacactttgggaggccaatgtgggaggaacccaggagtttgaggttacagtgaggtaggatcatgccactgcacttcagcctgggcagcacagcaagacctcttctttaattaaaaaaaaaaaaaaaaaggcaggggcatgtggtggctcatgtctgtaattccagcactttgggaggccgaggcaggaggattgcttgagcccacgtgttcaagaccagcctgggcaacatggtgagaccctgtctccaccagaacatcagaacattagccagccatggtggcatgctcttatggccccagctacttaagaggctgagttgggaggatcgcttgagccaaggaggtcaaggctacagtgagctgtgattgtgccattgcactccagccagggtgacagagcaagatcctgtctcaaaaaaaaaacaaa

SEQ ID NO: 37309 - DNA, 601 bp, Human
ggggatacaagcatgaataaaacagtccttattttcaaggaattcacaatttagttggggatacaaatacttaaaggttgtaccaccacgtgggaatgtgtacagggtgttaaaggaacacattaaaagaagtaccttggctcagcgcagtggctcatgcctgtaatcccaacactttgggaggccaatgtgggaggaacccaggagtttgaggttacagtgaggtaggatcatgccactgcacttcagcctgggcagcacagcaagacctcttctttaattaaaaaaaaaaaaaaaaagkcaggggcatgtggtggctcatgtctgtaattccagcactttgggaggccgaggcaggaggattgcttgagcccacgtgttcaagaccagcctgggcaacatggtgagaccctgtctccaccagaacatcagaacattagccagccatggtggcatgctcttatggccccagctacttaagaggctgagttgggaggatcgcttgagccaaggaggtcaaggctacagtgagctgtgattgtgccattgcactccagccagggtgacagagcaagatcctgtctcaaaaaaaaaacaaaaa

SEQ ID NO: 37310 - DNA, 601 bp, Human
aaaggaacacattaaaagaagtaccttggctcagcgcagtggctcatgcctgtaatcccaacactttgggaggccaatgtgggaggaacccaggagtttgaggttacagtgaggtaggatcatgccactgcacttcagcctgggcagcacagcaagacctcttctttaattaaaaaaaaaaaaaaaaaggcaggggcatgtggtggctcatgtctgtaattccagcactttgggaggccgaggcaggaggattgcttgagcccacgtgttcaagaccagcctgggcaacatggtgagaccytgtctccaccagaacatcagaacattagccagccatggtggcatgctcttatggccccagctacttaagaggctgagttgggaggatcgcttgagccaaggaggtcaaggctacagtgagctgtgattgtgccattgcactccagccagggtgacagagcaagatcctgtctcaaaaaaaaaacaaaaaaaagtatatgtgtgtgtgtgtgtgtgatgtgtgtgtgtattatatatgtgtgtatatatatgtatatgtgtgtgtatgtatgtaggggaggggatgagtagctgagaaaga

SEQ ID NO: 37311 - DNA, 601 bp, Human
aactcctggctttatgccatcctcccaccttggcctcccacagtgtgggatgacaggcatgagccaccatgcccagttaggaggtagatttaagtaattatgatttggccaggtgcggtggctcacacctataatcccatcactttgggaggccaaagcaggagggtcgcatgggcccgggagttggagaccagcctgggcaatatggcaagaccttgtctcaaaaacaaacacacagagaattaaaaataagtaattatggctgggcgtagtggctcacacctgtaatcccagtactttrggaggccgaggtgggcggatcacaaagccaggagttcaagaccagcctggccaatatggtgaaaccccatctctactaaaaatacaaaaattagccgggcgtggtggcgggcgcctatagtcccagctacccggggaggctgaggcaggagaatctcttgaacctgggaggcggatgttgcagtaagctgagatcgtgccactgcactccaatctgggtgacagagcgagactgtctcaaaaaaaaaaaaaggtaattatgattttaggatttattctctgctcattttacttatccata

SEQ ID NO: 37312 - DNA, 601 bp, Human
aatcccatcactttgggaggccaaagcaggagggtcgcatgggcccgggagttggagaccagcctgggcaatatggcaagaccttgtctcaaaaacaaacacacagagaattaaaaataagtaattatggctgggcgtagtggctcacacctgtaatcccagtactttgggaggccgaggtgggcggatcacaaagccaggagttcaagaccagcctggccaatatggtgaaaccccatctctactaaaaatacaaaaattagccgggcgtggtggcgggcgcctatagtcccagctaccyggggaggctgaggcaggagaatctcttgaacctgggaggcggatgttgcagtaagctgagatcgtgccactgcactccaatctgggtgacagagcgagactgtctcaaaaaaaaaaaaaggtaattatgattttaggatttattctctgctcattttacttatccatataacaaaaatgtattgagtgcttgttctatgccagacactgtgctaggcaggagggttcaaagataatggctgctcagtcactggctcaaggcctcgactgtatcatgatgcctaagggaccttctttggct

SEQ ID NO: 37313 - DNA, 601 bp, Human
gaatctcttgaacctgggaggcggatgttgcagtaagctgagatcgtgccactgcactccaatctgggtgacagagcgagactgtctcaaaaaaaaaaaaaggtaattatgattttaggatttattctctgctcattttacttatccatataacaaaaatgtattgagtgcttgttctatgccagacactgtgctaggcaggagggttcaaagataatggctgctcagtcactggctcaaggcctcgactgtatcatgatgcctaagggaccttctttggctaatgcttgtgcctctgcartggtgaaaactttacctgccaaaggctttatccctttacagaatgaacttagagggagtctgccaagggcaggctctgattggctgatcatcctaagaagctcatggctgttgtgccctgacagcagggcacaccatacatgatttgacagctgccatgctaacacaagccctcattttcctgaaatgatttagaaataccttggaaatcctctcgggaaaattgggttgatacagtacagtgatgagttggcagcatgcatttctttttagtcagcgagaatttcatctgtgctcctct

SEQ ID NO: 37314 - DNA, 601 bp, Human
gtcacacctccctggacccgtagtgatggctatttcaagttgagtgcaaatatccttcgtaggacagaatacatatgtattaaagcagagttggaaagaatgcatattttggtaaaattaatcctgtgttttctgtcataaattgaaaacttatttctggaggttgggaataggctgagttgaaaattgtggtacaagaatggaagaaatgttttctgttagcctagcccactgcatgtacttttagaacactctgtcgtctttctttttggccctcctccagtttatagtaatttctccktagtaatcccttgaatctcatctgtcgttcccagaacacatccccttcccttgtaactttggatgcatagttgtaattttcagtaacctatgcagtcagaattaagaacatcagaatagcaacatcggttgaagtttatgattcattgagagttccatagtcttcttattgaggtgattaattcaaagtgaggagagatagtgatggaattcaagtcagggattgggtgtacaggtgtagtttaaaaggctccacccacgcccacacccccgccaccccccatcactaccaccaccagat

SEQ ID NO: 37315 - DNA, 601 bp, Human
actgaccctttccatttaatgttcccctccaaattcacctgccccagacttgactttggctatttctgaagtaaacggtcatggttgcttttgattttttctgtagtgtatgtgccttatcactaaaggggctgtgaaaagttgcagcatttggggcacagagatttatgtttgggacccatgcaaatatttgtactgtgagcctaaaaatatttttggtttttctttcgttttggagagtaacttcagcaatgctgtaaacccagaggactctgtaggttattactagtactgagatgascttaggcattcatggagagggtttgctcccagcacattgctcgttattaacctctcggtaatcctgtgggctctgagcctgaactcacgcagcattctcataactcttcctttcagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgagtcctgccctgaggtctgtct

SEQ ID NO: 37316 - DNA, 601 bp, Human
ggtgcagattgtccaggctcagccacagggtcaagcccaacaggcccagagtggcactggacagaccatgcaggtgatgcagcagatcatcactaacacaggagagatccagcagatcccggtgagtcctgccctgaggtctgtctttacaactttatagaaggaaatacttaaagatatatataccttgatatatatatgtatatctctatatataccttgatatgtatatctatagctatatatataccttgatatatatatctatagctatatatataccttgatatatatatgtatrtctctatatataccttgatatgtatatctatagctatatatataccttgatatatatatctgtagctatatatataccttgatatatatatagagatatatatcacacgcatgcataatcctttttttctttttaggagacaggtcttgctgtgtcactcagactgatgaagtgcagtggcttgatctcagctcactgcagcttccgcctcccaggttcaagcgattctcctgcctcagcctcccgagtagctgggattataggcacgtgccactatgcccggctgatttttgtattttt

SEQ ID NO: 37317 - DNA, 601 bp, Human
agaccatgcaggtgatgcagcagatcatcactaacacaggagagatccagcagatcccggtgagtcctgccctgaggtctgtctttacaactttatagaaggaaatacttaaagatatatataccttgatatatatatgtatatctctatatataccttgatatgtatatctatagctatatatataccttgatatatatatctatagctatatatataccttgatatatatatgtatatctctatatataccttgatatgtatatctatagctatatatataccttgatatatatatctrtagctatatatataccttgatatatatatagagatatatatcacacgcatgcataatcctttttttctttttaggagacaggtcttgctgtgtcactcagactgatgaagtgcagtggcttgatctcagctcactgcagcttccgcctcccaggttcaagcgattctcctgcctcagcctcccgagtagctgggattataggcacgtgccactatgcccggctgatttttgtatttttagtagagatggggtttcacagtgttggccaggctggtctctaactcctaacctcaggtgatc

SEQ ID NO: 37318 - DNA, 601 bp, Human
atgtatatctatagctatatatataccttgatatatatatctatagctatatatataccttgatatatatatgtatatctctatatataccttgatatgtatatctatagctatatatataccttgatatatatatctgtagctatatatataccttgatatatatatagagatatatatcacacgcatgcataatcctttttttctttttaggagacaggtcttgctgtgtcactcagactgatgaagtgcagtggcttgatctcagctcactgcagcttccgcctcccaggttcaagckattctcctgcctcagcctcccgagtagctgggattataggcacgtgccactatgcccggctgatttttgtatttttagtagagatggggtttcacagtgttggccaggctggtctctaactcctaacctcaggtgatccgcccgcctcggcctcccaaagtgctgggattacaggcatgagccatcacgcccagccctcagtacttatttatatatatgcgtgtgtgtgtttgttttgtttttaacctatatgcccagtgttcctgaccacaacttgcttcactgtgtttgttccctgct

SEQ ID NO: 37319 - DNA, 601 bp, Human
cttgatatatatatgtatatctctatatataccttgatatgtatatctatagctatatatataccttgatatatatatctgtagctatatatataccttgatatatatatagagatatatatcacacgcatgcataatcctttttttctttttaggagacaggtcttgctgtgtcactcagactgatgaagtgcagtggcttgatctcagctcactgcagcttccgcctcccaggttcaagcgattctcctgcctcagcctcccgagtagctgggattataggcacgtgccactatgcccrgctgatttttgtatttttagtagagatggggtttcacagtgttggccaggctggtctctaactcctaacctcaggtgatccgcccgcctcggcctcccaaagtgctgggattacaggcatgagccatcacgcccagccctcagtacttatttatatatatgcgtgtgtgtgtttgttttgtttttaacctatatgcccagtgttcctgaccacaacttgcttcactgtgtttgttccctgctttcctttaatctaggttcaggttcaccacgattgggcggcttctctcgatttcccctc

SEQ ID NO: 37320 - DNA, 601 bp, Human
gaaactcacgtagacttggttaaccacttcctctgtgaaaataactctaaaagtatcctgagatcagtttaggaattgttcttcatctgaagttaacatagtaataggccaagagaaagcttaggaaagtggagtgtgtatgtctctttctctacctctctcacgtgtgcttacgatacccaggattgcagatgactgagctctgccttgcttcattgtttcagtcctcaaccccaagatttctgttgaatggttctcatttttgcaagcgaaggcaccaccacaggttcatttaagacaragaagagttccaccttgcagatactttaactctctggggcacagagctttagcccagaagatttgttgcagaattcactacttcatcttcactggctcaggcaccttctgtaggagtcttcatttccagactctttaggcagctcattggaatgttcctaatagtgatgagcttcaggaaggaaactttatttccctttcaaaaacccagagcttattttctctgtaattaatgtaaaaaagctatgagggtccccagacctgtcctgctgtagaggaatgagggacggatcatcaccaa

SEQ ID NO: 37321 - DNA, 601 bp, Human
actcctggaactagccaccatcagtctctgtagatgaggttttccaaacttctgcccagctgccttcctccccacaagcaacttaacattgttgccaggaagctgcattataggatttaggtggggaattcaggcttggcaccacagcctcccagcagcttctcttggcatattctcaggaaagaaatgactgcaggtcctaatactcttgccctgtctcctttgaaccagatttttaatgggtttagattgggtgtccctccatcttgcctcaagtgggcaattctggaatggtctaccrtgaacttgagaggtcgttttttctcggtagttcaaattctgtgaggctggaagtctcagagaagcattttgattgaacactgcgtgcaggaatgcagcttcatcccattagcattttcctcatggaagagtcctgcagtgaagttagctcttgaaggccagagggaaatttgctccagagcagaggcaatacttgcctgttagccacaagaagcttccccttgcaacaaaggcaggctgggcagccagggcaggtggtttctggaccccgcagatagagacctagtctatccatgctccc

SEQ ID NO: 37322 - DNA, 601 bp, Human
ctctgtagatgaggttttccaaacttctgcccagctgccttcctccccacaagcaacttaacattgttgccaggaagctgcattataggatttaggtggggaattcaggcttggcaccacagcctcccagcagcttctcttggcatattctcaggaaagaaatgactgcaggtcctaatactcttgccctgtctcctttgaaccagatttttaatgggtttagattgggtgtccctccatcttgcctcaagtgggcaattctggaatggtctaccgtgaacttgagaggtcgttttttctyggtagttcaaattctgtgaggctggaagtctcagagaagcattttgattgaacactgcgtgcaggaatgcagcttcatcccattagcattttcctcatggaagagtcctgcagtgaagttagctcttgaaggccagagggaaatttgctccagagcagaggcaatacttgcctgttagccacaagaagcttccccttgcaacaaaggcaggctgggcagccagggcaggtggtttctggaccccgcagatagagacctagtctatccatgctcccagaacccctttcatttcctctaaat

SEQ ID NO: 37323 - DNA, 601 bp, Human
gtggtaaccgccttggtcctcttttcatccccagctcaaaacactaatactttcatggtacactggagcattaagagcctgagttaaggcttttagcacacaattaaatgcagcatgtggtattattgtattatctgagatttaatcgtaagcatgagagactctaagggcgctttcgtagctttggtttcccatgatggggttttctatgaaaggtttattgattctgcttccccttgggaggtgtttggccagaagctagtgctgaacaccaaagatcctaaaagccccacagacccccatccagcctggctcttggggacagagatggttaagcagtccagcttttgcctccaaaatgtgcagcatggggcagggcagtgtgagggctatgatgcggaatgatggctgtttgctttgggatcctggcagatgctggatctctttacagatgggagcgaaagaggcccacacttaatgtacaggcattctgatgatgtcagtcagataaattcctaagataagctgtgatcatgtagctaagagctggcaaataatgagcatgcagccatgctgttctcacctttgtgacaggatcttc

SEQ ID NO: 37324 - DNA, 601 bp, Human
cacacttaatgtacaggcattctgatgatgtcagtcagataaattcctaagataagctgtgatcatgtagctaagagctggcaaataatgagcatgcagccatgctgttctcacctttgtgacaggatcttctgggagttttttctgaagtccattcagggaatatattctcttctgtgctgtgtgacttgtgggatgtggatgttctgattttgcttgttttgacctctgtttaaaagggacttttttcagggcaggcttctttggagggcttgaggggtagggggcaatcaacatctcyggtcatggaaagtttgcctgtttgagattatactcaatgtcttatggtctctttgtctctgcccctgccctaggtgcagctgaatgccggccagctgcagtatatccgcttagcccagcctgtatcaggcactcaagttgtgcagggacagatccagacacttgccaccaatgctcaacaggtatgtgccccagagacacaaggcctgtgttggagaccaggagcagatggcttctgacaggaaaggagcgctcagcacacagctgtcttgccacctcatccttcaaccagaagcaccac

SEQ ID NO: 37325 - DNA, 601 bp, Human
ctcaaggggcaaagaaatgcaagtcaggggaagcctcgaaggtgcctgaaagaaaccttacaggtgtgcacacccatcagacctgggaaatgttcgacagatcgcctgatcgtcaggctgtttccatctttaaacccaagtggctgttgtgttctggcacctcctgtgctctttggaaagcttacttagattttacccctacctcctcttgcatccctaaccagaaaaattgcccttctcctctcctctcgtgccctacaatattgatggctatgagtcacagatggtgagggggctgccyccctgggcttgggggtgttgagggacatgggtattacttgcagaagatggggggtgctggtcaaggggaggcattgttaatggattcttttgcctcagacccaaaaaaagcagcgatcgtttaagagctggacccgtctggcccagttgcatttctggtgatgtatctattgacagtggtgacagagctgagtttgtagagcaggtctccaaagatctcatttgggaaaatacgaggaatgagccaaaagcaaggcttctgagttccatatagtctctgggatcattaagggctgtttct

SEQ ID NO: 37326 - DNA, 601 bp, Human
tgtgttctggcacctcctgtgctctttggaaagcttacttagattttacccctacctcctcttgcatccctaaccagaaaaattgcccttctcctctcctctcgtgccctacaatattgatggctatgagtcacagatggtgagggggctgcctccctgggcttgggggtgttgagggacatgggtattacttgcagaagatggggggtgctggtcaaggggaggcattgttaatggattcttttgcctcagacccaaaaaaagcagcgatcgtttaagagctggacccgtctggcccagytgcatttctggtgatgtatctattgacagtggtgacagagctgagtttgtagagcaggtctccaaagatctcatttgggaaaatacgaggaatgagccaaaagcaaggcttctgagttccatatagtctctgggatcattaagggctgtttctgtgcccactccccggcttacctaaggacgcggcttttccgtaactgatactgactcacacccttcccccagcccctctttttaacctcataagattcttccctgggatccaaaaaacataacggcatgggagtgggaggaaatgaga

SEQ ID NO: 37327 - DNA, 601 bp, Human
gaagatggggggtgctggtcaaggggaggcattgttaatggattcttttgcctcagacccaaaaaaagcagcgatcgtttaagagctggacccgtctggcccagttgcatttctggtgatgtatctattgacagtggtgacagagctgagtttgtagagcaggtctccaaagatctcatttgggaaaatacgaggaatgagccaaaagcaaggcttctgagttccatatagtctctgggatcattaagggctgtttctgtgcccactccccggcttacctaaggacgcggcttttccgtarctgatactgactcacacccttcccccagcccctctttttaacctcataagattcttccctgggatccaaaaaacataacggcatgggagtgggaggaaatgagaaggaagcttcttggttcctcagaagtcagtttggggctgggcacagtgggtcacgcctgtaatcccagcactttgggagggaggctgaggcaggtgatcacgtgaggtcgggagtttgagaccagcctggccaacatggcaaaaccgtttccactaaaaatacaaaattagctgggcgtggtggtgcatgcctgtc

SEQ ID NO: 37328 - DNA, 601 bp, Human
aatatgtaaataaaatgtaaaggtaaatgaaatctcagctaatatgaatggcaatcctgctggccacagagcagttaaccttcttatctatgtggaatattttccatttgtctcaggctcacttgtttattctgcaacatttctggaatactaactttgtatgggctcctgccctcaggcatcttataggctgttggaaggaaaaggaccaaaataaggaacaatagtaaaaaatagtcatgaagcctgtcatacctgttccctttcttgttcctcatagcctcatgggtaggcctgcagkggttgtttttggccatggtgaggacatttgagaggacagtccttgtcttgcaggctggctgtgatgattccaggaaatggtacacagaggacactgctggccaaatgttccataggaacacatgtgcatgcacaccgcagtcttctttctagtttaccgagctgctcccagcagttgtcattatatatgcagttctacatgtcagtacatttatctaaaatccattcacagtccacacataagattttaagtacttgtgataaatgttgtctttgttccactcccggtccctcccctttt

SEQ ID NO: 37329 - DNA, 601 bp, Human
ggggtgcttgcttgcttactacccattgagcacctgctgggcactttatatgcattgtctcatttgatctttatgaccctcttttgggtggtgggctggtggatcagaccctgcagctgacataccaactctaccatcttgattcttacagattacacagacagaggtccagcaaggacagcagcagttcagccagttcacagatggacaggtagggtacccaacctgggctgggcagagggtgaggatttgcggggcagggtagcaggtagtatctgggtttggatggttagggcaactstcctgtcctctactaacagtgagtggacagaaattgttaaaacaagtacggtatttaaatcagggcacctatcctttagttttatagacttagtgggaactaaaataatcttagacatgtagcccaaattgccattttacagatgagtaaactgaaccctggagatgggaagtgccttgtccatgctcccctagatgttcattgcagagccaggactagagagcaggtttcctgtttccctctctagaactgtatttttttcccctctaagccatgatgctgttttaatagcatggactg

SEQ ID NO: 37330 - DNA, 601 bp, Human
ggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctcccmagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatc

SEQ ID NO: 37331 - DNA, 601 bp, Human
tacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggaccc

SEQ ID NO: 37332 - DNA, 601 bp, Human
cccctcaagctcctcaagctcccccagtccctccctcccccgccactcgctctccagtccctgcccctttccccggccccactcactcttcatcttggatgcggaagccggtgacaaccccttgccgacactggacggaaaagaaagaagcaggaaggttgtccccctgctttccacttccctgaggcggggtcccgcactaggatctccgtggtggtccctcgaaggagagcgttagagatcccgccgccatgttgtgtccctgtcaccctagcaaccgtcaggccctgaacgccatgatctgtcgcctgcgcatgcgcaagatgccccgcccatgtacgcgtgcgcagtgcagcccgtcccctcagcccggttgctaagcagcctttcctccgcttccatgtaaatactgtgcaaatccccgcctttgacacaggcgaccttcgctcggctcgctctccctgctggcctgggaacttagcgatttggaacccactacgtggacgatagccttgagctttaattgggcttgggagcttctacaggaatttttttttttttttgagacagagtgtcgctctgttacccaggttggggtgca

SEQ ID NO: 37333 - DNA, 601 bp, Human
ccctgatgtaaatgatgggctctgtgtagtaatgagatatccacggttcatcgaccataataaacacaccactcgaggcaggtgctgacgacaggggaggctgtgtgcacatggggacagggctctatggaaacctaaaactgctcttaaaaaaatctatttaaaaatagtctattataaagggggggatctgttatgctaaaaatgtaagaaaactacctttcctataaaagattaatatcaccttcccacatgagaagaatgaaataaaatttaacaaaaaaagaagagtccaaaatggttgccaccttctccctccctgggatgtgggggccgctgggtgctacttgcccctcagcccacaggccctccctgggaagtcccaactcccagcctcagcttcaccagaatgaccctaagagtccgggaacacctcttccaggcgtcggtcccgccagcagggctgtggagggctgcagaaagccctcaccacctatgctctgtgcttggggaacgtttccacccaaaggcttctaagtcctgtttaaattactcagggaacacagcctgactccccagccctcagaaagcctgtgacaaa

SEQ ID NO: 37334 - DNA, 601 bp, Human
ctttttttttcttttctgtctcagcctgacagtctctgggccaggaacagagctggctccatgaatcagaagcgctgcctacccagggactcgcagtttcagatcaaactgtcacctccacagttaggcaaacaggagtgtccagaggtccggaattaggtgacctcagggcagacaggtcttagattcacattcagcaggtacttccagcgccaggtgacatccacagtgctctaccatctcagaatgcatcctgttcacaccatttacaagggccgcacaccaggctcttctagaaggmttactacctgtagccttggcatcaaccgcaaagtggacagccagcccctctttctcctgccgtggagctgctaacatcctcattttggggaggatacaccagaaggcagcacggtgtgggccccaagaggccctgaccactcttcaggatagagagcgcgattcccaagaaccagggaccctccagggggcagtaccttgccccaccatgtgcccatgggtctcatttgccaggtcctgcatctgccccaccgaacccacgagagtgcctacctctgttcttggaagtaggggtgctgca

SEQ ID NO: 37335 - DNA, 601 bp, Human
acagggtgctccggaaagccagcttttctgtggctgcccagagcccgcttctctgttttcctacggggaaggagaagagaatggagcagctccactgagagcccgcagagcacacggcctactggcttctttgtctccaatttgtctactgtgtgagttgtcactagctcttcttttctgcctgagctgtaatcaggagcctttttttttcttttctgtctcagcctgacagtctctgggccaggaacagagctggctccatgaatcagaagcgctgcctacccagggactcgcagtttcrgatcaaactgtcacctccacagttaggcaaacaggagtgtccagaggtccggaattaggtgacctcagggcagacaggtcttagattcacattcagcaggtacttccagcgccaggtgacatccacagtgctctaccatctcagaatgcatcctgttcacaccatttacaagggccgcacaccaggctcttctagaaggattactacctgtagccttggcatcaaccgcaaagtggacagccagcccctctttctcctgccgtggagctgctaacatcctcattttggggaggatacacc

SEQ ID NO: 37336 - DNA, 601 bp, Human
tggggtggtggggcagtggtcttgcctacgttgcccaggctggtctcaaactcctggcctcaagtgatcctaccctggcctccctaagcactgggtttacaggtgtgagccaccgcacccacctggtttttatttttaatgactgaaaaaaaaatgtttcatggcatgtgaaaattatgtgaaattcaaattttagtgtccccagttctactggaacgcagcccctatgtggttcatgtgttgcctccagctcctttcacactgcagcaaagcagggagtgtaacgaacaccccacggccmcggggcctaaaatatttcctatcagacccttagagaaaaatatgccgacctcggatgtgactgagggtggggacttgggtgaatgccggccaggagtgacatcaagggtttgaagcagaccctctgtccaggagggagcggaggcagagcagggacagtagtgaggaggccatctgtggtgacttaggcaaggtgaggaggatgtaggaggcaagaaggcgaagcccctgtgggatgaaggaagggtccacggggggcctgggcagttgacggagttgcctccctcggagggaaggccat

SEQ ID NO: 37337 - DNA, 601 bp, Human
tacaaaaaaatcagccgggcgtggtggtgcatgcacgtaatcccagctacttagaggctgaggcgggagaatcccttgaacccgggaggtggaggttgcagtgagccaagattgcgccattgcactccaacctgggcaatgaacgaaactccgtctcaaaaaaaaaaaaaaaaaaaaattaagccacaccaaagtcttcccaacaaaatcaattcccctcgtgtgcccacaaaagctaaaataaaggaatggctggtaaggacacatgttggactcggaaaacattaaaatgcaatactgyaacgacagcttattctttaataaaagtcaggggtgtcagcagcgtcactggtaagacatgatggcgctccacgactgaccagcagcgctgggaagggacacgcagaacccaccttccaaccacgcccaacacatcacagaaatgcctgctcgtttgttttgattcatatacaaagttacaaagtatttcctgccccaaattcttaacgaaaatgaaagaaaaccctagaatgcggtggttttacaagtatattagcccagaacatcctaggcagctgcgcgggccgcgggtgcggcaggg

SEQ ID NO: 37338 - DNA, 601 bp, Human
cagcgggggtgttgcccagtgctgtccttatccagcacaccccccacccccaccaccagcagatgagtatggtcatgaatatggtcacctcatcagtcatttgctcaattgtgaaaaagaaattgttcagagaagagcaaagtgtttttccatgagccaaaggtcagccagggtatgctaatgaggaagactggagagagcgcgtcaccgtcaccgagcctaatgaggagcactgggcaagggcacttctcccagggcagaacccacaaggagcgtcccagccccagatgcccagggaackgaaggccagtgggggtctgcccagtagtctcttgcccactgcgtgcctttaggctacagcctcccaagcccctttccccctcccctcccccatgccacactggggaggacgctgaccctgagaatggtgcaaacatctgcctgccccaggccgtctctcaccagcgagtgaatgctcttgggctcagttctgtttctgcagaaggagggtgtttagccacatatagtctcagcttttgacattttatgtctttcagtcaatctgtcaaagatctagaacctatggtgatagaatttaaaa

SEQ ID NO: 37339 - DNA, 601 bp, Human
agccaaaggtcagccagggtatgctaatgaggaagactggagagagcgcgtcaccgtcaccgagcctaatgaggagcactgggcaagggcacttctcccagggcagaacccacaaggagcgtcccagccccagatgcccagggaacggaaggccagtgggggtctgcccagtagtctcttgcccactgcgtgcctttaggctacagcctcccaagcccctttccccctcccctcccccatgccacactggggaggacgctgaccctgagaatggtgcaaacatctgcctgccccaggccgyctctcaccagcgagtgaatgctcttgggctcagttctgtttctgcagaaggagggtgtttagccacatatagtctcagcttttgacattttatgtctttcagtcaatctgtcaaagatctagaacctatggtgatagaatttaaaagtttaccttttcctatttatgtgcatacaggtatttgggtaccacatttataatttacaagttagtttgaaagatagaaattgcaacagtatggttgggagcctggtatgtaaggcatttgctggtgggcatgttttgaacatgtattgatccc

SEQ ID NO: 37340 - DNA, 601 bp, Human
gggggctgggcagaggaggtgcctagcagtgacacagaaacctctgttctgctgtgaggcctatggaatgcaaatggaacccacttttgaggatcttggagtcttggagtgctggagctagagagacctttagacattgttggctccaatgctcgttggatatgtagaaaaaggcccacagaggagcagtagatttgttcaaggttacacagcaagatggtgtgaagacagggcaggactgtgatccctgggtcccttgtctggtgtcgttgctgtctctgctttagtactccgtaatgcrtctgcagcacactggaggggagggttagtttggagcctttgggccctgcctttctggatgtggaacttgctgggctttgggaattttctgccagccattgataggagcagaggacctgttgtgttttgtggcagaggtcacccacggaagcgatccatctgtaagcacagagccagctgcagcccgaggtgatgtggatggagcttaaatgtggtgttgtgtgtgtctcttcttttcctttaaacaacgttttccccaccacacaggtttttagccagcttatctactctaaagtgctgg

SEQ ID NO: 37341 - DNA, 601 bp, Human
agaaacctctgttctgctgtgaggcctatggaatgcaaatggaacccacttttgaggatcttggagtcttggagtgctggagctagagagacctttagacattgttggctccaatgctcgttggatatgtagaaaaaggcccacagaggagcagtagatttgttcaaggttacacagcaagatggtgtgaagacagggcaggactgtgatccctgggtcccttgtctggtgtcgttgctgtctctgctttagtactccgtaatgcatctgcagcacactggaggggagggttagtttggarcctttgggccctgcctttctggatgtggaacttgctgggctttgggaattttctgccagccattgataggagcagaggacctgttgtgttttgtggcagaggtcacccacggaagcgatccatctgtaagcacagagccagctgcagcccgaggtgatgtggatggagcttaaatgtggtgttgtgtgtgtctcttcttttcctttaaacaacgttttccccaccacacaggtttttagccagcttatctactctaaagtgctgggaagttcccatttccctatctgcaatggctgtaag

SEQ ID NO: 37342 - DNA, 601 bp, Human
atcttctcaaatgccaaaattaaaaacaaccccaaaccttttttgattggagtttcttgaaaatgatattcttccctgccctgttaaacctttacgatggcctccagaggggtttgagggtctcacctctgcttggtgggcctggtcctgtggtgtgagtctgcttctctctcctcacctctctgccttcttcagagctgtcccttccctgagacactgtccctgccctgatagatttcctctgtatctcgtgatttactgactctatgtcaaggactgaaaatccaaaccaccacccttrgtaaagtgttaggtatgacataatctgagtgcctttcctgcggaataagatgcttggctggccaccatatcgccgaaagaatgttgttatttgtcttttaaggagaataagatcagaagtctgatttctaggcaagtggagaaatataatatttattcatggctttatggacttgatcgatctttgagaacctactaggtgtcagtctctgtggttggtactggtgttcagaacagtcttctctcacttgagggcacagtgagcgccgtgaccatatcatttgtggtaaattacacggga

SEQ ID NO: 37343 - DNA, 601 bp, Human
attcagcttatctgcatctaggctctctgaattacgcacccacttaaaacattctgtcaccttttctcttggaataattaaattattttaatgtaattcagatttctttttatcctagcccagcattacctgggagagaatgactcaggattaatcataataaaatcatattaaattatattccactaattcagaattggggataatttggcaattaaaggcggaagtgtgtcattcctctcctgtaagaaatgaacagtaatgatgggctcacagagatcatattgcttgttgcttaaaraagagatcaagcagttttcagactctggaattgttggcttatttgccaataaataattgagaattattcttaatgtcccttcccccaactccactttccagagtttagatggaataactgtgtataacatcaaattcaggaagttgcatttcttaaatattttctgtaagccttcttttgcattttgatgaagctttaagagctcctctcaggtccagaaggagacggtaaacactaaccactggcagttcccacgacgccaaccctactacagggtgtggggatgttgtagggtggtta

SEQ ID NO: 37344 - DNA, 601 bp, Human
cagttttcagactctggaattgttggcttatttgccaataaataattgagaattattcttaatgtcccttcccccaactccactttccagagtttagatggaataactgtgtataacatcaaattcaggaagttgcatttcttaaatattttctgtaagccttcttttgcattttgatgaagctttaagagctcctctcaggtccagaaggagacggtaaacactaaccactggcagttcccacgacgccaaccctactacagggtgtggggatgttgtagggtggttacagttcattctyctcttctgtttagaatttttactaaaatgatttcacgtggctgggcatggtggcttatgcctcccagcattttgggaggccaaggcaggaggatcatttgaggccaggagttagagaccaccctggccaacatggtgaaaccccatctctatgaaaagtacaaaaattagccaggcgtggtggtgggtgcctgtaatcccagctacttgggaagctgaggcacaggaattccttgaacctgggaggtggagtttgcagtgagctgagattgcaccactgcactccagcctgggtgacaga

SEQ ID NO: 37345 - DNA, 601 bp, Human
tttcacgtggctgggcatggtggcttatgcctcccagcattttgggaggccaaggcaggaggatcatttgaggccaggagttagagaccaccctggccaacatggtgaaaccccatctctatgaaaagtacaaaaattagccaggcgtggtggtgggtgcctgtaatcccagctacttgggaagctgaggcacaggaattccttgaacctgggaggtggagtttgcagtgagctgagattgcaccactgcactccagcctgggtgacagagcaagacaccatctcaaaaaaaaaaaaaaaattattttgtgcaatgtagactctgctgtatttaatcttatagaagtatataaataaaggatttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgt

SEQ ID NO: 37346 - DNA, 601 bp, Human
ttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccrtttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgtcgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaacc

SEQ ID NO: 37347 - DNA, 601 bp, Human
gtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccatttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgycgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaaccgaagcaggggtaagttctggggtaggctgcctgtgccttccttccatggataatggaactgtagcctcgtactagagcagtcatctgtcctgattgcaggaggtacagcatgtgtactgaccgggcagccctttgacacaatgaaagtgaa

SEQ ID NO: 37348 - DNA, 601 bp, Human
gcagggcacaaaccaggagagtatggcatgccatgatggagactgaacagaagcaaaaactacaggcaactgtagttttgttccctgttgaaggagagacactctattagagaagacctggaattcagttcagtttccttagcaaaggacaaaatggggagagaagacagggaaacagtaagcagccacgtgagattctggggaagacctgtgtcttctgagcaaagtagcccctccagccacaggatagacagtgacttctgtcttgcatgagtgaaaccactggatctggctctgcccrcccctccactttcttgcttccttagcctgtgaacaaagtgaaggacaggtaagagcatattgcttttctgctgagaacaatctaataccttacagctgcattttcccacactgctttcagaacattgaattgctgggtgtccttaagaaagggttgggaaattacgtcacagtgtctctctcgtgaagaatcactctgggtacatttatttcatatagtgtatgtgttatttagttcattaaagatgcgtaaggctgggcacagtggctcacgcctgtagtcccagcactttgagaggct

SEQ ID NO: 37349 - DNA, 601 bp, Human
gaattgctgggtgtccttaagaaagggttgggaaattacgtcacagtgtctctctcgtgaagaatcactctgggtacatttatttcatatagtgtatgtgttatttagttcattaaagatgcgtaaggctgggcacagtggctcacgcctgtagtcccagcactttgagaggctgaggtgggcagattacttgagcccaggagtttgagaccaacctgagcaacatggcaaaaccccgtcactacaaaaaatacaaaacttagctgagtgtggtagcacatgtctgtggtcccagctaccrgggaggctgaggtgggaggattgcttgagctcaggaggcagaggttgcagtgagatgatgccactgcactccagcctgggcaacagagcgagactgtgtctctcaaaaaaaaaaaaaaaagaaaagaaaagaaaccatcctgattaaccttgtctaatccagcactcatcttttttgagcttgggcccgttttttttttccatcctgaggaacagtgtttgcctcttacctgttggggaaatgctctcttagagtctacaaagctctgacatgtatatcatgtctctatagccctcaccg

SEQ ID NO: 37350 - DNA, 601 bp, Human
aaaaaaaagaaaagaaaagaaaccatcctgattaaccttgtctaatccagcactcatcttttttgagcttgggcccgttttttttttccatcctgaggaacagtgtttgcctcttacctgttggggaaatgctctcttagagtctacaaagctctgacatgtatatcatgtctctatagccctcaccgtgatcctgtgagaagagcaaggcagatgttacctctcttagggatggaaaactgaggtgccgatgttgacctgctcaaggtcaccccgctaaggacttgaaattgtgtcctcygagctcctgcccagtctcctttccatcagaccacagttgggggtctggaatattttataagggtcagttctagagagaagattaatcaggagcagtgaaaggaaagaactgcttgtgagagcctgtggtgaatttctgcaatcacattgtaaatatttgtctgttcccggtttcaacatgacccagaatgttctagtttgacgtttggctggacagggtcttacatagcaggagtgctcaggtacatgtttgttgaacatatgacaaatggatgattcttacaaaatcccatcctatacc

SEQ ID NO: 37351 - DNA, 601 bp, Human
cggtttcaacatgacccagaatgttctagtttgacgtttggctggacagggtcttacatagcaggagtgctcaggtacatgtttgttgaacatatgacaaatggatgattcttacaaaatcccatcctatacctattactgtttcaattccagttctacacattcatactacatgcagaaccaggggcccatgcacctccttctgtgcactggtcaatgaaagtatttattggaaagccaaagtccactgcatatctgatttgactgtgtccttgcactataataatgtgcttggtgttcrttcagatgtctgagccattattatatcttaaactcaatagacttctacatttattgactgccacctttgtcctggcaaacttggcagatcctggttaatgctcctaattgactattgcctgtcaacaggttaacagagagtccctgagggaggccaactgtggatctgcaggctggctgcaagacaacagaaaccattttaagcttcagttctaacaagctgctaaggagtgaagtgggggaaaggagtggactgaacagcattggatggtttccacaccccataaaagcgtgtgcaagt

SEQ ID NO: 37352 - DNA, 601 bp, Human
tgtgcaagtacatttgtgtacctggttctcctttgctaatggttttaggcttaattctctaacatcaaaaggaagtccttactgcaaacagtgtcttcctactgaaagaaagctccactctaagccaagtcttctgaaagagttgcctctggccatggtacagaagctagaccaccagggactagcaaaccagggccaagactggtgccaccttgattttatactaatctttaacactggaaaaacttgagtacccctgaatatggtaagtccatctgtgctttttttttttttttgagayggagtctcactctgtcgcccaggctggagtgcagtggcgcaatcttaactcattgcaacctcgcctccccagttcaagcaattctcctgcctcagcctcccgagtagctgggactacaggcgcccaccaccatgcccagctaatttttgtattttagtagagatggggtttcaccatgttggccaggatggtcttgatctcttgacctcgtgatctgcccacctcggcctcccaaagtgctgggattacaggtgtgagccaccgtgccctgccccatctgtgcttttgctcacagtttgg

SEQ ID NO: 37353 - DNA, 601 bp, Human
tgtacctggttctcctttgctaatggttttaggcttaattctctaacatcaaaaggaagtccttactgcaaacagtgtcttcctactgaaagaaagctccactctaagccaagtcttctgaaagagttgcctctggccatggtacagaagctagaccaccagggactagcaaaccagggccaagactggtgccaccttgattttatactaatctttaacactggaaaaacttgagtacccctgaatatggtaagtccatctgtgctttttttttttttttgagacggagtctcactctgtygcccaggctggagtgcagtggcgcaatcttaactcattgcaacctcgcctccccagttcaagcaattctcctgcctcagcctcccgagtagctgggactacaggcgcccaccaccatgcccagctaatttttgtattttagtagagatggggtttcaccatgttggccaggatggtcttgatctcttgacctcgtgatctgcccacctcggcctcccaaagtgctgggattacaggtgtgagccaccgtgccctgccccatctgtgcttttgctcacagtttggagaaaaattgttaggg

SEQ ID NO: 37354 - DNA, 601 bp, Human
agttagctgaggagattcccacccacccttaggggtttttggaaatctctgagggtgatcttggctgtccagtgagagcatgatgctggcattgaatgggtgtcagggaaccagttcagtccttcctgcccaatgaaggattgtcctacccccaaatgccagtcatgatcccatgacacaacactcttctagggctggaagggatcttctatcccaactcccatgaaccaggaactcgcagagaagcctttcttctgaaacacttctcagacttttccccgtattcgttttttttttttttgaaagagtctcactgtgtcacccaggctggagtgcagtggcatgatcttggctcactgcaacctctgcctccctggttcaagcgcttcttgtgcctcagccaccagagtagctgggattacaggcgtgcaccaccaggcatggctaatttttagtagagacggggttttgccatgttggccaggcctcaactgatctgcctgccttggcctcccaaagtgctggaattacaggtatgagccaccacgcctggcctccccatattcttgaactcttactggattccagtttcacaaccctg

SEQ ID NO: 37355 - DNA, 601 bp, Human
cttggcctcccaaagtgctggaattacaggtatgagccaccacgcctggcctccccatattcttgaactcttactggattccagtttcacaaccctgctggtgacatttggctgctggtactaaatccatacatgaggtgaatgcttctgttttgtatttgtgcattcatccctctgcctagtttagatttccagtttagcaatttcacctaataccattgagcttgcagacttgtactggcttcacccactcctgtggcaccattttaccctcgtctgtgttgctgaggtggtaggtcaycagttgaactggaaaatctttttgtgatgcagcaacttttggttaaacgttttttctgggttttcatctgtggcagttacattgcacatctggttgctccaggttggattgtgggcatgtggggataggcttagaacctagatttatttaaaacttagggcagacacactgaagtattaatagtgcatgtttttcagtgggggactatgggcaatattttcctcctttcctttaggtttttttgtggcgttttattttgtcatgtcacgatgtatcttggctttggctgttgtaacagaa

SEQ ID NO: 37356 - DNA, 601 bp, Human
ttcatagggttgtgggatccttagatgaaacagcacatgcaagtttccttcctttcatcatttttttttttttttgagacggagtctcactctgttgcccaggctagagtacagtggcacaatctcaggtcactgcaagctctgcctcctgggttcacgccattctcctgcctcagcctcctgagtagctgggactacaggcacccaccactacgcccggctaatttttttttttttttgtatttttagtagagacagggtttcaccatgttagccaggatggtctcgatctcctgacttygtgatccgcccgcctcggcctcccagagtgctgggattacagttgtgagccacggcgcccggccctttcatcatttttttagacatggaggtctctctttgtttcccaagctggaatgcagtggctgttcacagatgcagtcatagcactgtagcctagaacacatgggctcaagtgatcctcccacctcagtctcctaagtagctgtaatcacaggttcatgccctcacgcccggctccttaccctgctttatcaccaaagtgctgtctgtgtggtgagtgccaaaggaatgaagaaac

SEQ ID NO: 37357 - DNA, 601 bp, Human
ttgcttacttatcttgacatctggctgagttctgaccaaggatattgctgtggttaactcaaagcctataaatctgctgggaaaaagcagtagataaattgaccattttcaaggatcagtccccactcagtgagaatggggtttggaaaagtgccctattttctgcacccttgagattcattacagccaacttgaatctaatattcattgcctagaagtccaagagtgtaagtctttaaaactttttattgaaataatacacatagtatcatgaatgcacattgaagtcacagtatgcagytctataaatagtgacacaatttatgtgcctttgtaacctgtgtccagattaacaaatagaacattaacaacacccagaaagctgccctcatgttccttggaagtaattcaaggtaattaaaagatagtaatagttatatccaaaggacttaggcagatcaacaccttgaattatcagttgactttgtatttgaggtctagcagtgttcacacaaggcatggtatggtagcttggggctaagactcggattggaagggaggttaattgtgttgagctggattactttgttacattccatgt

SEQ ID NO: 37358 - DNA, 601 bp, Human
tagataaattgaccattttcaaggatcagtccccactcagtgagaatggggtttggaaaagtgccctattttctgcacccttgagattcattacagccaacttgaatctaatattcattgcctagaagtccaagagtgtaagtctttaaaactttttattgaaataatacacatagtatcatgaatgcacattgaagtcacagtatgcagctctataaatagtgacacaatttatgtgcctttgtaacctgtgtccagattaacaaatagaacattaacaacacccagaaagctgccctcrtgttccttggaagtaattcaaggtaattaaaagatagtaatagttatatccaaaggacttaggcagatcaacaccttgaattatcagttgactttgtatttgaggtctagcagtgttcacacaaggcatggtatggtagcttggggctaagactcggattggaagggaggttaattgtgttgagctggattactttgttacattccatgtagcagtgctgcaggaagggctggctgatggggaatacctgacagtgtcttctgaagctctcagaaggaaaatagtttttaaatgtctgtg

SEQ ID NO: 37359 - DNA, 601 bp, Human
gatccttcatctgtccaagccaagtctccttcttgctgagaacaaagtgaggagagagggattcactaagttgcactgagtatgtgatttcttggcctgttcttagcagggataaacctgccctggttgccctcaatcatgaaggggagtcagacaaagagtgtcctgtgttctggctgctacaggagcagggctgcttagaagaaattctcccgcatccctggtgctctgagaaataaattcttggtgcttctgcataacaggagctatataacttgttctcagaatttgtcttgtcttmagacaacatttactccttcactcatttctctgcactaaaaacagatcctgtaaacacctgaacaaatttcccaaaaacacaccagaaagattgaggaaataggaatcacagcgataagggactgggcaatacaatgccattttatgtttgctgagtttagataattccttactgtaaataaatttccttcccacagaaggatgccgttgagtcttaattcctggctcttcatttacaaaatcagcttcttccttactagtgcttgatcagatctgttaattggttgcaaatgcccttgtc

SEQ ID NO: 37360 - DNA, 601 bp, Human
tccttcatctgtccaagccaagtctccttcttgctgagaacaaagtgaggagagagggattcactaagttgcactgagtatgtgatttcttggcctgttcttagcagggataaacctgccctggttgccctcaatcatgaaggggagtcagacaaagagtgtcctgtgttctggctgctacaggagcagggctgcttagaagaaattctcccgcatccctggtgctctgagaaataaattcttggtgcttctgcataacaggagctatataacttgttctcagaatttgtcttgtcttcaracaacatttactccttcactcatttctctgcactaaaaacagatcctgtaaacacctgaacaaatttcccaaaaacacaccagaaagattgaggaaataggaatcacagcgataagggactgggcaatacaatgccattttatgtttgctgagtttagataattccttactgtaaataaatttccttcccacagaaggatgccgttgagtcttaattcctggctcttcatttacaaaatcagcttcttccttactagtgcttgatcagatctgttaattggttgcaaatgcccttgtctt

SEQ ID NO: 37361 - DNA, 601 bp, Human
ctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaartacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacggagtctcactctgtcacccagactggagtgcagtggcacgatctcggctcactgcaacctccgtctcctgggttcaagcgattctctcacctcagcctcctgagtagctgggattacaggtacgcgccaccatgtcca

SEQ ID NO: 37362 - DNA, 601 bp, Human
ccgctcttgctcttggtaaaatatagagtggtcagtagccttatgcacctaattcaaaaggtggaatatagttctgtcagggcttttacgtaaacctccacttgtacatgcaatttggacagttatgtgttgagggaagtacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacrgagtctcactctgtcacccagactggagtgcagtggcacgatctcggctcactgcaacctccgtctcctgggttcaagcgattctctcacctcagcctcctgagtagctgggattacaggtacgcgccaccatgtccagctaattttttttggtattttttgtagagacgaggtttcaccatgttgtccaggttggtctcgaactcctgacctcaagtgatccgcccacctcggcctcccaaagtgctgggattactggtgtgagccaccatgcccagccagtggttgaattttttaaaa

SEQ ID NO: 37363 - DNA, 601 bp, Human
tataatcaccctgttgtgctatcaaatagtaggttttattcattctttctaacttttttgtacccaatcaccatccccaactccccctttccagccactagtaactgtccttctactctccatgcctatgaattcgcttgttttgatttttagatcccacaaataagtgaaaatgtgtgatgtttgtatttccatgcctggcttatttcacttagcataatgatctccagtttcatccatgttgttgcaaatgactgcgactcattctttttatgactgaatagtactccattgtgtataagtaccacattttctttatccattcatctgttgatggacacttaggttgcttccaaatcttagctattataaacagtgctgccacaaacttacaagtgcagatatctttttgagatactgatttcctttcttttgggtatatacccaaacgtgaggtttgtaactcacatagtgattttttattgcaggtaattccagtggagaagctagtgaaaggacgtttccaggacaacctggattttattcaatggtttaagaaattctatgatgctaactacgatgggaaggagtatgatcctgt

SEQ ID NO: 37364 - DNA, 601 bp, Human
aggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcwgtagcccatgatgaataaaaagtgttagtcacaaatctcaaagctgtacattaagatggggcagatggctcagccttgctgcagacttcaggctaccttcccctcccctgctcctcagggccgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagt

SEQ ID NO: 37365 - DNA, 601 bp, Human
tcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggcygtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagatacctttccttccttcatagaacttggagatagcagttgcacacagtaagttattacac

SEQ ID NO: 37366 - DNA, 601 bp, Human
tcagtttctccctggagagcgtttgtctaatgtggctcagtatcatttgtgaaagggtctagctaagcgtggcttccatgtaagtgatctaagggacggagagtcctcaacataaaactaaatagccatgcttacagcctctctgttctgcttctctttcctcctcccattctccatttcctgcagaagatgaacaagtatttcagtctgttcaggctgctagagcagagtactgtagacagggtgacttataaacaacagaaatttacttctcacagttctggagactgggatgtccaasatcaaggcgccagtagattcagcgtctgcttgaggccccattcttcatagatggcaccttctcactgtcttcacatgctgaaaggatgaataagctcgattgggcctcttatcagggcactcatcctattcataagggctctaaccccatgacagccacctcccaaaggccccacctcctaacaccatcaccttgggtgttaggatttcaacatacacattttgaggagatacaaactttcagaccatagtaagaagttagaggaaagatgtgttccagcctatgttagcaggagacgaa

SEQ ID NO: 37367 - DNA, 601 bp, Human
cttcacatgctgaaaggatgaataagctcgattgggcctcttatcagggcactcatcctattcataagggctctaaccccatgacagccacctcccaaaggccccacctcctaacaccatcaccttgggtgttaggatttcaacatacacattttgaggagatacaaactttcagaccatagtaagaagttagaggaaagatgtgttccagcctatgttagcaggagacgaaagctcacttccagcctgcggggaaccgcacaagcagaaagaccactctgtccctggttaataaacgctyagttgcctgaagggaatgaccagagtgctgtggagaattggacgttttggcccagggtcaagctccagacaacagccctgttgtttctccctcagacttacacattggttatttctgcttctctctctctctctcttttgggttttattcacaggaattgctggtcatgtcttatactatattttgggtggttttttttcttcactctcactcccttgcaggtacattcattaaaacttgcccttgaaggcgtggaaaaggaaagggatttctactttgggaagttgagagagatcgagc

SEQ ID NO: 37368 - DNA, 601 bp, Human
tgctattcacaagtgctgctattcacaagtgctgatggagacccaggatgtggctgtgtcagggtgatgaaaagcagatgtgagaaatggaggaggaataagaatctaggaagcaaggagagaaagcggggcaggatgcatggcagagactgaggcaaggcaccccgggtctgccagtgccaggagagagaggcccagcagccagaggtggaggtgggagcctgatgtggcttcaccttccacagagccaagttgaggggttggggtgtccagcttctcttatgccaggctgatgctagtrgaagtgtcccggtctctgggtgttctgagcctgtgatgttctgagggcctccagtggagttgtatgtgttgatatttctataggacatagcaagccatcagcaagtttactctcttattccagctgaatcccaggcaaatgtttactccatttatgcctcaaaatactagcagtgaaattctcctaaactgtaaggcactgtatctgtggtttggaagctctttatcacttttttttttcacttcttccaaatattttgatttaaattatttattggttatcaatagctcagaatttgaa

SEQ ID NO: 37369 - DNA, 601 bp, Human
gtgtgtacagagtgcttgccctctgtaagcactagatggactatggttattctcttcacaagcttatttgaggctaaatcagctgagatctccacagcgccatgagactgagtgaatggcgctgctgtctgcgataacgcctgctagtgggaataaggccggcgtgcaggatcaaatcttcttcccagccctgcacttcaaacggggaaaccctgagtctaacctcatgccagattttgtcccaagagggagtccatgtgcaggagcactgtctgacagtgaactccaaatgaagtgttggagaggtccactgaattcccggctaagataggtggacagcctcaggcaagagcccttgcctcctgggtgtgatttccagggggtctacctagatgaccgcactcagtttctgttctgccatacccatcaccacccgaccccacacacacatacatcccagcaccaccttgccaccatctggattcagagagccattcctgcaatgtacatgcaactaaaatgcaagcaccccaagaagaaataacactttaaggcctcatcattcattaagactaaataataagtttagcagacacctctt

SEQ ID NO: 37370 - DNA, 601 bp, Human
agatgagggaaactaaggcagcagagaggttgaataactttcccaagtctaggagcagaataatttccatttgaaccctgaaatctgaatcctgagtttatgttctcccttctccaagtctgaggcaccttttaagtgctattatgacagtagtaatggctaatactgattgagcatttagcatgtgctagggattgtattcatttactacgtagattactgaccttaaccacatccctgtgaggtgagtaattacttatctacattttacagatgaaattactaacccaatggctcatarttaataagctccagcactaggatttgaacccaggtttatctaactcagaggctaaaatcataaggactgagttacctccctcgccgagtggtgggtaccatggagcagggaggaaacgaacatagtactagttggggaaagcctcaagattaactgtctacttgacagtcttcagttgaacacgccctgtgtgtgaagaagaaagtttccaaatttttacgtgggttttctctaaataactccccttacctcgttttgttgattttcaccttcgaaagcctagttgtggcctctttttcg

SEQ ID NO: 37371 - DNA, 601 bp, Human
gtactagttggggaaagcctcaagattaactgtctacttgacagtcttcagttgaacacgccctgtgtgtgaagaagaaagtttccaaatttttacgtgggttttctctaaataactccccttacctcgttttgttgattttcaccttcgaaagcctagttgtggcctctttttcggggcattcatctgattttaaatgagcatccacaaagaacttcagttttcttctagccagtttgtaacttttttaaacccactttgttgttgtatctctggcactgcgctgacatcatcaaatagmtttaagggaaggaagagagagggaaagagacagaggcattgccctgtaagtatatgctggggagtacccaaaattcaagaagagaattactcagagtaaccaggcagttgaatctggcagagaaaacagccttaacataaattgcatgtgtgggttaccagagcaagatgttcaaatgcagttactggcttaatttttctagttccaggatatttttattgcaactttgtgtctgcaaaactccaaaagagacacatcaggctatactgagttttctacagagagtaagccgtttgatct

SEQ ID NO: 37372 - DNA, 601 bp, Human
caagaaatcatcctagatatcttaaagcctccaagcattttcatttcttcctgagaatatggaatctggtttctctggaaccacccagaagcacatagccagtcctacactgggggagtgagccttcctaaagctgtacccttgcctgccttcccctatgtctatggtctggaaaagcaacggttttgaaaaacaatgtgcttagtggttacgatgccatcatacaccactgcccccatctctgggaatcctgcctttgccccactgtgctttcccctgacattgtgtcctgttttctggycagccccacacttgtgtgatgggtagatttgcacccatgtgcagggatgatgtacatggcgtctgggaggaagtgccagcactttgttcatgatgctgttggtacagctgtgtgtacagagctgagatggcacagatgcctggtggtctgcctttcccagagccctcctggagctagaaggccaggttgcagcacatgctgttcagctaaacatagatggacatgctttgctttgacatttgaggtaggagtatttgctggggagatctcttcccctgagtgattacttaacactcttat

SEQ ID NO: 37373 - DNA, 601 bp, Human
gagagcactggcttaggaaggccagtaactgtttcttgtcctgcgctggcccaagaagaagttctctcctgctcccctgagcatgtatggccacactgttggtgaggcactgactctgagctgagaggaccagcctcacatgtgccagacagaaggcaaagcagtgtgcagaggaagtgccaagagcacagctgctgtgatgcccaggggtctggggtcgatccggcagaaggggagtaaagaggggatcagggctctgagatctccctgaggtcaaagagcacctgcaattaaggaattygggagtgcaagggtcaggaagacacatgatgtgatcagagagagcaagagattgggcctaacgttccagaagtggagctagttctaggtggtgaacacagggtggtcatggggtagggagagctcacatttgctgaataaggggcctgtcggcacggtaagagacaatgccagatttttccccaagttttcaacacaatgtcactgtctactgttggttgacacagaaagggttacttttttaaaaaaattacttgcacttctagaatatattccagagttctcccactaagaaataata

SEQ ID NO: 37374 - DNA, 601 bp, Human
gtgcccttactgagggaacagggaactcctttgattagccatgctccctcagcttgggtaaaaaacagcaaatattttgtgtgagttcagaaaatgaatgaatgtacagatacggctgactgaggctagtgctccctggagttggtgttcatgccatgcttcactgggttagataaaggaataaatagggctgtttatttctaaatagtgggaagaacaattcacctatctgattctcagttgataaacataacgtaagccaaaagggccccaagcagtctaagtagatgtcccaaagtcyttgagctaaagctcctgagctccctcattgggaggggcctctttgcctgggacaacccatgaaatgtggctgctgtcctttccttagcctgggaacctctaacactgctgctctggtatctaagcctacatcaggttagtaacataacaaagggtctccttcagggcgacactgccgagcaagaagaatgacagcaagggagggactaggaaatggagcaaaagcccacatccctatccattagtgaggagtgacaccccgcaccaaaataccatggaggccaggggtgctgcttttata

SEQ ID NO: 37375 - DNA, 601 bp, Human
cagctttactcatggttgtcatgatgctcttggatcactgtgtttggtttactcttttacaaaggttaggaaagtatgccatgtattctaagaagatttccttccaaaacaaaatagttgggtgcctaaagcctgacgactgtgctttctagaatgatctgttctttgatcacatggggaagctaaggcgcccctgcatatgtatcagacaccggaagctgggagacgtttgcatggcgagttgtgcctaactaagcctggtgccctccacagccttgagacgccatgctggcagtggcartgggctgggatgctgcagggccccattcccagtcaattatctcagctgaaacttctcccctgcccacaggagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggtt

SEQ ID NO: 37376 - DNA, 601 bp, Human
cacatggggaagctaaggcgcccctgcatatgtatcagacaccggaagctgggagacgtttgcatggcgagttgtgcctaactaagcctggtgccctccacagccttgagacgccatgctggcagtggcaatgggctgggatgctgcagggccccattcccagtcaattatctcagctgaaacttctcccctgcccacaggagggccacacagaagagccggaagcagaggagcaagcccacgaacagcagcccccgcagcaggaagagtactgacccaccccggctgctcttgacacttycattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccacca

SEQ ID NO: 37377 - DNA, 601 bp, Human
ttctcccctgcccacaggagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccragagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatga

SEQ ID NO: 37378 - DNA, 601 bp, Human
gtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagyccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgag

SEQ ID NO: 37379 - DNA, 601 bp, Human
tctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctrgtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaacttt

SEQ ID NO: 37380 - DNA, 601 bp, Human
tgaacccagcgcccgggcatgcgcagacgcgttgttgtggtgggcgtggctccctccggacccggcgccccgccctccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggacgtaagtgtcgggcggggagtgggggtaagagagtagcggccgcaggctggagaggcctcggagccggggccgtctgacgggctggtgcccacagcacaggctcgttgccgccaccctcccggaagccgcagacccgggctgagccgccgcggacctctcctctcctgggtccggcggcgccaggagaaggcgacggcgtccagaccccgccaagacggagaggggaccgcgccctcccccgggacaccccaggatccctggaaaatcccccgatcccccacttcacagctggacaagccgaagccccgagaaaggagcgtgacccggccagctccctcagcgaggggtgccccggctaaag

SEQ ID NO: 37381 - DNA, 601 bp, Human
tttacacttcagatccctcaagggatctgctattagttttttatgatcatatggtgtcgtaggctctaaagagtaattttttatttttattttttgagatagagttttgctcttgtttttttgttgttgttgtttttgttttttttggttttttttgagacggagtctcagtctgtcgcccaggctggcgtgcagtggcgcaatctcagctcactgcaagctccgcttcccggggttcacgccattctcctgcttcagcctcccgagtagctgggactacaggcgcccgccactgcgcccrgctaatttttttgtattttagtagagacggggtttcgccgtggtctcgatctcctgacctcgtgatccgcccgcctcggccttgcaaagtgctggaattacaggtgtgagccaccgcgcctggccttgctcttgttttagtagagacggggtttctccatgttggtcaagctggtcttgaactcccgacctcagatgatctgtctgcctcggcctcccaaagtgttgggattacaggcatgagccaccgcaccaagccattttttcttaagctttaagatttatttattttcgagacagg

SEQ ID NO: 37382 - DNA, 601 bp, Human
ttctaggctacttgtcagaatttggttaatataattttattgtaaatatctgctcagatgataaaaactgtttttgaagttttggcgttattttgttatacctttgcccttgataatatctagagccaaattcaattagataaattgtaatctggtgtttaaattaaatttaaaatcacacctgaaaccatatttagactgcactggaattcatcaaaagcagaacctcagagctgttatttcacaccaagaagatagctaaaattctgtgaacaatagttgttctccatattaatttgamtgcttttttcttgattttggggaatatttctctggaagtttatcatatatcaacaggacacttctgtcagttggaattggagtcacttttttcctttccccctccatgagataactggtttctagttcaccaaattagattacaaggctttattatgataaaaattaaataatgattgaagtaggcttagagaaaagttatgttaataaatataaattgctctcagatttaagggtacctaatcagttattaggccatgtgcaaattacatgtgggaaaaagctagaacatttttgaaat

SEQ ID NO: 37383 - DNA, 601 bp, Human
tgacagtgtaggagggactggtccctggctcttgcccaggaaactcttccgattagagttcatatcttgtgacgagtattctgaagttacagcatctcttttaagctatttggacagtagaggcctctaataaccaacttcagtttttctttgttacagcagtagatcctatattaactagaagagcagagatctgggattacaggcgcatgccaccatgcctgactaatttttgtattttttgtagagacggggttttgccatgttgcccaggctggtctcaaactcctgggctcaagcratctgcccgccttggcctcccaaagtgctgggattacaggcatgagccactgtgtctggctcatagcccccatttcatttggtgcctgggactgcgcaccagctgccccatagagcatgcaggcaggcatccccatagagcatgcaggcaggcagccccatagagcatgcaggcaggcgtctgcactctggctcatctaaggcacctgtgggtaatttgccacccttggcaattggctttccaaagcctggctgtgtccattccctgcctcctcatggccaaccataatctggccatggt

SEQ ID NO: 37384 - DNA, 601 bp, Human
gataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacrctgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccag

SEQ ID NO: 37385 - DNA, 601 bp, Human
tgtgttcatttattatagcaggaagttaaaacgctgattcagtcagtgacaggcatctgttctgttttgttctgtatcttatagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgyttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaatggtttgtcttgatttaccgtaggagtaaaggtcagaaaaatgtgaagtct

SEQ ID NO: 37386 - DNA, 601 bp, Human
gaggcagaggttgcagtgagccaagatcacgccactgcattccagcctgggcgacagagcaagattccatctcaaaaaaaatttaaaaaaaataaataaatgtcagagggatcatgagccatggagaaggaaatagaattatagtatatgacttgattctgcaataaatatttttacatcatagaaatgatactttattagtatttggcttttagaaagaaccaatattttaaaacatggttatagaataggatgtaaatatctatagtctaacaaacagtatagttaaaggaaaggacargagctcatagaagataaaatctgaagttgatgctacctaacagaagtaatcaacaaaacaactaaagacagcagtgtgatgatgaggcggcacattgtgggtgggctaaaccctcatcttaacaaaaaggtaacaggtaataactaaaattggtaatcaagaaataaaaactaggctgggcacggtggctcacacctgtaatcccagcactttgggaggccaaggcaggcagatcacttgaggccaggagttcgagaccagcctggccaacatgacaaaaccccatctctactaaaaata

SEQ ID NO: 37387 - DNA, 601 bp, Human
gccgggcgtggtagtgcacgcctataatcctagctacttaggaggctgaggcacgagaatcccttgagcctgggaggcagaggttgcagtgagccaagatcacgccactgcattccagcctgggcgacagagcaagattccatctcaaaaaaaatttaaaaaaaataaataaatgtcagagggatcatgagccatggagaaggaaatagaattatagtatatgacttgattctgcaataaatatttttacatcatagaaatgatactttattagtatttggcttttagaaagaaccaataytttaaaacatggttatagaataggatgtaaatatctatagtctaacaaacagtatagttaaaggaaaggacaagagctcatagaagataaaatctgaagttgatgctacctaacagaagtaatcaacaaaacaactaaagacagcagtgtgatgatgaggcggcacattgtgggtgggctaaaccctcatcttaacaaaaaggtaacaggtaataactaaaattggtaatcaagaaataaaaactaggctgggcacggtggctcacacctgtaatcccagcactttgggaggccaaggca

SEQ ID NO: 37388 - DNA, 601 bp, Human
acaggatcatactttttaaatgagtaagagcaagttctaagaaactgaaaatgactgaagaacaaactccaaagaagggctgcaatgtgaaattgtggaaatcctcccaagtgtaaaacagaaagggggaaatagtgaaaaataacaagagctacaaggaccagtaccatcatgtaacaagtatttcaggaagaaaataaacaaaaaagtggtcacttatgctagaaaatggtgtcaaaactggctcaatgaatagcaaagatactggatactagaaggcagtggaggaaggtcttccaartgaggatgaaacattttaaacctaggatccattaaatccgaaggcaaaagaaagtcaccacacatcaggactaaaatgttgacttcccataaacactattttattttatttttattttattattttattttattgtatttttcttagactgagtcttgctctgttgccaggctcaagttgcagtggcacaatcttggctcactgcaacctccgcctcccgggttcaagtgattctcctgcctcagcctcccgagtagctgggactacaggcacccgccaccacgcccggctgatttttgt

SEQ ID NO: 37389 - DNA, 601 bp, Human
cttgcctcagcctcccgagtagctgggattacaggcgtgcaccatcatgcccggctaattttttgtatttttagtagaaacggagtttcaccatgttggccaggctagtctcaaactcctgacctcaggtgatccgcccacctcggcctcccagagtgctgggattacaggcgtgtgccaccacgcctggccagaaccatgttgttttaaagatgtactttattcctcctgcctctcttaactcagtgttggactaggataaaacatcagaataaacaaggactaatgtcttctcctcccrtacaccaccacagtgcctaggcatagacggtggatgtctcttagctcagcttttgttgccacagtttactgctcccccacatcatctagacacttagtttcatttttgttgtttcttgttatttcctattgttacaaactagtgttagaacacttgtttctcccaagagaaataaatagattttctcagattttctctctttttttgttagttcccagaaatgaatgctatgatcatgcgacggttcagtttgcctggagatgtagacagagctcgacagtatgtactacaggtaagact

SEQ ID NO: 37390 - DNA, 601 bp, Human
agtgcaatggcgcaatctcggctcactgcaacctccacctccccaggttcaagcaattctcttgcctcagcctcccgagtagctgggattacaggcgtgcaccatcatgcccggctaattttttgtatttttagtagaaacggagtttcaccatgttggccaggctagtctcaaactcctgacctcaggtgatccgcccacctcggcctcccagagtgctgggattacaggcgtgtgccaccacgcctggccagaaccatgttgttttaaagatgtactttattcctcctgcctctcttaactcagtgttggactaggataaaacatcagaataaacaaggactaatgtcttctcctcccatacaccaccacagtgcctaggcatagacggtggatgtctcttagctcagcttttgttgccacagtttactgctcccccacatcatctagacacttagtttcatttttgttgtttcttgttatttcctattgttacaaactagtgttagaacacttgtttctcccaagagaaataaatagattttctcagattttctctctttttttgttagttcccagaaatgaatgctatgatcatgcg

SEQ ID NO: 37391 - DNA, 601 bp, Human
ttatagtaacttttggtctttcagagattttgcctctattctgtcttcacgtttacaaaggtcagtcatgtcctccataaaattcagtgattccactgtgatacagaaaccacggcccttgcttttggtgggtttctgattggagagaggaaaggtcatctttcacccactatctagcatagccattggcagcatgattcttcccaggggaggctgacgttctgggtggctggaccaggctactttggcagcttgctaaggctatgaatggagatgttggggtactcggtaggaacacccrccctcattattacaaggcttccatcctctcaaactttggaggctgaggtaagaagtgaaaggtatgctgtaaataggtcctctctcccaatgaggcttacttgccagcccaaaatcaaagagtataatacatgtgcccagttttgacaaaaatttataaaacctccttttgtacattaaggcaagagtgaggaacatttgagccatgtaggtgttatgctggggattagaaaaatgaggcactggctaccagtaacctatataactgcgaacattacttctcagatacttgttagtaaac

SEQ ID NO: 37392 - DNA, 601 bp, Human
ttggacttcacctcgtgttctgaccagatgggcaaaccaacatcagctgatctgaagctcgggttagccactggtcctgtcctgtttgcctgtcagcaggtaggttttacaaactccctttgacacatcactgcatagccccacagaactgatgtcccgcggcacagctgatgggaagattgcataaaggaatagatgggaaggcattcagataagagatcacaggtctgcatttgatcctggctgagtgagatgttggggctggtcatttcaccttgctaagactgtttccttatctgtraaattgagaagatcacctttctcccagggtggttgtgaggattagctaagatcctatttgagatctttgtgtcttgtggtgtgccataggcatttgaggtagcatcgtgattatttccatatattttggccactggcaaagtgaacggtttctaagtcttgattataggactggactttggtggtcctcagagccccttaaaaggcataggaagcatcaagggcctccaagcataagaaattctccggttctagaagtttaatgagactctgctgctctgagagaggctttagaacctcg

SEQ ID NO: 37393 - DNA, 601 bp, Human
gaagagtctgcagtgagccgaggtcatgccactgtactcaagcctgggcaacagagcaagactctttctcaaaaaaaaaaaaaagaatgtaatatatatctttaaatatgcaaattaatgtgatatatagggtgtatttggttatagcatataattcaactatttatgcagtagtttataactagttgctaatacagtgtagacatccatcacagtctaaagaagactggaaatatgttgattgcttagtgttcaatggaaaaacttttttttttttttgtctaggaatgaggggcagtgycacatagtacaaaaagcatttcacttggagccaaaattctttggtttaatttttattgaaaataacatgtatcgtgccatgctctggggtgtgctcagtactagctgagatgattcctagtctgagctcccactccactccaccctccccactgccctgggagcatagagactagagcatcactgactggtacgcaaggtgtgatggtcgcagcatgcatgggtgttgtacacgcacaaaagggaggcatctgaccagactgagggatcggggggaacttcttagaggtggcatctgaac

SEQ ID NO: 37394 - DNA, 601 bp, Human
ttggtaaacacaatgaacatcactgtttagatactgaagaacctaagacaataagtacctaaatagttatgttgaaaattctgtgaactctagcctttataactaattactacagaatgtaacacttacggccgggtgtggtggctcacgcctgtaatcctagcactttgggaggccgaggcagttggatcacttggggccaggagttcgagaccagcctggccaacatggtgaaaccccatctctagtaaaaatacaaaaatacctgggcgtggtggtgtacgcttgtagtcccagctaytcatgaggctgaggtggggggattgcttgaacccaggaggaagagtctgcagtgagccgaggtcatgccactgtactcaagcctgggcaacagagcaagactctttctcaaaaaaaaaaaaaagaatgtaatatatatctttaaatatgcaaattaatgtgatatatagggtgtatttggttatagcatataattcaactatttatgcagtagtttataactagttgctaatacagtgtagacatccatcacagtctaaagaagactggaaatatgttgattgcttagtgttcaatggaa

SEQ ID NO: 37395 - DNA, 601 bp, Human
gtctctaggatctccccggccaggtgaagaaggaactaaaggccaaaggatcccgagccttgagctgctaatgatgtaggggctgggtcagggaatgtaagtgggtacctatatatcataatttgtaaaatgactttataggcatatacttacatcaggatgtcttacataatatgtatattatataaagtggtgattaattggtaaacacaatgaacatcactgtttagatactgaagaacctaagacaataagtacctaaatagttatgttgaaaattctgtgaactctagcctttatractaattactacagaatgtaacacttacggccgggtgtggtggctcacgcctgtaatcctagcactttgggaggccgaggcagttggatcacttggggccaggagttcgagaccagcctggccaacatggtgaaaccccatctctagtaaaaatacaaaaatacctgggcgtggtggtgtacgcttgtagtcccagctactcatgaggctgaggtggggggattgcttgaacccaggaggaagagtctgcagtgagccgaggtcatgccactgtactcaagcctgggcaacagagcaaga

SEQ ID NO: 37396 - DNA, 601 bp, Human
atctgcttagcacagggctacttgccagttcctacctgtttctgcctctgacccacaactgctatgttaccggtacaaaaccccccacacacagtgccccctcggtgagcccttgttaggcctggcctgggcttcctagcacttctttcctttaactcccacccctggccgtcacagtcctgtggcttccatgtcatatgctggacctttggtctctaggatctccccggccaggtgaagaaggaactaaaggccaaaggatcccgagccttgagctgctaatgatgtaggggctgggtcrgggaatgtaagtgggtacctatatatcataatttgtaaaatgactttataggcatatacttacatcaggatgtcttacataatatgtatattatataaagtggtgattaattggtaaacacaatgaacatcactgtttagatactgaagaacctaagacaataagtacctaaatagttatgttgaaaattctgtgaactctagcctttataactaattactacagaatgtaacacttacggccgggtgtggtggctcacgcctgtaatcctagcactttgggaggccgaggcagttggat

SEQ ID NO: 37397 - DNA, 601 bp, Human
ttattagcattgggaatatgggaaacagggacttggtttgaggatgcatagatcctgggttgaaggatgagaataaagttgaacagatgagaatgaaaatgcacaggcatccatcgccatcaccacacacgtgctctacaaacaaaaagtttgtgcaggccaggcgcagtggctcatgcctgtaatcccagcactttgggaggctgaggtgggtggatcacctgaggtcaggagttcgagaccagcctggccaacaaggcaaaaccctgtcactactaaaaaaacacaaaaattagccagygtacacctgtaatctcagctactcaggaggcttaggcaggagaatcgcttgaacctgggagagggaggttgcagtgagccaatatcacactactgcactccagcctgggcaacagagtgagactccatttcaaaaaaaaaaaaaaagtttgtgcaaacaactaccccaccctcacctccttttctctcatagatttatagtattcctggttcattcctatttaattctccttattaaaagaagagatatatgtatatacacacacacacacacacacacacacacacacacatacatata

SEQ ID NO: 37398 - DNA, 601 bp, Human
atgtatatattaaagcatatttctatattattagcattgggaatatgggaaacagggacttggtttgaggatgcatagatcctgggttgaaggatgagaataaagttgaacagatgagaatgaaaatgcacaggcatccatcgccatcaccacacacgtgctctacaaacaaaaagtttgtgcaggccaggcgcagtggctcatgcctgtaatcccagcactttgggaggctgaggtgggtggatcacctgaggtcaggagttcgagaccagcctggccaacaaggcaaaaccctgtcacyactaaaaaaacacaaaaattagccagtgtacacctgtaatctcagctactcaggaggcttaggcaggagaatcgcttgaacctgggagagggaggttgcagtgagccaatatcacactactgcactccagcctgggcaacagagtgagactccatttcaaaaaaaaaaaaaaagtttgtgcaaacaactaccccaccctcacctccttttctctcatagatttatagtattcctggttcattcctatttaattctccttattaaaagaagagatatatgtatatacacacacacacacac

SEQ ID NO: 37399 - DNA, 601 bp, Human
acagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacaygattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggtttt

SEQ ID NO: 37400 - DNA, 601 bp, Human
attacatttaaaaacagaatgtaaacacaaagacattatcagggcagttttacatgttaacaggataaccctatacagtgactctgaaaatccaaaagttcacaattaaccagtatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaagrcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaat

SEQ ID NO: 37401 - DNA, 601 bp, Human
tatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggartctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagt

SEQ ID NO: 37402 - DNA, 601 bp, Human
aaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaayagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggctttt

SEQ ID NO: 37403 - DNA, 601 bp, Human
tcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagkgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaa

SEQ ID NO: 37404 - DNA, 601 bp, Human
agctgcacacatacacaaacaacaaattattttttcgaatggaaaatccatgccatattgagagaccgaaaatctcaggtgtacttataccatcagttagctttaggatgcttctataaaagttaatatataatgttgagtgttaatgtttatattatcatgcaaaataaaaacccttttgtgttataaaataactgtcaaaaaatactcattttatgtcgtaagtcctactgtttctttaattctctgaactaaccttaagtaaaccagaagaaactttaggactacctgaaatatgacrtgagagttttcttcctttttatttatttcagcattactcaaatagtccaaaattctctgtatttcattgcatgtgagcatgcttcattgcaacccataatgaaacgctcaaatttacaggcactactaagtgtttcagtcaagcagcacaatctttaaaaaataaccttacagaaagtcaagatttaaaaggatttatcaaaatggaattgcttaaaatgaaatttcagttcaggcacttaaaatatgaagctacattaaagaggagtcacaaaaagggaaagaaggagttcattagaaa

SEQ ID NO: 37405 - DNA, 601 bp, Human
aaagaaggagttcattagaaattcatcccctgcaatgcctttcactcctgcaaggttgccttttttcaggaagaaaaaagtccccagggtaaaaaaaatcaatactggttaataaaacatcaggtgtgcagacataactaggtatgacgattccgctgcacaggcctgcctgaatgcaccaggtgccatgacgattagtcatccagggcagacagcaagcctggtgaaaacacaatgcttgggcgctggaagggaaaggggaaacaggtaattctggggggaaattagtctgaatagttamaccaaacaggaatgtttcctccaaagcaaaagaatgttctaatcagaaacagagaactcaaatgattgtaattttacctctacagtgacactgacaatatttaaatagaaaaacaccacatacgataagaattgaaaacaatactccattctgaggctatctgtggtaaaagaatgggtcttaaaagctcactgctccccaagtatttcacaatattgattctcctcataaataccgtatttagtttgttaggaaactaagggagaagggagcttggatctttaaaacgctttaatgctg

SEQ ID NO: 37406 - DNA, 601 bp, Human
caggtgataaggttggaaaggtcagctaataagaggcattcaaatatttatggagagatgaaaggcaggaaagtagaggaaatcagggtgggaaggcccaaatcattaagtcatcaagaagccaataaagaattctaagaaggaggattacatgatcaggttgaggtttctggaagattactttagtagaatgttatgaacagactagagtgaaagcaaatctgaaggaaaatagacaagttcacagtatgtgcattagttcccaggaaaaataaagaatacctgaacaaagaaaagagcyccagatgtgtgtggatcaagcagaatgtggtgttgtgaatagaaacagccaagtgttgtggccagagcaccacacttatggcagaaagtggttaagacagaagccaataatagacagggagcaagatcttagagagccttagatacaacattaacgagctcaggtcttatttcgtagttgatgaaaaatcatacaagagttttaatatctgtattttcagcagattattctggcaaccaggtggcagatgggtttaaagtagaaaaattagaggcacaagagattcttttatttactctg

SEQ ID NO: 37407 - DNA, 601 bp, Human
caagggaggaaatgtgatgaagtgaagaacaaaagattcatgaataggagaaagaaaatctgtgggtggccaggtgtggtggctcacgcctgtaatctcagcactttgggaggctgaggcgggtggatcacctgaggtcagaagttagagaccagcctggccaataggtgaaaccctgtctctactaaaaatataaaaatttgccaggtgtggtggcaggtgcctgtaatcccagctacttaggaggttgaggcaggagaattgcttgaacctgggaggcggaggttgcagtgagcccagrttgcgccattgcactccagcctgggcaacaagagtgagactccatctcaaaaaaaaaaaataaataaataaaagaaagaaagaaaatctcctgtgggtaagaatgggtgtgaaaaagaggtcaggaattgaggctgttcatacctgacattttcaatcttcttacatagaaatgacatcatcctctaagaaagaagggacaatggttcagaagagggcctgaggactaaagaaactgacaaaggacaaataattcagagcaatttttagtgacaactttacctaggtgtgtgagtctata

SEQ ID NO: 37408 - DNA, 601 bp, Human
aaatgagcacaaaagcttgaagtataacaagggtcaacagagagtgtcacagaggctaagatcctcaagttccagtgctgacaccatccaaagtgtggccttatcaatggggagatgaaacagagaagaggtaagggtcactggaatgaaatttggttgaagaactacaaggccaatattcaatgagtgaagaaaagggaccagaagttggagaatggcagcaatgaaaaggggtcgatggcattgcagccaaatggctggcatctcaaaggagaaggttgctggtaaaacatgagaaagmaggcatacattctaataaagtgttgggggtacaggactctatttacaatgaaacaaaatttgaagtaaaaaggaactgggtgggaagcaagcgggaggatgaggccaactgctagtaacataggataaagccaggagatggatcagacaagagcagtttgctttttgtggaaggagtaaaacttacaaggtcacagggaagaagagagcaatgggtgaagctccctgccccccaatattctgactatgacacaaactgttttggtccaagaataggctaacggtgctatctagtacttac

SEQ ID NO: 37409 - DNA, 601 bp, Human
cctcaacaacatctctacattttgctttctttatctgtaaacctaggtttatcagatcttcttcctggcgacgctgtgacaattaaatgaactgctgctcatgggaatggctgggtgacttcggtagctggcatgctgtcagtactcactagcaccctgtcctttccccaaaaagaaagaagcagaaagctgtatttgttcccatttatgggactaagagatcaggaacaataaggatgtgttttgcgcacttttacactcattagaggatgaccatatatcccaaggaagatgaagccartaactgtaagacacaattacaagtttgacttttctccctctatgatatgctctgttccatgagggcaatggaggcaccagagaaggcaagaggaaacatcattagtccgtccttcagcatcaggtggtcccactgctcctgaggcaccctcagttttcagggtcactggtttcctccctcctggcaaactctagccacaagcgctcagactcgaaggtgttgaactctcttttcttccttacaagggtgccagaattcttaactgcatttgtttatcccagtaaaagtgagtccttcaca

SEQ ID NO: 37410 - DNA, 601 bp, Human
ttcaatcaacaaatgctgagtgtccgccatggccagatactctttgacagtcgtcacagcacacagaacatgtgattagtaaacataatggtgcaggacatcagcctgctaatgttattcccaggtgtcatcaaatgagtgacaatttgtacaatgtttcattaaatgcctatttagaggataaccatagttgatgacacagaaaaaagccaaacccagaatgcaagaatcgtagccagcagagcacgtggaaacaacgtccaagttgcaggtagcagcttgcaggataaccacagttggygacgctttcaggcagctgggagaattctcagttgtccattttatggttaaatggttttactaaggtctaaaaaattcatttctaactcctagacttatgtttccattactatataaagaatgagccaaacaaataaataacaaaatattcactatggaccccaaaatttcaaggcatgaagagagccccaaattctctgtgaactgcaaagagaaaccattagtacaggaatagatgaagaaattgtttttgagtataatataaacataaacaaatctcttaacagcacgagtgtcaaca

SEQ ID NO: 37411 - DNA, 601 bp, Human
cgtcacagcacacagaacatgtgattagtaaacataatggtgcaggacatcagcctgctaatgttattcccaggtgtcatcaaatgagtgacaatttgtacaatgtttcattaaatgcctatttagaggataaccatagttgatgacacagaaaaaagccaaacccagaatgcaagaatcgtagccagcagagcacgtggaaacaacgtccaagttgcaggtagcagcttgcaggataaccacagttggtgacgctttcaggcagctgggagaattctcagttgtccattttatggttaamtggttttactaaggtctaaaaaattcatttctaactcctagacttatgtttccattactatataaagaatgagccaaacaaataaataacaaaatattcactatggaccccaaaatttcaaggcatgaagagagccccaaattctctgtgaactgcaaagagaaaccattagtacaggaatagatgaagaaattgtttttgagtataatataaacataaacaaatctcttaacagcacgagtgtcaacaaatgcttttgttgttgcaaaaacagtctcaaaaagagtggtgacaaggaga

SEQ ID NO: 37412 - DNA, 601 bp, Human
caggcagctgggagaattctcagttgtccattttatggttaaatggttttactaaggtctaaaaaattcatttctaactcctagacttatgtttccattactatataaagaatgagccaaacaaataaataacaaaatattcactatggaccccaaaatttcaaggcatgaagagagccccaaattctctgtgaactgcaaagagaaaccattagtacaggaatagatgaagaaattgtttttgagtataatataaacataaacaaatctcttaacagcacgagtgtcaacaaatgctttygttgttgcaaaaacagtctcaaaaagagtggtgacaaggagactgacaaggagaaatgagctattttttcatctccaaaattgcacttcctggtccacggttcttagcactgcagatgttgcagaactgtgcagcagagttctaaaaatgcaatttaaaaacacatatttaaaaaatgatcttctttttctactctcatattcagaaacactaaggtagcgttagtcagggggtggagaggaagtaataggatggcactcctttctctggagtttatttctggttaacataggatttagt

SEQ ID NO: 37413 - DNA, 601 bp, Human
ctcatattcagaaacactaaggtagcgttagtcagggggtggagaggaagtaataggatggcactcctttctctggagtttatttctggttaacataggatttagtctagatcagctgttactctgtgactccaaggacacccaacagcagaatacgtctaatgtgacctggaggaatatgacactaaaaaaatgatagcatcatggaacacaaatcaggctgagaaacacataagatacacaatggctctctactgttgttgctcatctctacagcatgacagctgtcaactgggcctgratgaattccttcaaatgggtatgcttttatgtttactatagtacatagaacatttctaaatatttttacatttgaaaactagattaatttttgttatgtgatataaatccacattgtaatttttttttaacccatacagccataaggatgaagggttacagtttaaagcacattcctctaagtgtgttaatttccctctagttgataggtgccaagctgccaactcaccatgctgggcatgggcaggcactccttgtggaacatgtgccggcaatggaagaccaccacgctgaagggctt

SEQ ID NO: 37414 - DNA, 601 bp, Human
tctctggagtttatttctggttaacataggatttagtctagatcagctgttactctgtgactccaaggacacccaacagcagaatacgtctaatgtgacctggaggaatatgacactaaaaaaatgatagcatcatggaacacaaatcaggctgagaaacacataagatacacaatggctctctactgttgttgctcatctctacagcatgacagctgtcaactgggcctgaatgaattccttcaaatgggtatgcttttatgtttactatagtacatagaacatttctaaatatttttayatttgaaaactagattaatttttgttatgtgatataaatccacattgtaatttttttttaacccatacagccataaggatgaagggttacagtttaaagcacattcctctaagtgtgttaatttccctctagttgataggtgccaagctgccaactcaccatgctgggcatgggcaggcactccttgtggaacatgtgccggcaatggaagaccaccacgctgaagggcttagctgcatctggcgaggagggcagagaaaggaggagaacttaatgcaacaagcaagatcattttaaacc

SEQ ID NO: 37415 - DNA, 601 bp, Human
acttgtgcttgggcagatcccctcatctgttcctgctctgtgtggccagcttatttttggtaagatttagtgtcatcagcagagtaaatttggagttaaatctaactgtagagtgggaatgtatgtggttcctttttgctgcaacactgtctgaaatgctatggaagctcacttcttcacctgagcccatgcagttttcaacagaagcacttaaacatccaaatctaattcctctagaaaagaacctaagtagaacaacttctcatggactgccccatgaaataatcctttaatcctaagyaaacatgaggtcaactaggtcttttagtactttgttatgctgaacttatatttgaaaagcatttgttagcatcctaacaatgctttgttagtttccgcttttgaattatgcaaatttcttctgtcataataaaccttaagaaggtgcttttcattacagatgaagacatatatctatctgccaagaactagaaataaacaaatgcttatgtcttttaaagactcacagttccaattagatggcagggattatgtatgtttccactgaaatgtgagatgacttgggcatgtagaaccatat

SEQ ID NO: 37416 - DNA, 601 bp, Human
ctttttgctgcaacactgtctgaaatgctatggaagctcacttcttcacctgagcccatgcagttttcaacagaagcacttaaacatccaaatctaattcctctagaaaagaacctaagtagaacaacttctcatggactgccccatgaaataatcctttaatcctaagtaaacatgaggtcaactaggtcttttagtactttgttatgctgaacttatatttgaaaagcatttgttagcatcctaacaatgctttgttagtttccgcttttgaattatgcaaatttcttctgtcataatraaccttaagaaggtgcttttcattacagatgaagacatatatctatctgccaagaactagaaataaacaaatgcttatgtcttttaaagactcacagttccaattagatggcagggattatgtatgtttccactgaaatgtgagatgacttgggcatgtagaaccatatatcagagaaaaacactaaagaaaagggaatgctacctataaattttttttcccagacatgtatatggttcttctaccttgaaatttaaatgctgatggttagttttcattttgtttttaccctagactagc

SEQ ID NO: 37417 - DNA, 601 bp, Human
agatgacttgggcatgtagaaccatatatcagagaaaaacactaaagaaaagggaatgctacctataaattttttttcccagacatgtatatggttcttctaccttgaaatttaaatgctgatggttagttttcattttgtttttaccctagactagcagttctaaaagaagggcccctgaaccagtggcatcaacattacctgggaacttgttagaaatatacattctcagttcctgccctggaagtttggaaccagagactctagggagtctgactgggtcagcgatctgggttccaayaagcctgccaggtgacgatgactcaccctagagcttgagaacctcagctctaagcaatggcagcaccagcattccactgagcaggatggaagccacaacacttctctccactgggttattctgaaagttatatagttttataaacggtagttggctaattccaaaattttgattccactcatcattaaaatacatgtttgggatttttttggggaaaaccttcttacctgatggaagaataggggaaaggcacgactcacagatgttctcctctgtaagaaaacacacatactttggatt

SEQ ID NO: 37418 - DNA, 601 bp, Human
ttcagatgctcatttgtccaagaaaggatacttacttgcaaattgtagtcttgcagaattttaaccaaggaatctctcaaattggggatctccattccttccttaatacggtgaatcagtagaattgggtcaacatgtgtgccaatgttgtttaacaagccagtaataaatgctacaaaataccacataaaacaatgaacatataagcaacattataatgcaattttatttgcacataatttgcatataatgcaattttagatcaaaagtaactcaaagaaaaaattatttccttcaaagyaagtgttaaaaccatttgaatttctaaactcttaagaattaatcttctaaacttccaagaactaacgctccttaagacatgaaggagaaagtaaataagaactgttttaaaacagttgaacaaatgattacttgccttcaaaatacagtttttagcatcaaatgggtgtaaataatatttattgacaactgactatggctcaggtatcatatacactttcctcaaatactgtgcaaggtaggaatgctgtgtccccattttacagacaagggaaatggggtgtttaatttttccagggtc

SEQ ID NO: 37419 - DNA, 601 bp, Human
gatgctcatttgtccaagaaaggatacttacttgcaaattgtagtcttgcagaattttaaccaaggaatctctcaaattggggatctccattccttccttaatacggtgaatcagtagaattgggtcaacatgtgtgccaatgttgtttaacaagccagtaataaatgctacaaaataccacataaaacaatgaacatataagcaacattataatgcaattttatttgcacataatttgcatataatgcaattttagatcaaaagtaactcaaagaaaaaattatttccttcaaagtaagygttaaaaccatttgaatttctaaactcttaagaattaatcttctaaacttccaagaactaacgctccttaagacatgaaggagaaagtaaataagaactgttttaaaacagttgaacaaatgattacttgccttcaaaatacagtttttagcatcaaatgggtgtaaataatatttattgacaactgactatggctcaggtatcatatacactttcctcaaatactgtgcaaggtaggaatgctgtgtccccattttacagacaagggaaatggggtgtttaatttttccagggtcacac

SEQ ID NO: 37420 - DNA, 601 bp, Human
acactttcctcaaatactgtgcaaggtaggaatgctgtgtccccattttacagacaagggaaatggggtgtttaatttttccagggtcacacggctaataagtaatgtgcccaaattcactcaggccagcctcaagtttatgatatgttctgccacatcactttgcctcttgagatccttaaactactactttatcttgctagttacaagtgagattctttatattgtcaagaggatagttattaaagtcaatttcagattaaggtagttacatgaacacaaagacttcctaccaaacttaaaaaaaaaaaaaaggaaagaggaaatttcaaatcactactgctagttattttcaaaagagttgggtttctgttaggtgactgcttttgttttttcctttccaaaatgggagacccaatgcaaacagtcaagctgaggaccaacaaatacaaactctgggtgttgtactgataaaaatagtgcaggaaagaggctaaatactacaacacaaacatccaaatatcatcaatgtccagaacagttacatgtttccaaaaaagactggtaaggtctatacacttaaactataaacactcccata

SEQ ID NO: 37421 - DNA, 601 bp, Human
cagaacagttacatgtttccaaaaaagactggtaaggtctatacacttaaactataaacactcccatatacaagctaaaaacaaaaaaaaacacaccaacacaacccagatgacatttattcaatttgcttgcagcaggtaaaaatatgcctcatggggacacaattaataaactgtgtagccacctgttcttcatcacatgcaggtaatgcaaagtgatgaggctccaggttttccagcacaggaggagtattggaaatcattacaacacacctggcctatttttattgtaggtacgctrccatttttttaacccaatgtatcttgaaatagtttttaatctagacataactgattacactgagagaaaaaaaagttataaccagagatggcttttatgcttacgtggtttgtcaatggaatataaaatcaaatcttcccacagctctccatcatcttgctccttggcaaattcgattgctttatcaacatcatgtaattcctccataatcatcttcagggcacttcggctattacccattcggccttggtggggtgaagatgggagaaagagttcatttaaggtattttaataattttt

SEQ ID NO: 37422 - DNA, 601 bp, Human
ttacatgtttccaaaaaagactggtaaggtctatacacttaaactataaacactcccatatacaagctaaaaacaaaaaaaaacacaccaacacaacccagatgacatttattcaatttgcttgcagcaggtaaaaatatgcctcatggggacacaattaataaactgtgtagccacctgttcttcatcacatgcaggtaatgcaaagtgatgaggctccaggttttccagcacaggaggagtattggaaatcattacaacacacctggcctatttttattgtaggtacgctgccattttyttaacccaatgtatcttgaaatagtttttaatctagacataactgattacactgagagaaaaaaaagttataaccagagatggcttttatgcttacgtggtttgtcaatggaatataaaatcaaatcttcccacagctctccatcatcttgctccttggcaaattcgattgctttatcaacatcatgtaattcctccataatcatcttcagggcacttcggctattacccattcggccttggtggggtgaagatgggagaaagagttcatttaaggtattttaataatttttttaaagaa

SEQ ID NO: 37423 - DNA, 601 bp, Human
taaactataaacactcccatatacaagctaaaaacaaaaaaaaacacaccaacacaacccagatgacatttattcaatttgcttgcagcaggtaaaaatatgcctcatggggacacaattaataaactgtgtagccacctgttcttcatcacatgcaggtaatgcaaagtgatgaggctccaggttttccagcacaggaggagtattggaaatcattacaacacacctggcctatttttattgtaggtacgctgccatttttttaacccaatgtatcttgaaatagtttttaatctagacrtaactgattacactgagagaaaaaaaagttataaccagagatggcttttatgcttacgtggtttgtcaatggaatataaaatcaaatcttcccacagctctccatcatcttgctccttggcaaattcgattgctttatcaacatcatgtaattcctccataatcatcttcagggcacttcggctattacccattcggccttggtggggtgaagatgggagaaagagttcatttaaggtattttaataatttttttaaagaaattgcatatctcttaatttgtttacataggtggaaagct

SEQ ID NO: 37424 - DNA, 601 bp, Human
taaacactcccatatacaagctaaaaacaaaaaaaaacacaccaacacaacccagatgacatttattcaatttgcttgcagcaggtaaaaatatgcctcatggggacacaattaataaactgtgtagccacctgttcttcatcacatgcaggtaatgcaaagtgatgaggctccaggttttccagcacaggaggagtattggaaatcattacaacacacctggcctatttttattgtaggtacgctgccatttttttaacccaatgtatcttgaaatagtttttaatctagacataactgrttacactgagagaaaaaaaagttataaccagagatggcttttatgcttacgtggtttgtcaatggaatataaaatcaaatcttcccacagctctccatcatcttgctccttggcaaattcgattgctttatcaacatcatgtaattcctccataatcatcttcagggcacttcggctattacccattcggccttggtggggtgaagatgggagaaagagttcatttaaggtattttaataatttttttaaagaaattgcatatctcttaatttgtttacataggtggaaagctaagacaa

SEQ ID NO: 37425 - DNA, 601 bp, Human
gctttatcaacatcatgtaattcctccataatcatcttcagggcacttcggctattacccattcggccttggtggggtgaagatgggagaaagagttcatttaaggtattttaataatttttttaaagaaattgcatatctcttaatttgtttacataggtggaaagctaagacaaggctattttctcatgtgacaccaacatttactgtctataacatagcaaaataagtatctcctatttactggatatttactctgtactgagtactcatttaagtgcctcatataaatgacatcatwtaaccatcactacaaccctatgaggcatgttctactaatattcctcttttatagaagaggaaatagaaatgttagtagcttgctaagatcatacagctactaaatagtacactgtgaatttgaagccaggtctgtcatactctgacttacttttgatagacttatatatattctggaggtcaataccttcacatgcagatacacttaaaatgtttaaaggccctaaagtcattctgcctcatgaggtagctgtgcatactgcttttctgatacactttgtgccaactgcaaactcaacta

SEQ ID NO: 37426 - DNA, 601 bp, Human
tccctagaatagctgcactcagttacctctcagaggtactggactctacacaattcaatttaaaacatatttgaagctactcagaacatttcatgagcaagagtagaaaacaagacaccaaatgaaaagaaagggcctttcccactaagctttctctctttacactacttcaggtttccttacagcactgcttccttccaaatctgtagtcatttgtttaagctctgtttccctccattaagatgtaaggaatgttgctcatggttgaacttttcctagtattgtgcataccataagctcrggaaatatgaattcatgctgcatgaatgaacgaatgaatgattgaatttactaggaatatttgtactgccagatcacaggggctgaaagagaactctgctcaaggatctgtcaaaggtgagaaggaaaaaacacttttgatgatcaagaaggatccaaaaaggagcaactatgcagatgagagcatttccattagtcttaaaaaaaaaaaaaagacctactatatattgataaattacttactaattctaaattaatcaggatacatttactatattctctgtgctgggtgctagagggt

SEQ ID NO: 37427 - DNA, 601 bp, Human
agtattgtgcataccataagctcgggaaatatgaattcatgctgcatgaatgaacgaatgaatgattgaatttactaggaatatttgtactgccagatcacaggggctgaaagagaactctgctcaaggatctgtcaaaggtgagaaggaaaaaacacttttgatgatcaagaaggatccaaaaaggagcaactatgcagatgagagcatttccattagtcttaaaaaaaaaaaaaagacctactatatattgataaattacttactaattctaaattaatcaggatacatttactatatkctctgtgctgggtgctagagggtcaggttagatagagatgcaaagatgacaataataaaaatgttagtgatgattataggtaagaggaaaacaaagaagagaataatggaggaggcttagtaggagcattagcagcatgagtccacccccgggagctcagggtccaggaagtgacagagatgtgacaacgcattattccacgattagagtaacatgaacaaagggccatgtgtacagaggagggacactgaaactgtgtggtcctcttgtgagaagcttcaaggggaagtggcatctgaa

SEQ ID NO: 37428 - DNA, 601 bp, Human
tcagacttaaagctgagaatctctaccacgacttacaaggcatccacaacctagcccttaatttctgtgcagcttcacctgcctctgctcacctctccattgcgtccccttgcctgaaatgcttcccttaccctgactctccactattggatggcactaccttacgtcatgaggtcaaggtcacccaaggtggacgaacaagaggaaggagccccggtctctgaccccgcggcatggtgctctcagcagggccactccaccaacacttccacgtgacagaaaaagaaactgttgctctgtkaagccacaattattttgggatttttatcactcacagttgaatctaatcctagctaataccgagaaaatcttcctttattttgattaaaaatatggtttacctattcctatatggtcttgcctgtcaatcaccattgtaaatgatgaaactttcttaccaactcttcactctcctgcagtgatactactgcagagacaaaaaacataagtaagaagttaaataataaagcaaaatagtgcaaatacatcagaggacacgggattcaaacaaaaaaccactgagaagccaactgagtgccta

SEQ ID NO: 37429 - DNA, 601 bp, Human
aatgatgaaactttcttaccaactcttcactctcctgcagtgatactactgcagagacaaaaaacataagtaagaagttaaataataaagcaaaatagtgcaaatacatcagaggacacgggattcaaacaaaaaaccactgagaagccaactgagtgcctagatttgttctgggtgttaagatacagatagtttatagttgagtgggactgccattcacagataaatagaacactgtaatacaactgaataaggagaatgtttagagaaagatagtctgactaatgataagcatttatgytgcttaaaataatttattattaaaaggtatccatgaatcaattctgtacttggaaattcacttacacactttaaaataccattcaagatttcagacagaaccattacccattttcttctgcacatgagaatgcttaagaacatgctagtctcaaaccacaaaagagtttgcagtttgaagcctcatctgagttatccaagacagcagccacttgctctatgtgtctatttaagtttaaattgattaaaattaaattaaattgaaattcagttccttggtagcaatagccagatttcaaat

SEQ ID NO: 37430 - DNA, 601 bp, Human
agatagtttatagttgagtgggactgccattcacagataaatagaacactgtaatacaactgaataaggagaatgtttagagaaagatagtctgactaatgataagcatttatgctgcttaaaataatttattattaaaaggtatccatgaatcaattctgtacttggaaattcacttacacactttaaaataccattcaagatttcagacagaaccattacccattttcttctgcacatgagaatgcttaagaacatgctagtctcaaaccacaaaagagtttgcagtttgaagcctcayctgagttatccaagacagcagccacttgctctatgtgtctatttaagtttaaattgattaaaattaaattaaattgaaattcagttccttggtagcaatagccagatttcaaatactcaattgtgacatgtggttggtggctactatgtgggacagagtagattataaaacatttccattgctgtagaatatgccatagaatagcaaggctataagatcctgtatatactttcaaaaaggaagtcatgtgggaagaaatgtctgaaggtaagctgaagttaggaatgacacggaatgtaa

SEQ ID NO: 37431 - DNA, 601 bp, Human
ttccccaacatagtggaaaaaatacagagcctaaaattaagtcatccaggttctaagtcttggtccctcaacttattagctctagactttaggcttttttccagctccctaagacttggcttgtcatgtataaaacgactctatccacctaactgcacttttgtagagattaaataaaacaatatacatgaaggcacaacatacattataaagcacaaaagaaatacaaataatttttattatctttaaaaattgctgtagatattataaattcccacaaactctgtatttcctttagaayaaacaatttcataaaagtttatgattaatttttgaatttcagagtcgtggtgattttaaatcctgaactctggcctttgataactataactagggcttttgatgtgacgtcaggatctttccaaagttttgggccaaatactattgattgtgggatttcaatcaattcaaaataaggttaacctagattcttgaagatttcaatcagttgccaatctgaaatcacctcctctcaacaattagccaattgttggcaaaggaagacaaccaaaggaaagacaaccaaaattagaaagatata

SEQ ID NO: 37432 - DNA, 601 bp, Human
ctagattcttgaagatttcaatcagttgccaatctgaaatcacctcctctcaacaattagccaattgttggcaaaggaagacaaccaaaggaaagacaaccaaaattagaaagatatagtgtcttcccagtaaaggaagacaaccaaaattagaaagatatagtgttctgccagaggtaaattataaacaacagtggatcaatgggttctgaatatgcctttgaaagcttaaacacttctcatttaaagtagaaacaaagaacaaaaaatcctcttgtaccaataggactcaacaatctcyaaattctaaggaagcagacagaaatttctttggggaaagggaggctttataatttcaaagttctcaatttcatattcaggagaaaaagagatcacattttctatgagtcgctctttatacaaaacaggcagacaggtattccgtgccctttactagcaagcttgggatgcgtttaattggagaaatccactttgtcattcgcaaattggtacatacgatagcttttcatgtcacatgtaaacataaaagggatttgtttctaagatgactgagtatatacagaattctttcttattattc

SEQ ID NO: 37433 - DNA, 601 bp, Human
ctctcaacaattagccaattgttggcaaaggaagacaaccaaaggaaagacaaccaaaattagaaagatatagtgtcttcccagtaaaggaagacaaccaaaattagaaagatatagtgttctgccagaggtaaattataaacaacagtggatcaatgggttctgaatatgcctttgaaagcttaaacacttctcatttaaagtagaaacaaagaacaaaaaatcctcttgtaccaataggactcaacaatctctaaattctaaggaagcagacagaaatttctttggggaaagggaggcwttataatttcaaagttctcaatttcatattcaggagaaaaagagatcacattttctatgagtcgctctttatacaaaacaggcagacaggtattccgtgccctttactagcaagcttgggatgcgtttaattggagaaatccactttgtcattcgcaaattggtacatacgatagcttttcatgtcacatgtaaacataaaagggatttgtttctaagatgactgagtatatacagaattctttcttattattcttttttatttatttaaagagagttttgctttctcgcctaggccgga

SEQ ID NO: 37434 - DNA, 601 bp, Human
cttactgtaacctcaaactcttgggctcaagacttcctcctccctcagcttcctgagtagctatgaatactgactggcatgtaccactacactggactaatgtttttatttttgtagagacagagtcttgctatgttcaccaggctggtctcaaactcctggcccaaaactattttcccaccctcagcttcccaaagtgctgggattagaggtgtgggctaccacacccaaccagaacttactttaaggaaaacggagtgagaatcttgagttagtaatactgtcatgaacctctcctttmagacagctttgggtacctgatagggtagagtgctatgttttctacaaatatacagatttcccacaatagatcctgacaaacagataatctcttatgaagaagtctcagtaacctgaaacatgaaaacccatttagggagtcctaaaaatatggattactacttgattatcttataatggtctgtttcaccattaccacctctaatccatgctcaaaattctctttcagtgggacacgagataaatttttaaaaataactgtgtctaaaacataattggttttactatgcttgtgctgagt

SEQ ID NO: 37435 - DNA, 601 bp, Human
aagacttcctcctccctcagcttcctgagtagctatgaatactgactggcatgtaccactacactggactaatgtttttatttttgtagagacagagtcttgctatgttcaccaggctggtctcaaactcctggcccaaaactattttcccaccctcagcttcccaaagtgctgggattagaggtgtgggctaccacacccaaccagaacttactttaaggaaaacggagtgagaatcttgagttagtaatactgtcatgaacctctcctttaagacagctttgggtacctgatagggtasagtgctatgttttctacaaatatacagatttcccacaatagatcctgacaaacagataatctcttatgaagaagtctcagtaacctgaaacatgaaaacccatttagggagtcctaaaaatatggattactacttgattatcttataatggtctgtttcaccattaccacctctaatccatgctcaaaattctctttcagtgggacacgagataaatttttaaaaataactgtgtctaaaacataattggttttactatgcttgtgctgagttcttttacattcaatatgttgtttccag

SEQ ID NO: 37436 - DNA, 601 bp, Human
tgactggcatgtaccactacactggactaatgtttttatttttgtagagacagagtcttgctatgttcaccaggctggtctcaaactcctggcccaaaactattttcccaccctcagcttcccaaagtgctgggattagaggtgtgggctaccacacccaaccagaacttactttaaggaaaacggagtgagaatcttgagttagtaatactgtcatgaacctctcctttaagacagctttgggtacctgatagggtagagtgctatgttttctacaaatatacagatttcccacaatagrtcctgacaaacagataatctcttatgaagaagtctcagtaacctgaaacatgaaaacccatttagggagtcctaaaaatatggattactacttgattatcttataatggtctgtttcaccattaccacctctaatccatgctcaaaattctctttcagtgggacacgagataaatttttaaaaataactgtgtctaaaacataattggttttactatgcttgtgctgagttcttttacattcaatatgttgtttccagtggaccagagagaaaaattctacaaggtctacacaaatgctc

SEQ ID NO: 37437 - DNA, 601 bp, Human
aaatatggattactacttgattatcttataatggtctgtttcaccattaccacctctaatccatgctcaaaattctctttcagtgggacacgagataaatttttaaaaataactgtgtctaaaacataattggttttactatgcttgtgctgagttcttttacattcaatatgttgtttccagtggaccagagagaaaaattctacaaggtctacacaaatgctctaagcaagccatatgtgtaggaagcatcacatgcaggtctgcaacattctgctgctccctactgggtgaagcaggktgtcttccactgagtactactagacccgaaaactttaaaccaggtgggcataaagtgtgtgagagatatagagatactggaacctgggtggcgcctctgcatcttgtgcttagggaatgggaagggctgttaatcacccacatgtgacctctctgtctcagaggtcaatgggagacttcaggagactgccacatcctctctgaaatatacaatgttctcttgaaaagtgagaaacaaatgaaggagcactgttcaaagaataagattctcactctattgccaggttataaagtcctatgt

SEQ ID NO: 37438 - DNA, 601 bp, Human
agaaaaattctacaaggtctacacaaatgctctaagcaagccatatgtgtaggaagcatcacatgcaggtctgcaacattctgctgctccctactgggtgaagcagggtgtcttccactgagtactactagacccgaaaactttaaaccaggtgggcataaagtgtgtgagagatatagagatactggaacctgggtggcgcctctgcatcttgtgcttagggaatgggaagggctgttaatcacccacatgtgacctctctgtctcagaggtcaatgggagacttcaggagactgccacrtcctctctgaaatatacaatgttctcttgaaaagtgagaaacaaatgaaggagcactgttcaaagaataagattctcactctattgccaggttataaagtcctatgttgagagaagagggtagtatctgtttttacttttagagtaagataatgaatttccaaattaagtcctcagaaaatgtcttagggccccaaatataaaatgctaatgtcgttttataagttaacaggcaggcaagatttttttcaataattgtggactttaaaaatccattgagctaaattggttcacagtactc

SEQ ID NO: 37439 - DNA, 601 bp, Human
tctgctgctccctactgggtgaagcagggtgtcttccactgagtactactagacccgaaaactttaaaccaggtgggcataaagtgtgtgagagatatagagatactggaacctgggtggcgcctctgcatcttgtgcttagggaatgggaagggctgttaatcacccacatgtgacctctctgtctcagaggtcaatgggagacttcaggagactgccacatcctctctgaaatatacaatgttctcttgaaaagtgagaaacaaatgaaggagcactgttcaaagaataagattctcaytctattgccaggttataaagtcctatgttgagagaagagggtagtatctgtttttacttttagagtaagataatgaatttccaaattaagtcctcagaaaatgtcttagggccccaaatataaaatgctaatgtcgttttataagttaacaggcaggcaagatttttttcaataattgtggactttaaaaatccattgagctaaattggttcacagtactccaatgcatttaataatcatgggctaaggaagcatacacggaagttgtaagtgtacataaactgtgttatcatccagctt

SEQ ID NO: 37440 - DNA, 601 bp, Human
cagaaaatgtcttagggccccaaatataaaatgctaatgtcgttttataagttaacaggcaggcaagatttttttcaataattgtggactttaaaaatccattgagctaaattggttcacagtactccaatgcatttaataatcatgggctaaggaagcatacacggaagttgtaagtgtacataaactgtgttatcatccagcttctttgcacatatctctaatgggtcaaatatgttttttattttgttggtccacacagctgactttcaaaagtatctggccatccaaatttagtcasacatttgtagatgttagtggtagatggtattgagaactgtaggacataatactgttggcttttaggctgcccagttgttagcacatatatagttaagtacttcagtttattttgaaacagcagtctcataaaacttactagtccttatttagcccgaactaggatcttgcatgtatataatttattcattcattctctcactcatgatgcaacacacatttagtaaatgtctaatgtgtggtgggtactagatttaccaaaatgagtaagacaaattccttgtctttgaagaatttccag

SEQ ID NO: 37441 - DNA, 601 bp, Human
ggaagttgtaagtgtacataaactgtgttatcatccagcttctttgcacatatctctaatgggtcaaatatgttttttattttgttggtccacacagctgactttcaaaagtatctggccatccaaatttagtcacacatttgtagatgttagtggtagatggtattgagaactgtaggacataatactgttggcttttaggctgcccagttgttagcacatatatagttaagtacttcagtttattttgaaacagcagtctcataaaacttactagtccttatttagcccgaactaggaycttgcatgtatataatttattcattcattctctcactcatgatgcaacacacatttagtaaatgtctaatgtgtggtgggtactagatttaccaaaatgagtaagacaaattccttgtctttgaagaatttccaggagacagagactagtaagcagataattatagtggaatgtaggatgtaggagaaacaaagaaaaacatagggtagacacttaaagaagataggatgcaggacctaagctatgacctcagtttatcaaacctgattcctgactggagcaactgcttctggcttagga

SEQ ID NO: 37442 - DNA, 601 bp, Human
ttagcacatatatagttaagtacttcagtttattttgaaacagcagtctcataaaacttactagtccttatttagcccgaactaggatcttgcatgtatataatttattcattcattctctcactcatgatgcaacacacatttagtaaatgtctaatgtgtggtgggtactagatttaccaaaatgagtaagacaaattccttgtctttgaagaatttccaggagacagagactagtaagcagataattatagtggaatgtaggatgtaggagaaacaaagaaaaacatagggtagacasttaaagaagataggatgcaggacctaagctatgacctcagtttatcaaacctgattcctgactggagcaactgcttctggcttaggacagtctgtgtctccctcccaggctcttgactctgaggtgtcactctgatcctgggagatggactgagacttctaatatatcatttttgcctgatggttgattaagtcctagaccctggattaagctgttcttccaattaaacctgtcacagaaatgcttcagctcttcaccaaagtctaatccaatgagatctccttttcttgacagaatgtc

SEQ ID NO: 37443 - DNA, 601 bp, Human
aaagataagccgtgacccattaaaatgagaaaagcaatacctggctaacattgctatttttagctctaaacacctcccatggacaggttgggggagaagcagtcttcagggaaaacctctaggtgatggagaagtggaaaggaaaaccctttgggagagcaaaggattccgataatttctctagaagggccccaaaacctgactctgccacgtaccaactgtgaccttaggcaagtcactaatctctctgagactcagtttatctacaaaaattttattgagttactgtgacaattaaacragttgccattacgaaatcactcagaaccaatgaacttagcatacactaagaactacagaaatgttaatgacagtagttgtcaatatcatcattggtatctgctttggctcagaaataaaaagatgagtggtcttcccagatcataaaaattattttacacaaaagagggtagagtcctgggacaagcacatattcttaaaaactcaagtagcgggcactaaactcatttccatacattctgcatctcctctttgttgactcttcaaatgaaatgctgcctaaactggtaacatcaaaaac

SEQ ID NO: 37444 - DNA, 601 bp, Human
attacgaaatcactcagaaccaatgaacttagcatacactaagaactacagaaatgttaatgacagtagttgtcaatatcatcattggtatctgctttggctcagaaataaaaagatgagtggtcttcccagatcataaaaattattttacacaaaagagggtagagtcctgggacaagcacatattcttaaaaactcaagtagcgggcactaaactcatttccatacattctgcatctcctctttgttgactcttcaaatgaaatgctgcctaaactggtaacatcaaaaacaaaaatayaaagtaaaaatcaagaagaatgcaggtgttctgaaacagttttcaaaactgattccttaccttagctgtctgaaaaaaagttaacttcacaggaaatcagtaattcactttctcctcacaggcaagattaagtctatcaatacagtactcagaagtcaaaaaacaattcaatgtttagttaatattaaatgtaaacaaaaaccccacaatctactgaagacaggaagacttaatcaccaatcccacgagcattaacaccttgggttgctgtttccaagtggattggtttataacagacat

SEQ ID NO: 37445 - DNA, 601 bp, Human
tacactaagaactacagaaatgttaatgacagtagttgtcaatatcatcattggtatctgctttggctcagaaataaaaagatgagtggtcttcccagatcataaaaattattttacacaaaagagggtagagtcctgggacaagcacatattcttaaaaactcaagtagcgggcactaaactcatttccatacattctgcatctcctctttgttgactcttcaaatgaaatgctgcctaaactggtaacatcaaaaacaaaaatacaaagtaaaaatcaagaagaatgcaggtgttctgraacagttttcaaaactgattccttaccttagctgtctgaaaaaaagttaacttcacaggaaatcagtaattcactttctcctcacaggcaagattaagtctatcaatacagtactcagaagtcaaaaaacaattcaatgtttagttaatattaaatgtaaacaaaaaccccacaatctactgaagacaggaagacttaatcaccaatcccacgagcattaacaccttgggttgctgtttccaagtggattggtttataacagacatagagcaccagccgccctgcagctgagactgtaaa

SEQ ID NO: 37446 - DNA, 601 bp, Human
aactacagaaatgttaatgacagtagttgtcaatatcatcattggtatctgctttggctcagaaataaaaagatgagtggtcttcccagatcataaaaattattttacacaaaagagggtagagtcctgggacaagcacatattcttaaaaactcaagtagcgggcactaaactcatttccatacattctgcatctcctctttgttgactcttcaaatgaaatgctgcctaaactggtaacatcaaaaacaaaaatacaaagtaaaaatcaagaagaatgcaggtgttctgaaacagtttycaaaactgattccttaccttagctgtctgaaaaaaagttaacttcacaggaaatcagtaattcactttctcctcacaggcaagattaagtctatcaatacagtactcagaagtcaaaaaacaattcaatgtttagttaatattaaatgtaaacaaaaaccccacaatctactgaagacaggaagacttaatcaccaatcccacgagcattaacaccttgggttgctgtttccaagtggattggtttataacagacatagagcaccagccgccctgcagctgagactgtaaatgcgctgat

SEQ ID NO: 37447 - DNA, 601 bp, Human
gctgcctaaactggtaacatcaaaaacaaaaatacaaagtaaaaatcaagaagaatgcaggtgttctgaaacagttttcaaaactgattccttaccttagctgtctgaaaaaaagttaacttcacaggaaatcagtaattcactttctcctcacaggcaagattaagtctatcaatacagtactcagaagtcaaaaaacaattcaatgtttagttaatattaaatgtaaacaaaaaccccacaatctactgaagacaggaagacttaatcaccaatcccacgagcattaacaccttgggtkgctgtttccaagtggattggtttataacagacatagagcaccagccgccctgcagctgagactgtaaatgcgctgatgtttgttattgctgttgaatctagtcacaatgacgcctaaccatggacacatgcaccttaagaaaccaatcttcaggcttcctgttcacttcttcctaaggcaaaacggagcagtacaagcagtagactgaactcatgtgccaggcagaggtctgatgaacaccaccgccagtccactggcactggggtcagtgtgttagcggggatatgtggtgctgtttcc

SEQ ID NO: 37448 - DNA, 601 bp, Human
caggaagacttaatcaccaatcccacgagcattaacaccttgggttgctgtttccaagtggattggtttataacagacatagagcaccagccgccctgcagctgagactgtaaatgcgctgatgtttgttattgctgttgaatctagtcacaatgacgcctaaccatggacacatgcaccttaagaaaccaatcttcaggcttcctgttcacttcttcctaaggcaaaacggagcagtacaagcagtagactgaactcatgtgccaggcagaggtctgatgaacaccaccgccagtccacyggcactggggtcagtgtgttagcggggatatgtggtgctgtttcccagagtgcaaaaaggacagggaggccctgtcacatgaatgctgagtcaaatttatatatatagaaacaagacattgcctggcagggaagatgagccatgttagtgtgggctgtgccaccacttcaccattgcactgattacattgtcgcacagagagctactgcccataatcctgtctcctggcttaagtaagtcagaaatcactgctttataaatgaattcctaaggtggttagcaatgtggagccttgcttgg

SEQ ID NO: 37449 - DNA, 601 bp, Human
ccaatcttcaggcttcctgttcacttcttcctaaggcaaaacggagcagtacaagcagtagactgaactcatgtgccaggcagaggtctgatgaacaccaccgccagtccactggcactggggtcagtgtgttagcggggatatgtggtgctgtttcccagagtgcaaaaaggacagggaggccctgtcacatgaatgctgagtcaaatttatatatatagaaacaagacattgcctggcagggaagatgagccatgttagtgtgggctgtgccaccacttcaccattgcactgattacaytgtcgcacagagagctactgcccataatcctgtctcctggcttaagtaagtcagaaatcactgctttataaatgaattcctaaggtggttagcaatgtggagccttgcttgggaagcagataatcttgagatttccaatcatgaacaatgcagcagtagcatctgagcaaaagagaaaaaaaggtgcctctcattcccttcctgcagtcttcaaaagcttcaaagcagaaaactgacttttgaaaaaaatgctctattccctaagcctcctcctagggtgcaatgagatgggcaaagata

SEQ ID NO: 37450 - DNA, 601 bp, Human
cttcctgttcacttcttcctaaggcaaaacggagcagtacaagcagtagactgaactcatgtgccaggcagaggtctgatgaacaccaccgccagtccactggcactggggtcagtgtgttagcggggatatgtggtgctgtttcccagagtgcaaaaaggacagggaggccctgtcacatgaatgctgagtcaaatttatatatatagaaacaagacattgcctggcagggaagatgagccatgttagtgtgggctgtgccaccacttcaccattgcactgattacattgtcgcacagakagctactgcccataatcctgtctcctggcttaagtaagtcagaaatcactgctttataaatgaattcctaaggtggttagcaatgtggagccttgcttgggaagcagataatcttgagatttccaatcatgaacaatgcagcagtagcatctgagcaaaagagaaaaaaaggtgcctctcattcccttcctgcagtcttcaaaagcttcaaagcagaaaactgacttttgaaaaaaatgctctattccctaagcctcctcctagggtgcaatgagatgggcaaagatacaagtgcactta

SEQ ID NO: 37451 - DNA, 601 bp, Human
agcaatgtggagccttgcttgggaagcagataatcttgagatttccaatcatgaacaatgcagcagtagcatctgagcaaaagagaaaaaaaggtgcctctcattcccttcctgcagtcttcaaaagcttcaaagcagaaaactgacttttgaaaaaaatgctctattccctaagcctcctcctagggtgcaatgagatgggcaaagatacaagtgcacttattgtatctgatacccatagtcctactgatataatccctaagtgtgctaagttttctcttgtataacttttaaaggacayagaaaacaactattcctgctttactctcatgatgatgcaatgcagagaattgaagtagccccccaaagaaatctagaataacaggccttaattacacaaccaccaatagcacacaagaaatatggaattagctattgtcatggtgagggacaaaagaaatgagactctgcccttttatcgctctgtggtctggatatggaatggttgtctgacatttccttagcaggagaacttggtacagtatctgcggtgccatactggcctttactgtgatatatgccatggttatatttaatggca

SEQ ID NO: 37452 - DNA, 601 bp, Human
caggtggaaggcttattttgtatacttaaggaggcccttggctttacaatggctcttatggaaaatgacatttgtgaagaactgcattttcaaatgcatctcaatctgaagcctatgtgttttgcacactactaaaatggtgctttgctataacttcccaaatacaaaacatcttgactgcccatatcctagccccccgccctccgatgtctcggataccttcacaccttctcatgagactctcagtagttatggagagcatctctttaccagtatatcaagaaaatgagcttttcttccrgctacttcaacctcgacctagtctccctatgagactccacagacagaaggagctggttttatgaggagaagggaataagagtcagaaagagaatgagatacctgaagtttcataatgacataaagcttttggactttcagaatttactttagccacttttatcattcaggaaacacaaactagacagtttatgtcaagaggaagagggaaagcagcacaccagactgagcctcacacggaacacctgggggccctgttctagactctgctacgacctagctgtctgctccaaatgttact

SEQ ID NO: 37453 - DNA, 601 bp, Human
ctagactctgctacgacctagctgtctgctccaaatgttacttttgttctctgaaatacgagggtgttggagtagattatccctaaggtctcttctaaccagaagactctgattccttacatctggatcacattctagaatagcaattagtttcagctcattcatcttttttccacaggaacatatgcaaaacgagctctggagaacaatggaagggggtgcatgaggggagactagatatgaggaaaatgtaattaatttttacataagcatctcatcctctgccagacaagcagagcckctctacctgaacttccttggagctacgtaattcttcgtaaatctgtagtccctaaagacttgactcagtattttaaaaagggctaaagcatctttgagaaaaagaggtagctctagctcctatctaaattaagtttaagttggtggagattaatagagcacacaatatctctaaatacagtacaatataattgaaaaatgcattaatccttttggagcctttagggttctacttttaggtttatctaaaatttcaattttttgaataagaacactgttttataaacctcattatttctgt

SEQ ID NO: 37454 - DNA, 601 bp, Human
ctcattcatcttttttccacaggaacatatgcaaaacgagctctggagaacaatggaagggggtgcatgaggggagactagatatgaggaaaatgtaattaatttttacataagcatctcatcctctgccagacaagcagagccgctctacctgaacttccttggagctacgtaattcttcgtaaatctgtagtccctaaagacttgactcagtattttaaaaagggctaaagcatctttgagaaaaagaggtagctctagctcctatctaaattaagtttaagttggtggagattaatakagcacacaatatctctaaatacagtacaatataattgaaaaatgcattaatccttttggagcctttagggttctacttttaggtttatctaaaatttcaattttttgaataagaacactgttttataaacctcattatttctgtcatgagcacttgtaattagatttcttttacacacacacacacacacacacacacacacacacacacacacacacagcttgcatcactttgcaagcgccaatgtgagctgtggctgggtccactcattagggggcgtaaatttattattaggttatt

SEQ ID NO: 37455 - DNA, 601 bp, Human
ccagacaagcagagccgctctacctgaacttccttggagctacgtaattcttcgtaaatctgtagtccctaaagacttgactcagtattttaaaaagggctaaagcatctttgagaaaaagaggtagctctagctcctatctaaattaagtttaagttggtggagattaatagagcacacaatatctctaaatacagtacaatataattgaaaaatgcattaatccttttggagcctttagggttctacttttaggtttatctaaaatttcaattttttgaataagaacactgttttatamacctcattatttctgtcatgagcacttgtaattagatttcttttacacacacacacacacacacacacacacacacacacacacacacacagcttgcatcactttgcaagcgccaatgtgagctgtggctgggtccactcattagggggcgtaaatttattattaggttattcaaatttgtcacacaataaaataacattccacatgtcctggacatgagcatcacctcaaaccaggggaaaccccacatgctgggatacgtgaacaccaagaaataaaatagtaataagtcggtcaaga

SEQ ID NO: 37456 - DNA, 601 bp, Human
acaactagaataacaacatctagcgagggtcagagtgttctaaagattgtcggcataaagccaagttatgtgattcattcaccaatccagcatttggatagatatctaagtattaaatatttggaatagtaaaaataattgacagtactaaaataaaaagcacattacctctgaatcaaaatccattaataaaacaattttatccttgatagaactgaaaagattatgcttgtggatcaactgaaaaacgtctttatgtcttaatgttaagtatatttccagagcattgccatagttcttrtcataggtgtacctggtaatacaaattttttacattaatattcatcaacagttctaattaaaacacacacagagagatcatggttcacaatattaaaaatggaaacactcctttagagagaaaagttaactttatttcaaaaaatattcctatttttgaataggatttaactatacatgaccaataagtatttctttctcagaactttgcctctcatgttgccaaaatttaagaaaattcacaatattcaagtaataaaaatggtctttattgggggtctcagtctcaaaagttttacaa

SEQ ID NO: 37457 - DNA, 601 bp, Human
aaatccattaataaaacaattttatccttgatagaactgaaaagattatgcttgtggatcaactgaaaaacgtctttatgtcttaatgttaagtatatttccagagcattgccatagttcttgtcataggtgtacctggtaatacaaattttttacattaatattcatcaacagttctaattaaaacacacacagagagatcatggttcacaatattaaaaatggaaacactcctttagagagaaaagttaactttatttcaaaaaatattcctatttttgaataggatttaactatacaygaccaataagtatttctttctcagaactttgcctctcatgttgccaaaatttaagaaaattcacaatattcaagtaataaaaatggtctttattgggggtctcagtctcaaaagttttacaaacatccatacagcaaagaaactaggatccaggatgaagttctcattttagtaacagaaacatccgttccaattcttacaagcagtattcagctgacaaatggctaatattccaaaagctgattttaagggggctgtgtctaactgaaatgtgtttttccattgaaacaatgtttttca

SEQ ID NO: 37458 - DNA, 601 bp, Human
tcattttggtataccttttttggttttgggcaaaagaagaaaaaacaagggagaggagtggcctgaggtgatgggggcactgaggagaggtggatgcagggatggtcgtcttggctagacctgcagtatacttcttgtttccctagatcgaagtacttgagagcatatcttatctatctctgtatcataagcgtctcgcacaaagcctgcatcactgaatgtgcccaagaaatatgaaaaatattaaccaagctgccattttctgagccctgactcagggtcagggagtcctctattatgmcatctcttttaaagtttaaaattttcccataaggaattgacatttgagagattaaattaactgacttgaagaccctagaagagcagaatccagagccttgctcattgggaaactgttatgcttgagtgatctaaaacttggcacccttttgtttcctaaccactgcctctcccaagcgctgtgcgttaggggttctcttctctgggaaacagattacattgcaattgtacagtttcacacatgtccttatcgcctactcatttgaggtttatgagaggtttttactaagaaggaatgtag

SEQ ID NO: 37459 - DNA, 601 bp, Human
cataagcgtctcgcacaaagcctgcatcactgaatgtgcccaagaaatatgaaaaatattaaccaagctgccattttctgagccctgactcagggtcagggagtcctctattatgacatctcttttaaagtttaaaattttcccataaggaattgacatttgagagattaaattaactgacttgaagaccctagaagagcagaatccagagccttgctcattgggaaactgttatgcttgagtgatctaaaacttggcacccttttgtttcctaaccactgcctctcccaagcgctgtgcrttaggggttctcttctctgggaaacagattacattgcaattgtacagtttcacacatgtccttatcgcctactcatttgaggtttatgagaggtttttactaagaaggaatgtaggaaaatggtataaaatacatcttctccacttggagtttgccaaatctaaagtatgaaaaacttttcaacacagactgatatggaaaaagaaacacttaagtatactcacaattctgccagggttttaagtaaagtcttgttctgactatctttcttcaaatgatcccgaactgcttgaactatga

SEQ ID NO: 37460 - DNA, 601 bp, Human
aatgtggcaaaaccctaaccaaaggtgaaaaacagaaaaagaacactcattcaacagaataatagttgtgatattgtgaaatatacatttggtcctccttctgtttcctggcatataactctcaaaatccttagaatctctaaaatgatgtgtcttcttgtatgctaatgagctgactggtggctagcagcccctaggtaacttaaggatggggttgggcacaggatagactgagacaggattaaagggttggaacttttcagccctacccccacccctgccccacaacctccaaggaggrgagaggggctgaaggttacaccgatcaccaatggcccagtgtttaaatcaattatgtctaagtaatgaagctttcattaaaacccaaaaggagtggctttggagggctccccaagagctgaacacctggaggttcctggagggtggtgcacccaaagaggacctggaagctccatgcctcttcccacataccttgccctctgcatctaatccatttggctgttcatctgtatcctttgcaatattctttataataaaccagtaaatgtaagtaaagtgttcccctgagttctatgagctg

SEQ ID NO: 37461 - DNA, 601 bp, Human
atgtggcaaaaccctaaccaaaggtgaaaaacagaaaaagaacactcattcaacagaataatagttgtgatattgtgaaatatacatttggtcctccttctgtttcctggcatataactctcaaaatccttagaatctctaaaatgatgtgtcttcttgtatgctaatgagctgactggtggctagcagcccctaggtaacttaaggatggggttgggcacaggatagactgagacaggattaaagggttggaacttttcagccctacccccacccctgccccacaacctccaaggagggkagaggggctgaaggttacaccgatcaccaatggcccagtgtttaaatcaattatgtctaagtaatgaagctttcattaaaacccaaaaggagtggctttggagggctccccaagagctgaacacctggaggttcctggagggtggtgcacccaaagaggacctggaagctccatgcctcttcccacataccttgccctctgcatctaatccatttggctgttcatctgtatcctttgcaatattctttataataaaccagtaaatgtaagtaaagtgttcccctgagttctatgagctgc

SEQ ID NO: 37462 - DNA, 601 bp, Human
acagaataatagttgtgatattgtgaaatatacatttggtcctccttctgtttcctggcatataactctcaaaatccttagaatctctaaaatgatgtgtcttcttgtatgctaatgagctgactggtggctagcagcccctaggtaacttaaggatggggttgggcacaggatagactgagacaggattaaagggttggaacttttcagccctacccccacccctgccccacaacctccaaggaggggagaggggctgaaggttacaccgatcaccaatggcccagtgtttaaatcaatyatgtctaagtaatgaagctttcattaaaacccaaaaggagtggctttggagggctccccaagagctgaacacctggaggttcctggagggtggtgcacccaaagaggacctggaagctccatgcctcttcccacataccttgccctctgcatctaatccatttggctgttcatctgtatcctttgcaatattctttataataaaccagtaaatgtaagtaaagtgttcccctgagttctatgagctgctctagcaaatgagtcaaatctaaggaggtggtagtgggaattccagtttata

SEQ ID NO: 37463 - DNA, 601 bp, Human
gatatttggtcacagaagtgttgtgttgtgagagtatagcatgagaaactgagtttggtttctcctaaattctcaaaacaaaccaaacaatttaaaccatccctaaaagtattcacttttagtcacataacagaccaaacaattatatgattaaaagtttgttcaataaatatttcatcaattttcagactatgggtctgggtgtggtgaagagttgcagggaatattattgtacaataaatctccatttagcattcctgggaggcaggtcgtgccatctacttctgtccttagttttacraaatgtacaactaagaaagctatcttgttccttctataaagtgcatggacaagagtttaggttggacttgctccatccccattctggactaactgtaacatttggatgacagctttaacatcttacagatattacccaagtcagctactttccccaccaccaagagtcctctaatgcacttaggcctgggctgctgggtgcaactggttatgcagttgtgcactgtatagccagcacaactgaccgtggcagtctgcttgggacagggctgctcccacagtgaaactgtccagcattcta

SEQ ID NO: 37464 - DNA, 601 bp, Human
tcaaaacaaaccaaacaatttaaaccatccctaaaagtattcacttttagtcacataacagaccaaacaattatatgattaaaagtttgttcaataaatatttcatcaattttcagactatgggtctgggtgtggtgaagagttgcagggaatattattgtacaataaatctccatttagcattcctgggaggcaggtcgtgccatctacttctgtccttagttttacgaaatgtacaactaagaaagctatcttgttccttctataaagtgcatggacaagagtttaggttggacttgcyccatccccattctggactaactgtaacatttggatgacagctttaacatcttacagatattacccaagtcagctactttccccaccaccaagagtcctctaatgcacttaggcctgggctgctgggtgcaactggttatgcagttgtgcactgtatagccagcacaactgaccgtggcagtctgcttgggacagggctgctcccacagtgaaactgtccagcattctatatctttaacaagtcaccatcttggtcctccttccactttggcttctaatgccagttttatgttggaatttg

SEQ ID NO: 37465 - DNA, 601 bp, Human
ctaactgtaacatttggatgacagctttaacatcttacagatattacccaagtcagctactttccccaccaccaagagtcctctaatgcacttaggcctgggctgctgggtgcaactggttatgcagttgtgcactgtatagccagcacaactgaccgtggcagtctgcttgggacagggctgctcccacagtgaaactgtccagcattctatatctttaacaagtcaccatcttggtcctccttccactttggcttctaatgccagttttatgttggaatttgagactttggctcaagtmttatcccctggctcttatcctggctatctctagatctcaaattttgtggttccccgatttgatcctgtttccgtcccacagctgattctgggccagtatcttgctcagtctctactccctgattcccgactttagacttcatgttttataactcaaagtatgacagagcagtttacttactgatccttgacaatgtttagaacaaaaacatgttcataagacagtaaagagaattaaaaacatccacgttattaaatgtgaaaggaaaataaattctcaggacctccaattcactaagcc

SEQ ID NO: 37466 - DNA, 601 bp, Human
ggaaaataaattctcaggacctccaattcactaagccaaagggaaagttaagggaactgagtcatgcaaaaattgccttccttttgttcccaaacagagagctgtcatttcacatgcttcctttagctcatgtcaaagctagatctactgagcaagagatgaatgcataattgactttttccccacttctctctttttacatgtaaaacgtagatttcctgagctaatcagagcatcactggaatgtgaccaagtgcctcattgcttactctccccctacttatttatttatttatttttwaaatttgctcctttgcctcctgcttgctctttcccctttaaattttgaagtcctcaacaatctctttggaaaaagcacaggacacagaccctgtttcttttccccaagtatgtccctaaccttggcaaaataaaccttaaagtcgattgagatctgtctcagtcactttttggtttatataaaaaatagtacattattactattaaataactccattaatactttaatgaactactgtgaatttgtttaaataatacttagaaatgaaaacaatgtgatagaagctgcttctgtaatgca

SEQ ID NO: 37467 - DNA, 601 bp, Human
atgtaaaacgtagatttcctgagctaatcagagcatcactggaatgtgaccaagtgcctcattgcttactctccccctacttatttatttatttattttttaaatttgctcctttgcctcctgcttgctctttcccctttaaattttgaagtcctcaacaatctctttggaaaaagcacaggacacagaccctgtttcttttccccaagtatgtccctaaccttggcaaaataaaccttaaagtcgattgagatctgtctcagtcactttttggtttatataaaaaatagtacattattastattaaataactccattaatactttaatgaactactgtgaatttgtttaaataatacttagaaatgaaaacaatgtgatagaagctgcttctgtaatgcaccaggatttggtaagaaaagtgcaaaagaatcagtaatatagttttcattaaagttccacccgatttctaccaaagtagcccctggaaggatggcaagagaccagaacaaaagaccacatattttccatttagattacaaacttcttatatattaatatgattgaaattttacttcagaaatttgggaatggattcaatc

SEQ ID NO: 37468 - DNA, 601 bp, Human
attattactattaaataactccattaatactttaatgaactactgtgaatttgtttaaataatacttagaaatgaaaacaatgtgatagaagctgcttctgtaatgcaccaggatttggtaagaaaagtgcaaaagaatcagtaatatagttttcattaaagttccacccgatttctaccaaagtagcccctggaaggatggcaagagaccagaacaaaagaccacatattttccatttagattacaaacttcttatatattaatatgattgaaattttacttcagaaatttgggaatggrttcaatcagaacattaaaatgtttgtagaaccaaaataatatttcagatcaagtttctttcttttcttccttctctgtttccctttccttgtctttccttccttgtccttcctttcttccctccctcccttccttttctttctctctctctccctctttctttgtttttctctctctctcttcctctctttttttttttttttttttttttttttcaggtggtgtttcgctctgtcgcccaggctggagttcagtggcgctatcttggctcactgcaacctccgcctcctaggctcaagc

SEQ ID NO: 37469 - DNA, 601 bp, Human
aaagaatcagtaatatagttttcattaaagttccacccgatttctaccaaagtagcccctggaaggatggcaagagaccagaacaaaagaccacatattttccatttagattacaaacttcttatatattaatatgattgaaattttacttcagaaatttgggaatggattcaatcagaacattaaaatgtttgtagaaccaaaataatatttcagatcaagtttctttcttttcttccttctctgtttccctttccttgtctttccttccttgtccttcctttcttccctccctcccttmcttttctttctctctctctccctctttctttgtttttctctctctctcttcctctctttttttttttttttttttttttttttcaggtggtgtttcgctctgtcgcccaggctggagttcagtggcgctatcttggctcactgcaacctccgcctcctaggctcaagcaagtctctcgcttcagcctcccaaatagctgggactacaggtgcatgccaccatgcctggctaatttttgtattttttttttttttagtagagacggggtttaaccatgttggccaggatggtctccatctc

SEQ ID NO: 37470 - DNA, 601 bp, Human
gaccacatattttccatttagattacaaacttcttatatattaatatgattgaaattttacttcagaaatttgggaatggattcaatcagaacattaaaatgtttgtagaaccaaaataatatttcagatcaagtttctttcttttcttccttctctgtttccctttccttgtctttccttccttgtccttcctttcttccctccctcccttccttttctttctctctctctccctctttctttgtttttctctctctctcttcctctctttttttttttttttttttttttttttcaggkggtgtttcgctctgtcgcccaggctggagttcagtggcgctatcttggctcactgcaacctccgcctcctaggctcaagcaagtctctcgcttcagcctcccaaatagctgggactacaggtgcatgccaccatgcctggctaatttttgtattttttttttttttagtagagacggggtttaaccatgttggccaggatggtctccatctcctgaccttgtgatccgcccgcctcagcctcccacagcctcccaaagtgctgggattacaggggtgagccaccacacacagcctctttc

SEQ ID NO: 37471 - DNA, 601 bp, Human
cacatattttccatttagattacaaacttcttatatattaatatgattgaaattttacttcagaaatttgggaatggattcaatcagaacattaaaatgtttgtagaaccaaaataatatttcagatcaagtttctttcttttcttccttctctgtttccctttccttgtctttccttccttgtccttcctttcttccctccctcccttccttttctttctctctctctccctctttctttgtttttctctctctctcttcctctctttttttttttttttttttttttttttcaggtggkgtttcgctctgtcgcccaggctggagttcagtggcgctatcttggctcactgcaacctccgcctcctaggctcaagcaagtctctcgcttcagcctcccaaatagctgggactacaggtgcatgccaccatgcctggctaatttttgtattttttttttttttagtagagacggggtttaaccatgttggccaggatggtctccatctcctgaccttgtgatccgcccgcctcagcctcccacagcctcccaaagtgctgggattacaggggtgagccaccacacacagcctctttcttt

SEQ ID NO: 37472 - DNA, 601 bp, Human
ctgaatagctgagagtacaggcatatgtcacagcactcagctaatttttagttttttatagacaggtctcactatgttacccaggctggttttgaactcctgggctcaagcaatcctcccaccttggcctctcaaagtgctgggattacagatgtgagccaccgtgacagccctgttttcttaagactatataagataaaatagtctgtaaagatttctaccccaataccagcagctcacagtagcccctagaccattaataataatgctcagggaaagaagaaagtttggcctcattttytcttttccctatcatgcaacagcctcatggtactgccaacttcgaacacaaaataaagacaaaataaccagtcatcttgtatgataaaagcatgatgaccccaccataaactgaaataaacatctatcatatttcatgttaggcttctctctgttcaactggctttgtgtacccttgaataaatgtgctacccaagaaatatttataaaatctatctgtggccattattactaattagaggacacaggaacaagggacctgttatgattgaatgagcaaagttatagaaaacctcagtac

SEQ ID NO: 37473 - DNA, 601 bp, Human
gtttggcctcattttttcttttccctatcatgcaacagcctcatggtactgccaacttcgaacacaaaataaagacaaaataaccagtcatcttgtatgataaaagcatgatgaccccaccataaactgaaataaacatctatcatatttcatgttaggcttctctctgttcaactggctttgtgtacccttgaataaatgtgctacccaagaaatatttataaaatctatctgtggccattattactaattagaggacacaggaacaagggacctgttatgattgaatgagcaaagttayagaaaacctcagtacctatcataataagtaaaagtctagaaagtactcatgaaatgaaatgccacagaaatcatccaatttttaacatgcttatatgtttgtcgttaatattaaacaaagcttaactgtttaactctgctgggtcgtaaattaataggcaaagctacaggcatatgactagaaaccccatacaaagaagtcatgaagcatctttacctccaatattacttcatgtctttttagggagaaaaaaattgacaagtcaatattccagagaagtacagtttgttttttgtaatc

SEQ ID NO: 37474 - DNA, 601 bp, Human
atttcatgttaggcttctctctgttcaactggctttgtgtacccttgaataaatgtgctacccaagaaatatttataaaatctatctgtggccattattactaattagaggacacaggaacaagggacctgttatgattgaatgagcaaagttatagaaaacctcagtacctatcataataagtaaaagtctagaaagtactcatgaaatgaaatgccacagaaatcatccaatttttaacatgcttatatgtttgtcgttaatattaaacaaagcttaactgtttaactctgctgggtcrtaaattaataggcaaagctacaggcatatgactagaaaccccatacaaagaagtcatgaagcatctttacctccaatattacttcatgtctttttagggagaaaaaaattgacaagtcaatattccagagaagtacagtttgttttttgtaatctgaccttcagtgctctgtttagcaacacaaaatgtctctccacataatatgtgatcaaaagtgttgttagggaacacagctatttgactgataatgtgacaatttaattcaaaattaaataattaagctgagaataagggaaggta

SEQ ID NO: 37475 - DNA, 601 bp, Human
aataattaagctgagaataagggaaggtaaaacatgaactatttataagagcttatgaaaataaaaacaaattatttacaacctccttaacagtactgaccagacatacatcctaaaacattcaggagaaaacatctacaatctctaaggttaagtcatgcttctttccatctcaataaaaagtgttccagatatgaaatcaacagggtaactttgacgataaaggatttttaaaagtttcatgaaaaaataagagttcaatcatgtgcaataactgtaacagaatcataaaaacaataamtttttttaaatgcttaaattacattactttaaaaataggaaaattataacatacttcagcatttgtaaaggaagtttgtactcttctccatcattttcacagaacactcataattctctttcttctgggatgatatcaaagatggaatagcagctgctattgtatttatgaaatctacaaaatagcacttagctctttttctttagttctagaaagaaggtaactttaaggaattccttaaaatgcacacggactaagtgttttcactgtctacataaacatgagttatactggagtttc

SEQ ID NO: 37476 - DNA, 601 bp, Human
agtcacagagatgaaaaaagtcgacttcttaagtaatcgaggagtacaggtaatctattcatctttccttccttcaactggagtttaccaaccttcaccaactcataatcatcttttgaaattaggaaaaatacatcttgtgttcttcagatattttcagtactgtgttaaaagtcaaatttacaaatactgttcaatgaccctataatgccctacaatccaatcaccacactttttactggggacagacagagaaggtcaccatccccaaggagctcacaagtcctagaagaaagatatrcagacaattaaacagacaataactgtattgtgtggtaagtgttataacagaggggtcagcacagtgctgcagcagcagaggagaaccatgcccactaaagccctgggtttctcaggaaaaaataagagaggggcaggacatctggcagggggaatagcatgagcaaaggcgtggagccatgaacatgcatctgtgtgcagggaggtcagaggagcccagagatgcgagatggcgtcactgaagggaggtgaggctggagaggaaggggaggtggggtcttgagaggaattctgattttat

SEQ ID NO: 37477 - DNA, 601 bp, Human
ttgattaggatgttgtgcactaagttgaaagatttaaaaaaagaaacatcaaaattattcattagagctaggtggtcaattttttccatctgtctttcagcaggtaaaatattacttgaaaaatacaatattattcagtaaatctaaaaaaagtcttatgctttataacctactggatgagattacacctattttcaaaagtcattaaaaagagcatgaaaacttcatctaaacacagagagaattggaaagagataagtgaacacattgtatatgtaataaatatataatcttatatatgtttttttacacgaggcttatattttgaaactgtctctaaaagtttgatttttctttccatctgagataataatcacgtcctaaaaaagagctgagtactattatctttgtttccactgcaatattaatatactacttgcagaaactgagagttaaaaataaggctttgcttaccttaagctgtccaatttctttaaatttataaacttcatattcccagagtgctgcatttttcccaagaattttctggcatttgctggcagtaaaaacatcccaggcagaaagaaagtatatattaaaa

SEQ ID NO: 37478 - DNA, 601 bp, Human
cttgcttcttaagcatattcatatttaaatgtatttatattttcatacattttagaattcacaggtcaggtcattaaaaaaagtaaataatgttagtattttaaaggctcctaatctgccccctttaagacattttttcataaaggaggtattcgatattagaaacatgatcgaacaattccacactgttaatgtatataaaattgtttcctgtgccttcatctgtagaatgcaagctacctacttcttctaccccaagtctgaagagaagttataagaaaaatgaaataatgactatcayactaaaggaaatagggaatattaaagttgatatgagctcagaaaaacctgtgattcaaacccatcagtttacagaagaaattgggctgaaagcagggaagtgactggcttcagagtattcatgtttattcgcttattctacctgggttctgaaaggatttggggtggccaacatcaccagaggcatgggaggacagctcttgcttgatctccccatgactcatcttctcatatactatttgcacctaaaagtattttcaccagaagcttaagcttgatatatataagaaacgttgggtgt

SEQ ID NO: 37479 - DNA, 601 bp, Human
gtatttatattttcatacattttagaattcacaggtcaggtcattaaaaaaagtaaataatgttagtattttaaaggctcctaatctgccccctttaagacattttttcataaaggaggtattcgatattagaaacatgatcgaacaattccacactgttaatgtatataaaattgtttcctgtgccttcatctgtagaatgcaagctacctacttcttctaccccaagtctgaagagaagttataagaaaaatgaaataatgactatcatactaaaggaaatagggaatattaaagttgwtatgagctcagaaaaacctgtgattcaaacccatcagtttacagaagaaattgggctgaaagcagggaagtgactggcttcagagtattcatgtttattcgcttattctacctgggttctgaaaggatttggggtggccaacatcaccagaggcatgggaggacagctcttgcttgatctccccatgactcatcttctcatatactatttgcacctaaaagtattttcaccagaagcttaagcttgatatatataagaaacgttgggtgttgatttctactttatgtacaaaaaggtgca

SEQ ID NO: 37480 - DNA, 601 bp, Human
caccaaatccagtgtacaactgaccagctgacctcgtcttacccttctgacctgcttacctccactactcaagcatttaattctctttaccctggaattctctcctctctcagctcccatgaaatgaccttgctctggctgttccaaatctactatgtatgcatcatcccttgaatgacagcattcctgatggttccattcatggtcctctgttcatgacactcactctaaaatgtatgaaaatataaatacatttaaatatgaatatgcttaagaagcaagcataattacataaagcaarctaagagtataaacaggttacagtcagtagtgctaataggaccctaatgtgtcctgtgcagaaactgagactcaacttttcagcccaaatttctttcctgggctccactacgatgtcccacagattcctaaaactaatgtgtttaaaataggattcatcatttctcccaatcctgcttctccttccacagggtatctctatcaatcagtaaatggcagcaccaaaccagaggcccaagcccaaagcctgggagtcagcctagatttttactcttattctttcatccacacagagtcagtt

SEQ ID NO: 37481 - DNA, 601 bp, Human
aggcaagccgatcacctgaggtcgggagttcaagaccagcctgaccaacatggagaagtcccgtctctactaaaaatacaaaattagccaggtgtggtggcgcatgcctgtagtcccagctactcgggaggctgaggcaggagaatcgcttgaacccaggaggcagaggttgcggtgaaccaagattgtgccattgcactccagcctgggcaacgagagcgaaactccgtctcaaaaaaaaaaaaaaaagccttcaactgcccacataaccaagcaggccaagctgtggcacctctctgcmtcttcacatatgttaactactctaagggccggaatgcattctcttccatttctagagaatccttgcttattctccacaattttggctggattttttttttttttaagatgctctggttttctattctcctgttattcctaaattattttgcttctgcactctttgacaattcaggctttcatgtggagttttacagagaagtttacggtagggaaaatgtaggcagaaagaatttgtactgaaacccaaataggcataaaagactgagcttccagttttcacctgtaaaaaagggaactc

SEQ ID NO: 37482 - DNA, 601 bp, Human
aagtcccgtctctactaaaaatacaaaattagccaggtgtggtggcgcatgcctgtagtcccagctactcgggaggctgaggcaggagaatcgcttgaacccaggaggcagaggttgcggtgaaccaagattgtgccattgcactccagcctgggcaacgagagcgaaactccgtctcaaaaaaaaaaaaaaaagccttcaactgcccacataaccaagcaggccaagctgtggcacctctctgcctcttcacatatgttaactactctaagggccggaatgcattctcttccatttctasagaatccttgcttattctccacaattttggctggattttttttttttttaagatgctctggttttctattctcctgttattcctaaattattttgcttctgcactctttgacaattcaggctttcatgtggagttttacagagaagtttacggtagggaaaatgtaggcagaaagaatttgtactgaaacccaaataggcataaaagactgagcttccagttttcacctgtaaaaaagggaactcggctagatggtctccaaggacccttcacatgtgcaggatgtgagttcctctgctc

SEQ ID NO: 37483 - DNA, 601 bp, Human
tcaattgagtctgttattatggaaacaccaaagcaatgcagttttaggaaacctctctttttttgataaattttgtgataatgtgatttttacctacgatttagggaaactttcatacacataactagaaagctctgtatttaaagtgttttccacagatacagtttccaaattacctaaaactgcctcctagcaggtgttcaagtctcttgtttacaagcagaaactgatttgataaaatattttgatctcataggttagggaattagtttaaaataaattctcaaaagataggaaaaayctgttcttttcaaattattttcagtctcactataacttattgaaagataaaattatgtttcaaataacaaattgcacacttaccagaatcttatgtcttttaatatttttttggctaatttcagctgccatcaatgcttcctttattccaaacataaggatgatttaaaaaaaaaaaaaaagcagaaaaggagggagggaaaatgggagaaggtgggagagaaagatattgaggttataaacactatagttattatggtttagcattctgcactacacgaataaagctccattttcccat

SEQ ID NO: 37484 - DNA, 601 bp, Human
ccaaattacctaaaactgcctcctagcaggtgttcaagtctcttgtttacaagcagaaactgatttgataaaatattttgatctcataggttagggaattagtttaaaataaattctcaaaagataggaaaaacctgttcttttcaaattattttcagtctcactataacttattgaaagataaaattatgtttcaaataacaaattgcacacttaccagaatcttatgtcttttaatatttttttggctaatttcagctgccatcaatgcttcctttattccaaacataaggatgatttaaaaaaaaaaaaaaagcagaaaaggagggagggaaaatgggagaaggtgggagagaaagatattgaggttataaacactatagttattatggtttagcattctgcactacacgaataaagctccattttcccatggcttttgcttgaagcattggaattgttaatgctatggttgaatgaacctcactgaattcaaactcaaaggcagtcaaccaaaatgaagacttctcccacttccatttgaattcatttcctcattaggacaatggaatcacatttcagacacaaatcaaaatacaac

SEQ ID NO: 37485 - DNA, 601 bp, Human
agtagtacagcattcctacaaagctgaactgttctattttcattaatatattttacaagggtatgataacagccaaacacagatgtctctggtatgactaaatattaatggttctccctgtatttatgagcagtgactaagtgtatttctctgtccactcaacaaatattcactgaacacctaaaatgtgccagaagtctttcaggctctgagcactcagttacaaacaagaaagacaacttctctgccaccccagagcgaactttcctgacacataaaatgggagtgatatgacaaccayggagccatgcagcttgacattaaattatgtgtcacattaaatagttaggacaatagaaaaaatacaagaacaaaaaacaaggggcccaatcctcccccgggtcctggtctgaactctagccttcccttttactataggagcttatgcaagttttgcaacatctctgcatccaaatgtccttgttttcagcacacacagtctacccaggtattctcttaagattctttcagcaccttaatttaaattccatttattgcaagtaggaagggggagaaaaaaacattaaaaaagcatatcagc

SEQ ID NO: 37486 - DNA, 601 bp, Human
tctttcaggctctgagcactcagttacaaacaagaaagacaacttctctgccaccccagagcgaactttcctgacacataaaatgggagtgatatgacaaccacggagccatgcagcttgacattaaattatgtgtcacattaaatagttaggacaatagaaaaaatacaagaacaaaaaacaaggggcccaatcctcccccgggtcctggtctgaactctagccttcccttttactataggagcttatgcaagttttgcaacatctctgcatccaaatgtccttgttttcagcacacacrgtctacccaggtattctcttaagattctttcagcaccttaatttaaattccatttattgcaagtaggaagggggagaaaaaaacattaaaaaagcatatcagccagatctttcatatctcttacctaaatgataatctctacattcattctcctgaaagcctctgactgtcaaagcatcagaagagatctcttcacaagtctcagaaagtggctggatgatgtccagtctaggcctggcacagtattctctttcctagtgggggaaaagagagaaacattaatttaaattacatttctat

SEQ ID NO: 37487 - DNA, 601 bp, Human
cctgaaagcctctgactgtcaaagcatcagaagagatctcttcacaagtctcagaaagtggctggatgatgtccagtctaggcctggcacagtattctctttcctagtgggggaaaagagagaaacattaatttaaattacatttctatatatcatacaaattaattctagttagccatacatattagtttcttctcacactcctatgaagaaatacccaagactgggtaatttataaaggaaagaggtttaactgactcacagttctgcatggtgggaaaggcctcaggaaacttacaaycagaaaacattccaaaaataaaatagcaactataaaagatcaactagtgaagaaaaatctatcagatctgtggagaaattacaaattgctaaactttgaaacaactgaaaaaaaatggagaaaactgaaatatatttaaaaattgaccactgtaacaataaaaatatcaaaatcagaatagcaaaataaaaaaatattttgaacaaaataaaaagaaaatcacttcactagaccatagaaaaggctcttttatatgtataagaaaagcatcagcaatgtgaatctcattttatactttcg

SEQ ID NO: 37488 - DNA, 601 bp, Human
actagaccatagaaaaggctcttttatatgtataagaaaagcatcagcaatgtgaatctcattttatactttcgttccctggccaaacagcccttgcctgtgaactccctaagagcagaaatctggttttgttgatcttggatctccagtgcccagcacaatttctaacacacatgtgctttatcaatgaatgaaagaaaagtaaaatactaggagaacaccttaataaattaaagtgtaccaagcagatggaatagtacacaaccactaaacacaatgatggtggcaagtacacagacayacgcagggaaaatggaataatgcccatgaaaacagggcaatgcagagtagcatgtgactatccctgcaactatgtgaaaacatgcatgtacgtgaaaggtatcacgtggatatctgggggctatttgggggataatactgaatgatataaaacaaattgtattcaatgtcgctaaaccaccttttcagtatgaaaaaataaagggggaagggagcttacctctttgttccttttgccttaattttatgagtttattctgtgtttaaggatttaaggtgtactttaatgttctataaaatg

SEQ ID NO: 37489 - DNA, 601 bp, Human
acagattttgatgtaccattatttgcactgataactgagatttcacaacaatccatttcaaagccataatcaagctacttagaatcaccagcccactaggaagtaaacaaatatgtctggaccaaagaaaataatgaaatgccctttctgtaattccctctgaccacagggacccctgttgttgctgctgatcaacttcattgctgtcatttctgctaatgcacagtgtcagcttagtttcttcccctttcagcaagaggaatccttcattccttttgactaatataccaagagaggtcgraaaaaaagactcttttttggctcagcaataggaacaaaggcaggcaatgagtagagtttccggaaagtaaatatgtcaggtctaaagggtaatctctgccaaccttattttataggtcagaaagttctgctcagattatagcgtatgctactgatgaacaacctgatctgggtgtaatgctaaaagtgaacccccacatgcctttgtatctggggagaaaataattaccgttttttctgaaatctcctttacatacgaaagtacaacaagctgatcacagagaggtgcaagtccactgat

SEQ ID NO: 37490 - DNA, 601 bp, Human
gccataatcaagctacttagaatcaccagcccactaggaagtaaacaaatatgtctggaccaaagaaaataatgaaatgccctttctgtaattccctctgaccacagggacccctgttgttgctgctgatcaacttcattgctgtcatttctgctaatgcacagtgtcagcttagtttcttcccctttcagcaagaggaatccttcattccttttgactaatataccaagagaggtcgaaaaaaaagactcttttttggctcagcaataggaacaaaggcaggcaatgagtagagtttccrgaaagtaaatatgtcaggtctaaagggtaatctctgccaaccttattttataggtcagaaagttctgctcagattatagcgtatgctactgatgaacaacctgatctgggtgtaatgctaaaagtgaacccccacatgcctttgtatctggggagaaaataattaccgttttttctgaaatctcctttacatacgaaagtacaacaagctgatcacagagaggtgcaagtccactgatgtagaattcagtttcaaactgagacactgcaaacaaaagggatacaggagtcatcatcaaca

SEQ ID NO: 37491 - DNA, 601 bp, Human
ccctcaggcggggcttgaacccatggctgcagaggtagaagcctccacatagaagtgaccggctgtcttcttccttgattgctttttgccatttgtctcttgtccgtttcatataactgcctgtccacttctccaattttcttcccttctggtagacttttgagcttataagttatccactcttcttcccacacttactagggaaactactaaatcatctaatggcacattccacaatgccaaatggacaactgttttaatgtgctgatataagtacatgaggaacagtctttcaaatggyttgaagtataataaaaaagcaaatgtatcggcaatattagtgaacacttttttgggcagttactggcagtgctcctgagttaaggcctttgtgaaatagatatcattattttcttaagattatggtgcagtgggggagacacaaaaataaggcactttactgaagtgtgacagggaagtacagagcaggggcatctcctgctagggcaggaagacttcctggaagaagtgacatgtaagttgaagcaggagagacaacacaggagaacacggtgatatgacagcatagggccttcaactg

SEQ ID NO: 37492 - DNA, 601 bp, Human
ctaatggcacattccacaatgccaaatggacaactgttttaatgtgctgatataagtacatgaggaacagtctttcaaatggcttgaagtataataaaaaagcaaatgtatcggcaatattagtgaacacttttttgggcagttactggcagtgctcctgagttaaggcctttgtgaaatagatatcattattttcttaagattatggtgcagtgggggagacacaaaaataaggcactttactgaagtgtgacagggaagtacagagcaggggcatctcctgctagggcaggaagacttmctggaagaagtgacatgtaagttgaagcaggagagacaacacaggagaacacggtgatatgacagcatagggccttcaactggaagctcaatcggacagaaatgaagggcatgggggaagaaggggacagagttgaggctggagagtaacggagaggcagatcacaaagaaccttggaagtcatgtttatgatcagttatcctatgggcaaggaggggactgacctcatctgacctgcacttagattattctagctatactgtttaggataggtttagggggggtaaaaccagcaccaaa

SEQ ID NO: 37493 - DNA, 601 bp, Human
taatggcacattccacaatgccaaatggacaactgttttaatgtgctgatataagtacatgaggaacagtctttcaaatggcttgaagtataataaaaaagcaaatgtatcggcaatattagtgaacacttttttgggcagttactggcagtgctcctgagttaaggcctttgtgaaatagatatcattattttcttaagattatggtgcagtgggggagacacaaaaataaggcactttactgaagtgtgacagggaagtacagagcaggggcatctcctgctagggcaggaagacttcmtggaagaagtgacatgtaagttgaagcaggagagacaacacaggagaacacggtgatatgacagcatagggccttcaactggaagctcaatcggacagaaatgaagggcatgggggaagaaggggacagagttgaggctggagagtaacggagaggcagatcacaaagaaccttggaagtcatgtttatgatcagttatcctatgggcaaggaggggactgacctcatctgacctgcacttagattattctagctatactgtttaggataggtttagggggggtaaaaccagcaccaaaa

SEQ ID NO: 37494 - DNA, 601 bp, Human
cagatcacaaagaaccttggaagtcatgtttatgatcagttatcctatgggcaaggaggggactgacctcatctgacctgcacttagattattctagctatactgtttaggataggtttagggggggtaaaaccagcaccaaaaagacttgacaggaagatgaagtgcagagatttgagagacattgacagaacttgagggctgacagtcttccaacactcagacacccctgaaagacaatgttattatgtttaatccagagatgaggacactgaggctctgtgagtgatgccagactgcmtggccagagctggaattcacaccaaggcctgactggtatctcgctggtcatgccacagcttgagaacaaggatgcattgcactactggtagctgggcatggctctactgcactcctcagctctgtggtctgggctcacccagcacctgtctcataggtaggaagtggcaggtaaaggtgggtgaataggtaagtgctaccttaagctcatgtcttgcataagcacaaatcaatgactgtaagagccctttaccactgataggtgggttcttgcccatgaactctaatctgcttcctccac

SEQ ID NO: 37495 - DNA, 601 bp, Human
aaaacctgactaaacaacaaaactaaccccatgttctgtaaatagctaaggccagctgggatgtgagaaattaaaagaagattgaaaaagacagcaccattctcaacacgaaaaagttcacaaatagttttacatgccatgggaaaagaaagaatacatcttaaaacttatgcacaggaaataatttgagcattaaatggtaatcacgtcacaataacatccaagtgaaaagatttgggtcctagaagccaatcaagactcacagtcctttggaccaccctcagtggatctataacaacayggacttattataaagacaagcaaaaccaccttgacagaagtcccccagccaataatcagtgtcacattgtccttccagcagaggctgcagggatacatgtctgggcgaagacttatatcatcccggggcacattggtgattctttgctttgagatgatgtcaaaaatcttcacaccctggaaaataatacagcagtaagcatcctctactcaggaggaaagtaacagaaaacttattaacagcccctgctacatactaccaataaccagcacggagaaatattagcagtgtttactgagc

SEQ ID NO: 37496 - DNA, 601 bp, Human
tcacctgtatagaggcagcaagggaggtcaagggaggttggtcaaggtagcaagatgtcacaactgtttctaactggatacaatttacagaaaacaaaacaaaaaaaaaaaaacagaaagaagccaactaactccttgtccaagatgactctcaatgatagacggcaccaagtggcaacgcagcctcccagacgtttagcccacttacaccaagaccccatcaatggagagagaacagagctacaggcccaaagagctaaccgttcaggacttagctttttagatacaacctgttcccctsattctcatctgcttcccactcatccaatctttctccagccccttgctacccaggtttctcttaaggttgctccaccacccttgttactgtttccttcatttgcaagggctttatgattacataacatcattaacatcttggggaggggatgaaaacaaaagccctcgtggctccactcagtgcacctccatctttggagctcatctgttgtggctgtaagcttgcatagactccacctccttctctctttatccccaaaccacccatgaaatcaccaacttaactaattttgtgtttttc

SEQ ID NO: 37497 - DNA, 601 bp, Human
acaccaagaccccatcaatggagagagaacagagctacaggcccaaagagctaaccgttcaggacttagctttttagatacaacctgttcccctgattctcatctgcttcccactcatccaatctttctccagccccttgctacccaggtttctcttaaggttgctccaccacccttgttactgtttccttcatttgcaagggctttatgattacataacatcattaacatcttggggaggggatgaaaacaaaagccctcgtggctccactcagtgcacctccatctttggagctcatcygttgtggctgtaagcttgcatagactccacctccttctctctttatccccaaaccacccatgaaatcaccaacttaactaattttgtgtttttctaatttaacatagagaattttttttaggtaaacacacacacaaaatctcacacaattttacttctatataccttcaattaaacatattttatacttgtattaattgacacatttccctcctacaatggaatagattcctcttcctacaatgtcatttttaaggattagcatatgatccttcattgctctaaacactcctacctccc

SEQ ID NO: 37498 - DNA, 601 bp, Human
aaacaaaagccctcgtggctccactcagtgcacctccatctttggagctcatctgttgtggctgtaagcttgcatagactccacctccttctctctttatccccaaaccacccatgaaatcaccaacttaactaattttgtgtttttctaatttaacatagagaattttttttaggtaaacacacacacaaaatctcacacaattttacttctatataccttcaattaaacatattttatacttgtattaattgacacatttccctcctacaatggaatagattcctcttcctacaatgtyatttttaaggattagcatatgatccttcattgctctaaacactcctacctcccaggttagcccttcttcccttcaacactttcctaatccatcctcaataccagtagtgaaggattcacacattctattgtttcacattcttaaactctccccctagctctctcgtaatgcataactgtagatcagggactgattccaaacatctcctctgctcctcaaacacattatgttacccttttcttcccttcagatgtaagaaaataaagccatcagggtcattgcccacaagtgctcctcctt

SEQ ID NO: 37499 - DNA, 601 bp, Human
aatgcataactgtagatcagggactgattccaaacatctcctctgctcctcaaacacattatgttacccttttcttcccttcagatgtaagaaaataaagccatcagggtcattgcccacaagtgctcctccttcactgtctaacttgcaatagctaggctcagtccacttccttcatgcctgtttcacaggcagagggtctaggactcttccaagattatcttccctacctaagctgttgatctcattgcttagtgctgctccaagaagcattctctttatttttaatcttttcctcttyactggtttttgccatgaaccaaaacatggtcggcaaaaaccttcccaggacacggcccctctctctaccagatgatctctcttctttattactaaatttctttaaagaagagtctctgctgattgtttctacttcctcatctccaatttattccttcatgtatagtgaccctcctgctctgaaaagagtcctcagcaaggtcaccagtaacttcaaaatcaccacatagaatgcccttgtttcagtccttccccctatttaatctccacactgcattcgacactgctgaccacttcctcc

SEQ ID NO: 37500 - DNA, 601 bp, Human
ttcctccttgtagaaaccctctctcccctggcttctctgacaccactcttcgggattccttacagtccctccaactgcttcttcttagactcctttgctgttttttcttccacagcctgagtattcaagttagagtgttccagaatttcaccatcagtcttctcttctcactctacagctctaaattggataatatctttaaaaatagcttcaccttattcaactatggttatcacgtttgtgtttaagggccaatctccatcctgaggcccatattcatgtttctaaaacctccgtaacrtccccacctgatgtactacacttatctaaactcaggaccaaactagcctagccatgtccttactcaaacataccctactgcaactgatggcatcccacaccccatccccaaagcgagaacctgaactgaccctgagctcttccgtctttcatcaccctcatccaagccatcactaaggctcgctaagtctatttagcacaggctgtccaaataaatttcatcctttccatcttgaacactcactatcattcttttcattgagatcctgtaatgccctgcctagagtattatattaggctt

SEQ ID NO: 37501 - DNA, 601 bp, Human
ctcctttgctgttttttcttccacagcctgagtattcaagttagagtgttccagaatttcaccatcagtcttctcttctcactctacagctctaaattggataatatctttaaaaatagcttcaccttattcaactatggttatcacgtttgtgtttaagggccaatctccatcctgaggcccatattcatgtttctaaaacctccgtaacgtccccacctgatgtactacacttatctaaactcaggaccaaactagcctagccatgtccttactcaaacataccctactgcaactgatrgcatcccacaccccatccccaaagcgagaacctgaactgaccctgagctcttccgtctttcatcaccctcatccaagccatcactaaggctcgctaagtctatttagcacaggctgtccaaataaatttcatcctttccatcttgaacactcactatcattcttttcattgagatcctgtaatgccctgcctagagtattatattaggcttctaaattgtcttttgtccccaatcactctcctgtttaaatcaccctccactctggcaaattcaactttttaaaacatacatcagaccct

SEQ ID NO: 37502 - DNA, 601 bp, Human
tctcctttacctgctggtcaataaatgtttgaataaacaggtgaaaaaaataaatgacctcttccttcaacaactataatagacacctcaactaccataatttttatctaaaactagtcctcttgactcttatctgtccttcaatcaatactgtatacagtcaccatattaattttcttaaagcttagttcagtttatttactttgttcttaaatatttagtaatttctagttatctaccaaatggagtccaaattcttcagcctgaatgtaaagccagcccaatcttccttcacattctgttgtgaaatcagtcttttatgtaccaaataaattggacaatttgccatttcctgaacacaaggtgaactttctagcctctccatttctattatgttgttcttccacatggaaagccagcttctctcatcagtccttctccatttattaaagccaagttaaacatcactccaccaatgaagccatcactgacaagaacagctaaaagtgattcctttcagctttggaacgcttaatattattcctacctctttgagtcttttaccacagatcgtgtgtgtgtgtgcgtgcgtgtgtgtgtg

SEQ ID NO: 37503 - DNA, 601 bp, Human
tgtgaaatcagtcttttatgtaccaaataaattggacaatttgccatttcctgaacacaaggtgaactttctagcctctccatttctattatgttgttcttccacatggaaagccagcttctctcatcagtccttctccatttattaaagccaagttaaacatcactccaccaatgaagccatcactgacaagaacagctaaaagtgattcctttcagctttggaacgcttaatattattcctacctctttgagtcttttaccacagatcgtgtgtgtgtgtgcgtgcgtgtgtgtgtgtrtgtgtgtgtgagtgatctcactcactataataaaatacccctgaagacagactgagatcacagtcacaaaatacacattctgtcttctttcacagcatctaaatagtatccagtacatctgaagtgttgaacagacacttactgacaaaattaatacagaagtggtaatgttcaaattactgtaatccatattgccttacttgagaaaacccttagaaaaagtaaaacttgctgaatacttactttaatgggacagtcaaaagtctcgtgaaattcttctccagaatacagtccaaatac

SEQ ID NO: 37504 - DNA, 601 bp, Human
tttaataattttaaggccccgtgacctctattaaatatctaatgaaaacaatcccatcagccacgtacggtggctcacgcctgtaatcccagcactttgagaggcagaggccgaggtgggtggatcacctaaggtcaggagttgaagaccaccctgaccaatatggtgaaaccccatctctactaaaaatatgaaaattagccaggcatggtggcgtgcatctgtagtcccagctactcaggaggatgataggagaattgcttgaacctgggaggcagaggttgcagagagccgagattgygccactgcactccagcatgggtgacagagtgagactccgtctcaaaaaaaaaaaaaaagaaaaagaaaaagaaaaaagaaaaaagaaaatcccatcaggttgagggtactttgctgcaattaagctttcataagcattccatggatagagttcccttcaatcaccacaaattgtattaaatgcatgccattaaaacaatgaaacagatttgaacaagttattactattcttttataaacttccataagctgtccctaaaggaactattttttcatcccttaaaggaaaggggagattttt

SEQ ID NO: 37505 - DNA, 601 bp, Human
aagctgtccctaaaggaactattttttcatcccttaaaggaaaggggagatttttttttagtgtctctcatatatataaaataaaccaaccatgtagatcagtgtggtaagagattaggtgaaccacacttcactcacaacttatgctaaatctactgagaatacagaaatgaaagatttaagttcctgcttatcagtgtctcccttaaagttgttccaggctactttattcatacttagtatattttctgagtgctttacttaacaacaacaaaacaaaaacaaaactgaaatataaaayacatgctataaaaaatacaaatcataaatttatagtttgatgaatttttatgacacgaacatatccgtgtaaccatcactctgatcaagaaatagaagccaataagctcctttgtttccctttccagtaaataacaccctccaactaatcactaccctcaaagctactggcatggataagttgtgctggtgttagaattttgtaagtaaggaatcatattctatttcactgatttatttcattcattatttaacattttctttgtgagatttagccacactgttggatatagtagaggtt

SEQ ID NO: 37506 - DNA, 601 bp, Human
catgctataaaaaatacaaatcataaatttatagtttgatgaatttttatgacacgaacatatccgtgtaaccatcactctgatcaagaaatagaagccaataagctcctttgtttccctttccagtaaataacaccctccaactaatcactaccctcaaagctactggcatggataagttgtgctggtgttagaattttgtaagtaaggaatcatattctatttcactgatttatttcattcattatttaacattttctttgtgagatttagccacactgttggatatagtagaggttgsttctttgccactgctgggtattatttcatgtatgaatatatcacaattcacatatccatcttccattgatgaccacttaggttgtttccagattggggctatcatgaatactgctgctaagaacatgctttgcaaatcttttggtggacttatatacatattcatgaagggtgtataccttggaatggaattgctgagtcataggttatgtgcatgttcacatttaataggcaaaccatttcacaaagtggtttcaaattaattatgctctcaccatgagaaagtttgaatgtttgtgtt

SEQ ID NO: 37507 - DNA, 601 bp, Human
ccattgatgaccacttaggttgtttccagattggggctatcatgaatactgctgctaagaacatgctttgcaaatcttttggtggacttatatacatattcatgaagggtgtataccttggaatggaattgctgagtcataggttatgtgcatgttcacatttaataggcaaaccatttcacaaagtggtttcaaattaattatgctctcaccatgagaaagtttgaatgtttgtgttcccccaaattcattacgttgaaacctaacctccaaagtgatggttatttatactctcagcatragaattccatgagatctcaaatgcttggagctaacaaatagtactagagccaatgagaactatttcccaacattggaatgtgttcactgtctttctagtctctagtatagtggtattattcttctttaacttttgtaggaattcactggtgaagccatctaggtctcatggctttgctatggtctgaatgtatgtgttctccccaaattcactgtgttgaaacctaacctccaaggtgatggtattaagaagtagggcctttagtgagtgattaaattatgaaggtggagccctcatagg

SEQ ID NO: 37508 - DNA, 601 bp, Human
gtttaactgagcaacattttcctcaagtgttcttatattctatttcaatataaaaaacatataacttcacgagacaaatctcataagctttgtcagtatcagcacaagggtgatttgtaaaatcttcaatgttttggttcatttcactactatgacatgccaaactagctgctcacacgttatactactaaagataataaaatccaaaacaattctcatttatttcccctctctctccctctttatttattttgccattttgtctgtgaaaatcacacttatctgtaaagggaatccctcsgcttttgggaagagctcatctgagataagaatcacataattaaaggttacgagagaggacccttttgaaaacggtatctcctgtagtagccctaacaactaccctgaacctgctaaaaaaaaatacctaatgaagaaaaagagaaaattcctaacaatgagccatagaaccaagctcctgcaaagtcctgggagaattctcattagctacaaaccagagagccatgtgagtaccttagaagtatgtggtacatgttttgttacccgaaatagaggaaacctaccctcatgaaacagtaag

SEQ ID NO: 37509 - DNA, 601 bp, Human
gacaaatctcataagctttgtcagtatcagcacaagggtgatttgtaaaatcttcaatgttttggttcatttcactactatgacatgccaaactagctgctcacacgttatactactaaagataataaaatccaaaacaattctcatttatttcccctctctctccctctttatttattttgccattttgtctgtgaaaatcacacttatctgtaaagggaatccctccgcttttgggaagagctcatctgagataagaatcacataattaaaggttacgagagaggacccttttgaaaayggtatctcctgtagtagccctaacaactaccctgaacctgctaaaaaaaaatacctaatgaagaaaaagagaaaattcctaacaatgagccatagaaccaagctcctgcaaagtcctgggagaattctcattagctacaaaccagagagccatgtgagtaccttagaagtatgtggtacatgttttgttacccgaaatagaggaaacctaccctcatgaaacagtaagggatgtaatcattctccactttagcatgaaactctatgtatttgccaaccagaacactgggcaacagccctg

SEQ ID NO: 37510 - DNA, 601 bp, Human
ttttgagatggagtctcactctgtcacccaggctggagtgcagtggcgtgatctcagctcactgcaagctctgcctcccggattcacaccattctcctgcctcagcctcccgagtagctgggactacaggtgcccgccgccacacccggctaattttttgtatttttagtagagatggggtttcaccgtgttagtcaggatggtctcgatttcctgaccccgtgatctgcccgcttcggcctcccaaagtgctgggattacaggcgtgagccactgcactggccaaaaagttctaattttwaaaaaattaaatatatatcaggctgatatgaaaacagaattgggaaagatttcagacaaattaaaaatgcaaaatgcaataaaaatctactccaggaagcagtaagacacaaaactgactttggaagaaaagtgaatcagagaagggaataaacaagtagaggaactctccctgactacacagaaataaaaggctaaaaatgagaaagcaaagtatatgtgtgagacgtcacacaatatgaatgaacaattttctatacaacctatgtattgccaaaaggaggagaagggtaaatagtgc

SEQ ID NO: 37511 - DNA, 601 bp, Human
aaggttttagaaaagaacaaaagtaggctggtttcagacatgtctacacaaataaatgtcagaaaaaagggagcaacatctccaaaattttgagaaaaaatattccaacccagaattttatactatagtttacatatgaaagcaacatatgcaagaaatcccaaaataaaccttgtatgtacttatcctaaaagttttctagaaacatatgccagtaaactgaaactgaacacacacacacacacacgcacacatacgatatgtgtgtctcaaaatgtagaactgcagaaaagtcatgacaaaaaaaagattgaaaatgagcaccagctgaataaacggtgtaaattttaaacaactgctggaattatgacttgaaaactgaatgcaaatatcaaaggttatccttgaaataaccctaataaataattatttatctaggaaccttaacacactgaagaaaggaaaaaatacccacaaaacctatttaaagatgcattagatttagatatctggaatgtgtttgtgtaatgtctttatatttttatcatcaccaaccactttaccagatcattctatactagcttctcaattttcacaatac

SEQ ID NO: 37512 - DNA, 601 bp, Human
tcttctccatttctgcacaaaccaactcctccttcatctctctctgataatcatgacaatctcagaatttctgaaagtactgtaaaatttgacagtgctttttgaaaagcactagtgttccaattactgtttcaaaagactctttgggcaacattaggcttagatatataaaatgcattcttgtatgtcaagagacttcatgttgctttttgttaacagattaaatgggtatatctcttttacaccgggtatactgtttttaatttacccatcttaatggcccactgaatttagggcacayaataaatacaaaattagattaggaaatctgctttactcagtaaggaatatgtaaagatctataatgattcttaatgcactctctcaaactgttattttagaaaagtagcttaaatacactgtgcattaggattttatcattgcaaaccaacattagaaaagatttccatcgacttaaaaacaaaaaagacattcttataagtggaaaatcaatcaccacaaccattaaatgtcacagctcaacatcagcaagaagcactgataattgttagttatacactgcacaaatgatgtatgtcct

SEQ ID NO: 37513 - DNA, 601 bp, Human
ttatcaaaagattctataattcaagagaaacattcataacttgtgtgtgaaaatgaaaaccactggcccacagaaatcatgcccacaaaatccaattttgtggatttatggcagaaagacattaaactactgtcttgcaggaactgcagactagtcactgaagcagaagtggcacggtagtaatgattaaggtgacacgtcaccctgccacagctgttaatcagcttaatactagttacattattgacattcttgtaattacttttcctaaggcacatttgtgcaaaatatattttacttyaattatgaccaatcagaagcaagttcaatactcagaaagaataatcaagattgtcttaatgcagttatatagtaagcaaggtgctgttccgatcacctggggctggcgccacagaactctctgcatgaccacatctttgccataccttgccatcctctgaacacacacccatgtgctctccactttcatccaagctaatctgatttatcttcacaggactctaaaaagaaaaagacaaaaagatgtgtaaaacttcaggaaaatatatatcaacaatcaatgtctttgctctttgtaaaa

SEQ ID NO: 37514 - DNA, 601 bp, Human
taggggtcgtccccaggcctctgctgcagcctggctgctcacggaggccctctgtcccccgttccagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcaggtgagctgacaacccgtggggtcaaacctgcatctcgggaggtggtctctgcatctggacggggtgcccgggccagtcccttctctcccctcytctgtgaacgagggaaacagcactcaactcactgggttacagagagaaccaggtggactcctattgatgaaagttcactgtgaactgcaaaggaaaagaaaaacgagcatgcattgagcgcctgctgtgtactgggtcatgcaaggagcacatggagcctctcaacagtcccgtgggtggggattgtcatttcatctctcagatgaggaaaatctcataaccgccagggccccagcatgagtcttgggggagctgaggttcataccatgtccacccatccttgcgcctgcggttgctcca

SEQ ID NO: 37515 - DNA, 601 bp, Human
ttttctcctggccaggcaggagcggcccgcctcatcgctctgcccagcccttggggtcgctgcctacagcctttcctccttgctgcacgcccctcctgcttgtacatggcagtacccggcatagaagtccttccccacagggcagccctgaccctgcctcgcagtggcctatggaccaggcttggctaggggaggagttcattgtggggaccacatccagactgcagcctgtctggctctgcctctgtctctatgtctgtctccctgtttttctctttctcatcctctttccatctctcckctcagcctttttctttggttttgttggtagtggtggtggtggtggtggtggtgggttttttttttattttagaggcaaactctgttgcctggactgtagtgcagtggcatgatcatagctcactgcagcctcaaactcctgggctcaagcaatcctcccgcctcagtctcccgagtagctgggaccacaggcgcatgccaccacacctgatttttattttttatttcttttgtttttttttgagacagagttttgctcttgttgcccaggctggagtgcagtggcacaatctctgctcac

SEQ ID NO: 37516 - DNA, 601 bp, Human
cacccagctaattttcatatttttagtagagacagcgtttcaccatgttgaccagcctggtctcaacctcctgacctcaggtgatccatccacctcagcctcccaaagtgctgggattacaggcgggagccaccgcacccggccccccatgaaacatactggatttgctcggcagtttccagcaaagtgggactgctggtggcagggctgcccgccgaagccacagctgcagaatttcagattagcagttttttctgccacacgctgccctgtgttctcaggccttggccctgctcttggrgacttccaggctggtggggaagcaggtaggaagcagatggtgaccttccagggtgatgcagattgactggtgggccaggagccccagggaaacccgcttcctgggcaggcctcacagagggcagggcaccatcccagaatctggaaggccgaagtgagccttcttccaggcaccgcagcaccgtggattatgggaggttggggagacagaaggctggacatggcagcagagccagatacacactcagaacaaaaggggagcccctgaagtggctgcaagtcggggggccatggctgggtg

SEQ ID NO: 37517 - DNA, 601 bp, Human
ggagtcagtgaggaagcatgtctgacgagctcagggcagcgctggtgtgtggtacgctcgccgcccaaggcagcccagttgtcatggttgccacctctgcccgccaatgccagccgccttcccgaacacgggtcccactccacaggtagcccatgggaagtcaacaggatgtgccagggcacgaggtgcttcctacaaaacaaaaggaaacgtggttttcggaggggtgactgttgacatatcacatcattcatgcaaagaacccaaacccaaaacctctcaagtgcgggggctggtgggstcggcagctgccaagcgtgggacaagaaggtgggtcctgttggaacgcaggcgtgtgttcattcattctgtgcaatttctgatcaccactgaatgctggacaccagggtgcagcccagtggagaagacagatcatagacactctgtgttacatccgggagggcctggagcttgggagcagagcccctgatggcagagattcaaaggacagggacccttactctcagctctccctcccttccctctggccaccaccacagccagacaaagcccaaccacattgcgtctttgcagcaccttc

SEQ ID NO: 37518 - DNA, 601 bp, Human
gaatctcactctgtcacccaaactggagtgcagtggcacaatctcagctcactgcaacctccgcctcccaggttcaagcgattctcctgccccaacctctcgagtagctgtgactacaggcacctgccaccatgcctggctaattttcgtatttttagtagaaatggggttttgccatgttggccaggctggtctcgaactcctgatctcaatgatccgcccacctcagcctcccaaagtgctgggattacaggcgtgagccaccatgtccagcctcctctgctcactttttaatgttttktttttttttattgatttaagttccttatagattctggacattagtcctttgtcagatgcatagtttatgaatgttttctcccattctgtcaattgtctgtttactctgttgatcatttcatttgccatgcagaagctctttcatttaattatgtcccacttgtcagtttttggttttgttgcaatggtttttaaggacttggtcttaaattctttgtcaaggctaacgctgagaaaggtatttcctaggttttcttctaggatttttatagtttgaggtcttacatttaagtcttcaatc

SEQ ID NO: 37519 - DNA, 601 bp, Human
gtttcattcttctgcatatagctagccagttaattgagtagggagtcctttccccattgcttatttttgtcaactttgttgaagatcaggtggttgtaggtatgctgctttatttctgagttctatattctgttccattggtctatgtatctatttttgtaccagtaccatgctgttttggttaccataggcttgtagtatagtttgaagtccagtaacgtgatgcctccaggtttgttctttttgcttaggattgctttgtgtgccgccttctgaagtctagtcaccctgtgtaaattamctacatttgttactgaccaaggttcttccacaggggagcctgctgctaagatggcaacagggctccctcccagccacccctgggaaccaggattgaatgtgctgcacctgcgtcctcagctgtgcagggtgcctggttcctcacagtggtgtctggatattcactgagccacagcgctgctggctgaggggcaggcaggggccagcacacccacctcagggccagaccttggtccagagcaggggtttgaggacttggacaggcagtgggcgccatagcagacagggatcagtctctggg

SEQ ID NO: 37520 - DNA, 601 bp, Human
catagctctgtgcggctgccctgttacacatttcaagagtattgacccatgtcgtcttcacaactatgcttcaaaacattatgccagttttacagatgaggaatctgagacttggggatgcaaagtggctttcccagtgtcacccaggccttcctgactccccagcacaggcctttctttccctgggacccacttctctagcaaatgccagggcctcagtgaccgggtgccagcagggtgccggtggcaggcaggcactgggtctgtcccgtcttcacttggtgcccccttccctctttcyctcctcatgcagcaactgaaccacccaaatatcatcaagtatttggactcgtttatcgaagacaacgagctgaacattgtgctggagttggctgacgcaggggacctctcgcagatgatcaaggtgagcgcctggcggggtgggggtgctgggggctgcgcagatctggagccaaaggtggcagtcttcctttagcccagtcccacaatgctctgcctttagccagaggcggccacccggggaccctgggcgcccccctgcagatgcccacaggcctcagctgcagtctggtgagggcct

SEQ ID NO: 37521 - DNA, 601 bp, Human
tcgtttatcgaagacaacgagctgaacattgtgctggagttggctgacgcaggggacctctcgcagatgatcaaggtgagcgcctggcggggtgggggtgctgggggctgcgcagatctggagccaaaggtggcagtcttcctttagcccagtcccacaatgctctgcctttagccagaggcggccacccggggaccctgggcgcccccctgcagatgcccacaggcctcagctgcagtctggtgagggcctctcagggtccgtccccagctgctgttgctggaggcctctttctttccaytggcctcagggaagctcagctcaaaagagcccatatgcaaaagcaaggcgaaggtggtgccaagacaggatggtggctgggagggggccagccatgggcagaaggaactcctctggccacccccagtgccccagcctaccacaggcacatgagccacttctcctgcctcacagaaggagcaggggcagcaccccgtttggtcagaccccagctcttgggaaagcatcttgtagatccactacctcattttaaagaaggggaaaactgagcccagagaggttaagagacttgcctgaggat

SEQ ID NO: 37522 - DNA, 601 bp, Human
tctcgcagatgatcaaggtgagcgcctggcggggtgggggtgctgggggctgcgcagatctggagccaaaggtggcagtcttcctttagcccagtcccacaatgctctgcctttagccagaggcggccacccggggaccctgggcgcccccctgcagatgcccacaggcctcagctgcagtctggtgagggcctctcagggtccgtccccagctgctgttgctggaggcctctttctttccactggcctcagggaagctcagctcaaaagagcccatatgcaaaagcaaggcgaaggtggygccaagacaggatggtggctgggagggggccagccatgggcagaaggaactcctctggccacccccagtgccccagcctaccacaggcacatgagccacttctcctgcctcacagaaggagcaggggcagcaccccgtttggtcagaccccagctcttgggaaagcatcttgtagatccactacctcattttaaagaaggggaaaactgagcccagagaggttaagagacttgcctgaggatacccagcattgtgggtacagagccatgcctgtggcccaggtctcttttcctggcctgg

SEQ ID NO: 37523 - DNA, 601 bp, Human
aacgcagcccgtggagaggacgcctcaccctctcagccccagtggagcccagacactgtggcctctcagtccacggagtggggctgccgtcagacaggcagatggggggctggggctgggcaaatccctcttccctgaacctcagtttccaccctgtccccgggaacctcttggagggagcattgcaggaaacccaggccaggtgcagtctccctcagctgagagagaagaggagacatgggggcattctatccagcatcccttctctatgccaggcctgggatggggtgtctccttcccygtgcaccccttccttggcttcaccagagccaacactggctcagggttcaagtcagtcatgaacccagcaggattgagtctaggatgggtgtggcctcagtttctgagcagccacctggccccccacgcctcgggtccttcctcctcacctggcatggttccccctcccacagtccccacctctctccccccactgtccctgcctgctcccgttccctccaacccggctcaggggccctcacctgcagagctggctcggtgcagccgccagcaggggaggcctggcagtgcagagacccac

SEQ ID NO: 37524 - DNA, 601 bp, Human
ggagactccatctcaaaaaaaaaaagaagtgggctaaggacttgggctttctaggtgggaggcctggggctgagctgtgtttctgcctctttctacgtggccctcagtttcgtttccctgtctgtaagatgggcctagccctccctcttaggcccggcatggtggccacaccctgcaggtggtctgaaagtgctggcccagctcctttcctccacccatgcccctttccaggccagtgtgtcctggtcagttcccagcttcccagcaccagagcagctgccctgaccagcaggcccacagygccgcctctgcctgctttggggaaaggtggttgctttgaagcaaaaagcccctgcacaaaaagctggtatgcaggtagctggtgaagaagtcctgccccacaggcatgggcctggcacctgagagccacccccgtctctagctgagccgtggctgtcacatgctctgggcctgccctctccaggaccttctgttacttacagctcactcagtgtggccggggacctttagtttttgttttcttcctggagcactaaatatgttttcccaggcagtgaagcagactgatgcccgttggaac

SEQ ID NO: 37525 - DNA, 601 bp, Human
ttttgagtgcgtcaagcccatttcctcaaggttctcgccgcgtttgttaagaattccagtgcactgagatctgctggttccgaggagatgggggcagctgtgatttaaccaccacgtgtgtcctgggtgccaccctcctgggccaggctggggctggggacagggagagtccacacccatttcagtcttgcaaggagtgccctgtggagggggtgtccaggaggttctggaaaaatgcagttgagggccactttcagcatatttgagctgggtgtccatgcagcaaagccatccggacatrccaggcctgcctggccctcacggagcttgctgggttgggacagggtggctgcagagtgccattcaggcagaagtagaggcgtggacacagcactcttggttctgggcttattgtttgctcagtggctcaatcccccccccccgcccctgccaggcaccagttacccactggggaaaggacagaggcagtgccctgtggccacccacctccaagcccgctcacccgggcctatccctctgcttgtctcccccactgcagtactttaagaagcagaagcggctcatcccggagaggacagta

SEQ ID NO: 37526 - DNA, 601 bp, Human
tcaggggcagccccttgaggaagttggaccgctctgtattccccaggcaagggggctgcccagcaaccgcgcacacacacgcgcccgggtcaggaacctccccgaggtggaaagtgacatgagccccagggggcaggggccccgcttggcacaccacttccagttccccacagcagcctgggagggaggtcgaggaagcctcgcacagaggggactttcatgggggctttgccgtctcagcgggctgggctgagaaggggaggcacctgagaggggtgtttccacagttgacatgattccragttgtgagaaaggagcctgctgggtgcccggcagggcacgaggtcctttacgtaggctgcttcatggacacctccgttccttcactctacctgtatctcttggtgtctgctgtattggaggccccgccctcactggggggtacggcactgggtgctccactgagcactccgttcattcattacgcagattttccctgagggcctcctgtgtgcgaggcactgttctaggcatggaggatacagctctagagcaggaaacaggagcacagaaacccctgctgtcttaaccctcacagcag

SEQ ID NO: 37527 - DNA, 601 bp, Human
attccgagttgtgagaaaggagcctgctgggtgcccggcagggcacgaggtcctttacgtaggctgcttcatggacacctccgttccttcactctacctgtatctcttggtgtctgctgtattggaggccccgccctcactggggggtacggcactgggtgctccactgagcactccgttcattcattacgcagattttccctgagggcctcctgtgtgcgaggcactgttctaggcatggaggatacagctctagagcaggaaacaggagcacagaaacccctgctgtcttaaccctcayagcagctctgtcaagttggtggagggagacccatttttcatatgaagaaactgaggctcagaaatggtcaatttcccgaggtcccacagccagagccaggacagggccttgccctgagggagcaggacctgggctaggcctcaccttcctcccccttcctctcgtcctgccccacctaccccaagcctcctaccccacaccaatctccttctcctcgccctgcagacatcaagcctgccaacgtgttcatcacagccacgggcgtcgtgaagctcggtgaccttggtctgggccgcttct

SEQ ID NO: 37528 - DNA, 601 bp, Human
tcttgcagccaccggcaggagggaggcctaagttctccggtgtccaggttggcagccacacaagctccccactgtccctagaccaccaaaggctgggtggctccgggattccatccacctggctgagcccctccgcatctataagatgggaacaggaccacctgtcttgcattgtcctcagtcctgataaatgacagacaggaaagggctctggaaacccccccaggctgttagacaccaagcccggcttggttttacagttggaaccctgactgtttttctgctttccctggagctgacktgagcagatgtggggtctggcttggagctgacacactgaaagaacttcagtctcagctgctgtggccggtgacagtccacagcagtgatgctcaggacagcgtgtccagggcctgcctcgagtgctgcgcagttgtccacagagcctgattgctctgtccccttgggactgtcgactctgaggctgacctcacagcccttgtgcatgaacttgagggctaagctgcccaccgctgggccacgtgggacccgcggccgctctcgtggccagggggtcttgtggccagggtcttttggtggt

SEQ ID NO: 37529 - DNA, 601 bp, Human
tctgagacaggaggaaacctgctggtgtagggccctgtgtgcctgcacattccgaacagccccggggagggtgcgtgcctgttattttgcggagaagacgttaaatccaggtggggaaagccccgggtgtggagagttgttgagtggcgcagagccactgtgctgctggtgtgtgtcccccaggaggagtcgtgagttccagtctctccaggactcctctaaatccaggcaggtggccactctggccaccaaggtcgctgaggctagcagtagagtcacgcccatgtcacctgctaacccrgctgtccctgggctcagggctccagcgtcaccgccctgcccccacttgccctaaggtctgaggaggggatgcaaacccacctgtaagtgggcatcgttcacccggtgtcagatcctgaggggcagagacaggcgttctaggtctcccaaggcccaggctaatgcccgcagcatagtggatggtcggggagcacaattttgaattagagcacgtgtctgtgtgtaggcagctcacttaccaactcactttcatccaaatcccagctccagggcccacccacggaaggatccaggcaagtca

SEQ ID NO: 37530 - DNA, 601 bp, Human
gaggggatgcaaacccacctgtaagtgggcatcgttcacccggtgtcagatcctgaggggcagagacaggcgttctaggtctcccaaggcccaggctaatgcccgcagcatagtggatggtcggggagcacaattttgaattagagcacgtgtctgtgtgtaggcagctcacttaccaactcactttcatccaaatcccagctccagggcccacccacggaaggatccaggcaagtcagcccctcccgggtgggcctcaggtgtcccatatgtagaatgagtggccagcccaccttgtcayagtgaggaaggaatgaggccctaggggtgaggtgcccgagtcagagaaggccctcgggcctgtccaccagctgcaggccaagcacgggcacttctgcccgcctccggcacgaggctcctgcagcttgccacatttccctttttgctttggccagcgggaagccaaagtgcagcccagcctcagtctccgaggaggctccactttgtcctcctttcctcatgtgtcttgtccctgggtcagatggcttttcgtttctttttccattctgctttgtgtttttgtaagctgcttcctgtctcc

SEQ ID NO: 37531 - DNA, 601 bp, Human
gtgccaggcctcactgaattctggctcgggcagtcctcctccgagtcctcatttgtgggcacctaaatgtgcatctcacaaggcagtcccgccttcgtgactccctggcattgaggctcgggttacgccgagctgactcatttgttggagtgagtggggctgtgcggctcgcagctgggggggctggaccacagccggggggcggtgaggggacggatcgcagccggggggtggtacgggggatggatcgcagctggggaggtaccgatcgcagcgaggggtggtgtggggggacagatcrcagccaggggtggataccagtcagcagtaggaagtgaatgaaacacagcagtcaagccctgaggggattagcgtcctcagggacatcaggcgctgacctaaccctagcagccccggcctcacacagcagcaggctgctgtggccacccatagccggcccatccaagggtaacggggcaggggctctgtgccaagtgaccccctccccactcctgcagtccctaaaggggaaggtgaagcaggcgtttccccagcagacagggaggagagccacatctgagcccacggccatgtaattgga

SEQ ID NO: 37532 - DNA, 601 bp, Human
gctgggagcaacaatgcccgagcttgggatatcggaaggccgggctctgttctcgttacctagatgcccatggaggtgcccagcgggctgcccgctctgcaggactgatttttatctatgtgggagctcagctgcaagtacggagctagaggaattggctcattcagtgccagtcccaggatcctcatagggggcctcctcgcagcagccttgaggtgcccagctgggactgagacccagcgagacagcggactcaaggggaagatctgcggagccttggccgggacgccgctttggaatsctgcttggacggcagagaggcctggacgcccctccgtggtggaggagcagggctgcagacctcctggcctccagtcacccttctgtctgggatgtgctcgagagacactgggtgacaagatgggtgtctgaggccctgacaggcaggagtcagattccccttgtccctctgacatctcagatcacacaccagcttctctgagccctcctggtgggggccagggcccacccacccccttttcctcggctatatgtcaccctgatgacaccagagagaagggcttggcatttgaggagcagc

SEQ ID NO: 37533 - DNA, 601 bp, Human
ttcccagcagcgaggtttataaaattgagatcaaatgggcatgatctgaagttgaagatcggctgattcctctccggggtcagccacatgaaaaaccagggcctgcgttcacaggaccaacactcaaaatgtcccttctacgctgcacagtaacagtccaggaaaatccaccttaatcctccagctgcaactcgggggcacccagatcaccccaggtgaccgtcctggagtctcagctgctctctgttatggcaacagatgtcctttgaaaatgcccgattaaccctttgcacccgagagwctcattttaattcctggacatgcgtcacctgggtggtgcatttggcaggctcccagcccgctcctggtcaggtcagcagaccccaaaatgggcagggcctctgcatcctcacacttcccctgcctggccagaccctccctgcagccctcctccaagggtgggtttcaggctccacatgggttcccagcccttctctgaggggcccaagctcccagccagccggaagacagaggtgatgctgtccctaaacacccacctgaaggcacttggcctggcctgggctcctggtcccgagggtgc

SEQ ID NO: 37534 - DNA, 601 bp, Human
gagcagtgtgactaccccccactccccggggagcactactccgagaaggtgagtttgcaggagccggaggcctcgccagccccaggaggccaccgaggcttatgagggccgctccaaaacaccacagctgtggggctgaggttaggctcactttacacggtgcagaaagggagctttctggaaaagtgacttggagaggggaaagtaggtgattgcactgaagaaggggtttcaccacgcagctccagtgtgggacccccaggtaggaaccagtggcacgtggcccttggcacatctccayctgttcagctcccaacttggtgctccagtgggaggccctctgctgcaggtccccaggacagggtctgtgccgtgccagacatgggaactgatacaggggcaggatgtggcaggcctggcgtccccataccaccagtggtggccactctgctcccatgacaggaaactacggcaggaggaccggtcagtttcctccttatataacagacttaacaccctgggcttctactgtcaacattttacactggctgcgggagccgtggacacagctcccatgggtctggcatggggctgtaccagt

SEQ ID NO: 37535 - DNA, 601 bp, Human
gagggccgctccaaaacaccacagctgtggggctgaggttaggctcactttacacggtgcagaaagggagctttctggaaaagtgacttggagaggggaaagtaggtgattgcactgaagaaggggtttcaccacgcagctccagtgtgggacccccaggtaggaaccagtggcacgtggcccttggcacatctccacctgttcagctcccaacttggtgctccagtgggaggccctctgctgcaggtccccaggacagggtctgtgccgtgccagacatgggaactgatacaggggcagratgtggcaggcctggcgtccccataccaccagtggtggccactctgctcccatgacaggaaactacggcaggaggaccggtcagtttcctccttatataacagacttaacaccctgggcttctactgtcaacattttacactggctgcgggagccgtggacacagctcccatgggtctggcatggggctgtaccagttactaggaatgtgtgaatatcttattcctcggctccgtcaccttgaagatgggactaataatctccttggtggataatggtgaggaagaaaggacaggtttcc

SEQ ID NO: 37536 - DNA, 601 bp, Human
ccaagtcagccctttcctggccacgagcccccactccccggagcactggctctcgccgggccccatgcttaggagtgagaggtggtgctcaggagcccccagcacaccctattttaaagttatatcgctgcttagaaatgaaaataagacacttttattatttttctcttgaattctgaaaacttcaaacatgcacttattgacaactgtgcgtttacttcataaattagttcgggtcacagacacttcacctgaatctggttttcttgggtattttaacctgtcagaggccaaccacagrtaccttcccccgaatattgtaaggttcagaaaacagctgtcttgtccacaggcgacttcagactccgggagtggcctagcaggctgcaggccctgtgtcacctgggcttctcggttgtaaggcatgcacgcaggtgcgaggggataccctaaggctctgtggcccagggagaaaatgccccatcagctgagaggagccctagtctacaggaagcccaggccccatccctcagcctaacgggcctgcgcagcagtagcccccgggcctccagaacgtcccgtgggcccttcccagtccctg

SEQ ID NO: 37537 - DNA, 601 bp, Human
gatgcagggtaagatgtaggcattttaaggtcattattttaattaccattaaaataattggcactccggctatcagaagaatggaggcgatcagaggcgcaaggcgcccctcccccacctcggggcgggagcagccttcagtgtctgtataattaaaagctccgtctttcatgagcacaataaaggggccgggggtgggcagactgcagccctgctgcatgttaatgcgtttattatgatcaataagcccttgccttgagttttgtcctctggtttgggcatctgcgtgactgacagcagccacacacacacacacacacacacacaatttgcccaatggtgtggacagctacaagttcaaaataatttggaggttaaccattcttagggtctcaaagcacagcctttgggactagacaggcctgggaggggtactggctagcccttgggagccatgcggctgcgcaccccttacttgccccagctaaacaccgttcttcagctctaacggggacaacgggaccatctagttgctctgaggatgaagtgccttcatgcagacagactgtggagtgcggagcctcagtaagactgctttctt

SEQ ID NO: 37538 - DNA, 601 bp, Human
agccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttrgtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattt

SEQ ID NO: 37539 - DNA, 601 bp, Human
tccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttcygtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaact

SEQ ID NO: 37540 - DNA, 601 bp, Human
ctgaaggaaacctctcctccagcacaacctaaactcttggaaagtcacatgctactcatcagtaatttccactgtgtgcttgttctcttaataatagcattttccacaaatgtgtacattatttacatagacaagttgcataatggaaacactggctgcactgcatttgtcacccattctaatctattcagttcatgttttctttctccctttttgtgatcatctatattcttatcacgtttcttattttagccattcttctgcatctgaaccttattttccaccatgctataatgcattmaatacacaacttcacagtctgcaattgatgatgttcctcaatggtgatcaaattttctgacacacatggagtctggctttggaggagtaggtggcatctttccatactttgcaagacaggcccttcgcacagtcgcaacgctggaaaatttccagcccatgagaacccttcttgcgttgtttggtacagacttccccctgatggagcactggtttgcagattttggtccagaaatgacgagcacagcaaaacccttcaatgcagtctgatgatcgtaggcaggggtctccttcatgccct

SEQ ID NO: 37541 - DNA, 601 bp, Human
aataaataatttgaggatagtacggacacaggacctcacactgaattcatctgcatagtaaatattatgatagcaaatcccatgcagatattcatttagactgtgcatcccctggtttcaaagatgaacagccaacttgtgcctcagacatatgatctatgtgttgccaaaacctgaacaaacgaaaaagttttcccaattttcttgcttactccagtgcagtacagatccagcttaagtctctattaccacagagtatgtatgaatacatgtatttaccaatctaattctatcaaaatayaggttatggccaatctttaagaaataatgatctctctgttagctcttttcccacatatattggacatctttaaatttttttgccatctgtgaaaattctgctctgtgtaagtattttactagtcacaatttatgggtatagtttggaaaatataatgcattcagagcaggaatcacataggataaagagagatatactgtcattccgtagaatctgaaggaactgtttttgtcttgtatcagttcttattaattacaggtaaaactaaaattttgaaaaaaaagtatttgtggctgtttg

SEQ ID NO: 37542 - DNA, 601 bp, Human
acttcaggagtccattttgtgaaacctcctgaaattgagattatttgaggatctcagcactataaaataaataatttgaggatagtacggacacaggacctcacactgaattcatctgcatagtaaatattatgatagcaaatcccatgcagatattcatttagactgtgcatcccctggtttcaaagatgaacagccaacttgtgcctcagacatatgatctatgtgttgccaaaacctgaacaaacgaaaaagttttcccaattttcttgcttactccagtgcagtacagatccagctyaagtctctattaccacagagtatgtatgaatacatgtatttaccaatctaattctatcaaaatataggttatggccaatctttaagaaataatgatctctctgttagctcttttcccacatatattggacatctttaaatttttttgccatctgtgaaaattctgctctgtgtaagtattttactagtcacaatttatgggtatagtttggaaaatataatgcattcagagcaggaatcacataggataaagagagatatactgtcattccgtagaatctgaaggaactgtttttgtctt

SEQ ID NO: 37543 - DNA, 601 bp, Human
taaatatatgtgggaagttgaaatttttaatagatatacaggctcaaactcaatctctactgggagaacttaaatttgagactgcagatgggatttaagtaaaagaaaactaaaaagtgaattgtggtctacaaaagtttaaagtcacgactataagataaccttttattgttttgtgctccagacaaagtatttagaactgagttaagtttaaaaaaagtagtaaagtggtttcaaagaatttagaaactgtggtgtctatagattagcaatatgcaggttttacaagttatcctacttrtattttttaaccgcaatggctgcagaaaaccgaaactagccctttggcaataaagcagatgctgcagaggtttgggaagaaaattggatgatgccattggctagtcagaagcttatagagggcaatgaaacctcactactctgtctacttcaggagtccattttgtgaaacctcctgaaattgagattatttgaggatctcagcactataaaataaataatttgaggatagtacggacacaggacctcacactgaattcatctgcatagtaaatattatgatagcaaatcccatgcagat

SEQ ID NO: 37544 - DNA, 601 bp, Human
gttatataggaaatgtttgattgaaatgttccattttcatttcaccaagcttatagcaacctgtttatacaaactttggttcttggatggactagtttataatttttgtttttgcagacctgtgcagaaaatgtaagtcttaatcatcttagtaaatatatgtgggaagttgaaatttttaatagatatacaggctcaaactcaatctctactgggagaacttaaatttgagactgcagatgggatttaagtaaaagaaaactaaaaagtgaattgtggtctacaaaagtttaaagtcacractataagataaccttttattgttttgtgctccagacaaagtatttagaactgagttaagtttaaaaaaagtagtaaagtggtttcaaagaatttagaaactgtggtgtctatagattagcaatatgcaggttttacaagttatcctacttatattttttaaccgcaatggctgcagaaaaccgaaactagccctttggcaataaagcagatgctgcagaggtttgggaagaaaattggatgatgccattggctagtcagaagcttatagagggcaatgaaacctcactactctgtctac

SEQ ID NO: 37545 - DNA, 601 bp, Human
gagtcgctgctgaagtctttcactggttttagttatctgaatttttttttcaaagacaaaactgactttattcttttttgaaaatatggtaaatttttttaattcaaacaatcaaacaattcagaaagtataatcaaaagagaaacaaatcatcctaaaacccattaccctggaacatttggtgtgtatgattctggatatctcattgtgcttctgtataaacagaaggacgatatgatagcagaatagatggacaaaaattagattataccatacatatggttttaataaaagtagtcarttcaatgtgccttgaactttgatagaaaaaagaaattgaagtgagattaaagaaactacagaagtgcaaatgtttgtcaccacaagacatatttgttcctaaaagagcttttaaattaagaaaatggtttgtgaaaaatattgagaggttaattattaaaataataaaatattgtcattttagatgacatttaatggcttctggctatgaaaatcagtacacttatagttcccccccccttttccaccttatattattgtttaaattcaaattatttctaagaaacttctataattacat

SEQ ID NO: 37546 - DNA, 601 bp, Human
tagtcagatcttactgatcaacttctccatccaagtgatcactgttacttaagggctttcaatttttttttttgaccatgatccacagggaaaagaaaaatacattttatattgtgattcagctcacaaaatataaaactatctaacatattaaaacaaaaattgtacaagaaaatatttaaactttaccacatgccttgcattcagttatttttcattccagtccattccacaccattccattcctttccattaaaaataatatccctcaacattcatttcatgagtcatcaaagagtcytgaattgtggcttgaagactattgccattgcctatgtggcccctccctcctcaaacttcctcactctgccaaaggcaaggcagcttcccatgacagatgctgatgcaggagaaaaggctctttacaagattttcaacaaaataaatgaatgatgaccagaatcactcagcaaatattccagtaatgacactcacgcatggcaaacagccatatggggccctcagtggtctctgatttacaagctttatctcactaattatcataacaaccctagggggtaggtactcttattttcatccc

SEQ ID NO: 37547 - DNA, 601 bp, Human
agcaagaaatattaggagataggacttggtgatagaaaacatgtaacagattagggaaatgaaggtgttaaggatgctgtctctttctgtctggggcagatgggtggaatggtggtgatatttactacgaaaaagagcactgagacagaacagatttgggaaatggatggggaggcagagcaggaggggaagataagatgttcacttttgatgccttgagcctgagtatgttagagatatcccactgcagatgcccagtgggcaatgggtctcaggagagacatgtgtgtgggaggtaggrattttggagtcaatgtcatcaaactgctcattgatggcacaagcatgaatgaatgatccatggaaacaaaataaagtctaggataaaatttcaggagcgtcaagatttaaaggttggatagaaagaagacctggaaatagcaactaaagagggatgagaaaaaaatatcataaaggtcaagggaagagtgcgtcttgagaaagaggatatgtccatgtattgccaaagcttaaggatattttctcttttcagaatatggcaacagatttctgaaagtaaatgtttcccatttcctaagta

SEQ ID NO: 37548 - DNA, 601 bp, Human
actttgacgttctcatagcatataaaaatctaagtatcaatgattctagggaaaatacatgaggctggagtgcatacagaaatctgcatttttgataattatagtgatgatgataatattgactagattggtcatactgattttccttttctttattaaaaacacaacccccatagcaaatagggaggtggcaatattttcagcccttttcaggtgggagagactgaagtgtagagttcaggtaacatgtgataagccagtgaaagggacaggggaggcagtttgggaaaggtgatgggtyacaagtggcagcctagggaacagctgagaggacactacagtggtccaggggaagatgtaggtcgcttggacaaggacaggggcagtaggataaataaggacaggacaaaagcaagaaatattaggagataggacttggtgatagaaaacatgtaacagattagggaaatgaaggtgttaaggatgctgtctctttctgtctggggcagatgggtggaatggtggtgatatttactacgaaaaagagcactgagacagaacagatttgggaaatggatggggaggcagagcaggaggggaa

SEQ ID NO: 37549 - DNA, 601 bp, Human
agcctgtcctaattgaaaaaagtcataacaatgactgatagcatttagtatacactaacccatgtttattacaacaaacctaataaactataattgtattttagggatgggggacgagagagcagaaatatgttttaaagaatagttccaatagaggtaatactgattattcagaaagcaggtcctcacaccagtgtgttggaaagatatctctggtggtctaacagctgggatagcacgggttcagaaccagaaatagagccttattattccgttaatttttctttctttttttttttttgagacagggtttcactctgttgcccaggctggagtgcagtggcacaatcacggctcactgtagccttgacttccccaggctcaggtgatcctcccatctcagcttcccaagtagcttggactaaaggtgtgtgccaccatgcctggctaagtttcgtatttttagtagagatggggtttcaccatgatgcccaggctggtcttgaactcctgggctcaagtgattctcctgccttggcctcccaaagtgctgttattataggcgtgatccattgcacttggccacttttttcatattagt

SEQ ID NO: 37550 - DNA, 601 bp, Human
gccctgcttgtagcctataactcagtccaaccctcttaatacaatccctggtccctggattgagcctgtcctaattgaaaaaagtcataacaatgactgatagcatttagtatacactaacccatgtttattacaacaaacctaataaactataattgtattttagggatgggggacgagagagcagaaatatgttttaaagaatagttccaatagaggtaatactgattattcagaaagcaggtcctcacaccagtgtgttggaaagatatctctggtggtctaacagctgggatagcaygggttcagaaccagaaatagagccttattattccgttaatttttctttctttttttttttttgagacagggtttcactctgttgcccaggctggagtgcagtggcacaatcacggctcactgtagccttgacttccccaggctcaggtgatcctcccatctcagcttcccaagtagcttggactaaaggtgtgtgccaccatgcctggctaagtttcgtatttttagtagagatggggtttcaccatgatgcccaggctggtcttgaactcctgggctcaagtgattctcctgccttggc

SEQ ID NO: 37551 - DNA, 601 bp, Human
ttgttgttgttgtttttaatgggagtctaacatttcaatcagcaggtttttgagtaaagcagattactacctataatgtgggtgagtctcatccaatcaattgaagactttcataaaaaatgtcttgatgaccctaaggaacagggaattctgccaggagtctacctttgggtgcgaactgcaaacatcaactcttccgtgggtctccagcctgcctatcctataaattcggacttgccagcctctacgatcctgtgagccaacgccttaaaataaatcaatatttctaaacaaataaatrtatcgatatgtgcatctatatgtattctattggtcctgtttctctggagaatcctgactgatacagctgtaggaaaaagagcagcttcagcacaaatgacaaaagtccgagtgtgctccttacacactaacaaaaccagcaggagtgtgaccggagcattctaatccaggagaatgttggatgctcttgatgcttgggcccaagagaaagcagcaaagtcactatctggttaactatccagttgaaagcgaaacagatgtgtcatggctgatgagggtggtcaacaagagccggtgggaa

SEQ ID NO: 37552 - DNA, 601 bp, Human
ctcccttcccgggcctgctgtgctgtaggctcatgatgagtaaaagtccgcagaggaaatgaaaagacctgggaaatcgttttaataaaagcagccctggcccacaccattaatcaggccatatagctgatgactagagctcattgtgactagctcatacttgttaagccactgtggtatacttggaagttgtgatggtacattttacatgtccagttggctaggccacagtatgcagatatttggctaaacattattctagagccttctgtgaaggtttttgttgttgttgttgttgttktttttaatgggagtctaacatttcaatcagcaggtttttgagtaaagcagattactacctataatgtgggtgagtctcatccaatcaattgaagactttcataaaaaatgtcttgatgaccctaaggaacagggaattctgccaggagtctacctttgggtgcgaactgcaaacatcaactcttccgtgggtctccagcctgcctatcctataaattcggacttgccagcctctacgatcctgtgagccaacgccttaaaataaatcaatatttctaaacaaataaatgtatcgatatgt

SEQ ID NO: 37553 - DNA, 601 bp, Human
ctgcactacggatcctaactcctactcacctctcatagccaagccctggcatgagagctgagcccctgtgtagggttttggggccctccttgtacccccagaattcccagcgcctgctctcatcttagccttcatgtgttattttgaaattctagtcctcgactaggcttgaacttctagaagggcagggcagggatcatgattgaatttatctgtgggaccttgtataatctggtggttaaatagaacatcttttcaaagctaaggaaaatgttctgttagtcagctaatccagaaagcktttttttttttttttttttttttgagacagagcctcagagcctcactctgtcacccaggctggagtgtagtggcacagtctcagcttgccgcaatcttggtctcccgggttcaagtgactctcctgtctcagcctcccgagtagctgggattataggcatgcattaccacatccagctaatttttgcatttttagtagagatggggtttcacactgttggccaggctggtcttgaacttctgacctcaagtgatccaactgcctcggccacccaaagtgctgggattacaggcgtgagcc

SEQ ID NO: 37554 - DNA, 601 bp, Human
caactctgaaacctgaatgcaggcagaatcatagaaaaacttataaactgaactaacaggaaacaaggtatgttatcatgtacacgtgaacacatcttttaatagttctcaagaaaatggttttgattgttaaaaatatgctcagcccttcagaacccttcagcacattgtcccacctctgtgggtttaattctttcttctttcttgcttcttcttactgtgaaggattaagtcatggccatgttcctcctaagtgtgtttccattccatgtctttctctctagactgatatcccactctygcctgttagacttgaatcttctctcccctggacaaagctacagttccctaggtgcttttcttgtttctagtcttactccgctctaagttttcctggaactaatatctggttggatctaaaccttgatactgactatgatgctcctaacctaaaaccctatggagatttctctttgccagtagaatgaggcctagctccttagaacagcaccccagctctccccttacttggacccactgcctactctccagtctcatcttcttctctagctcctcatctggagcctccttgtttaggggt

SEQ ID NO: 37555 - DNA, 601 bp, Human
gagacattaaaaacagctgttaggtagaatatcttgtcaccagacagttttaaagacctactcttaccaactcatgtaaatgaaagttatgcttgcaatatacagaaaacctcactcactgggaggcaagagacccaagacacacaaaagatagttggaagcgagaagtgattcgctgggtgggtatttctccagtccagggctggggctggggcgttggtgccccctcttctaactggcagaggagttgcttcatttcttgaccttttttacattctgtaaagtcagaatctcagccacwtgaagagtagcaaagactgggtgtggcagagtttgtgacactgttttatttatagtttgctatgcacttgttaataagctgtggttacctgggctacctgccctgtttttggatatacttgaaatgcagacaggcatgagaactggatgtagaaaaggagggaaatatatgagcagggatggtttttaccccttacaccattcttatcatgctataatagagccaaaaaaggaaattcatctgccagtttacggtagacagagaaactctaaatcatgtcaaggaagctcagatgagatt

SEQ ID NO: 37556 - DNA, 601 bp, Human
cagaactatcatcaatcactttatttttcttttgctcttaataacaatttattctttctcactcttgaactacttttacagttagtgtaatacatctgttcttcaaaaccagcagaatcgtttctataaagattgagaataacagaacactctgattaatataattactccctaaattaaaccattagatctgaaactgtttgcatttgcggataatcacgaaaggtcatgaccccagaatccatctctcctaccagggttgtctgcctgtaccaataatatcaataaggaaatatgggtsatatctcttctcatgaaagagcatcaatggattatgagttcatgactaaaacaaatatatattaaggcaaaccatatgaagttactgcttgtcagattaaaaacagccaaatatccacaattatatatggttcaacttaatagattttgtcccattttaaagcagcgtgactgaagaatttaattttcttaacaagtggtaaaggagatgggaacagttactggaaatgaactagaaagctattgttttatggcatagtttagttcctacagtaaatttcatcaaattttaataaactct

SEQ ID NO: 37557 - DNA, 601 bp, Human
agagaatattttgtgaatggaattaataagcagaactatcatcaatcactttatttttcttttgctcttaataacaatttattctttctcactcttgaactacttttacagttagtgtaatacatctgttcttcaaaaccagcagaatcgtttctataaagattgagaataacagaacactctgattaatataattactccctaaattaaaccattagatctgaaactgtttgcatttgcggataatcacgaaaggtcatgaccccagaatccatctctcctaccagggttgtctgcctgyaccaataatatcaataaggaaatatgggtgatatctcttctcatgaaagagcatcaatggattatgagttcatgactaaaacaaatatatattaaggcaaaccatatgaagttactgcttgtcagattaaaaacagccaaatatccacaattatatatggttcaacttaatagattttgtcccattttaaagcagcgtgactgaagaatttaattttcttaacaagtggtaaaggagatgggaacagttactggaaatgaactagaaagctattgttttatggcatagtttagttcctac

SEQ ID NO: 37558 - DNA, 601 bp, Human
cctccctgccaggccgtgcacaccacgccatggggccccgcacaaggcttctgcccgagccttggtttccccacccttcagacaaaaggagggacgaacagctggggcccggggaccctccttcgacagtcaggggcaggggcggtggggagcgggttcttttagacagaaccatggagacagcccaggctgccgggagcacctccttcccgactctagggctggcgtccaaacatccaccaggggctgcccgggcctccctcggtagtgccttagacagaccccagcatgggggacggargctgcttgcccaggcttggaaagggctcggggcctgggcccgtgtggtacaggagggggtgagggcccgcgccacagtctacgctggccgttccctatgcggtactgccacctgccggccgtgtgctggctctgcccgctccctgctcttcctccagctcgagtcctgtcctcccagagctctgcccgctgcccaaacccttctgagcccctgcctccaggcccccagcggtcgtggtgctgggagctggacgtgcacctgggcctcctccagaatgcggcggtgcaggacgcggcccag

SEQ ID NO: 37559 - DNA, 601 bp, Human
gaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaatggtgcccgggccagcggggcttccgcagagcagagccagaccctctgcctgtgtccccagagtttgatgagactttgtgttttcaattctaaagagtgctcagttgaccrggcacagtggctcatgcctgtaatcccagcactttgggaggccaaagcaggcagatcacctgagatcaggagttcaagaccagcctggccaacatggtgcaaccccgtctctactgggaaaaaaaaaaaaaaaaaaagagccgggcatggtggcacatgcctataatcccagctacccgggaggctgaggcaggagaattgttggaacctgggaggtggaggctgcagtgagccgagattgcactcctgcactccagcctgggggatgggggacagagtgagattctgcctcaaaaaaaa

SEQ ID NO: 37560 - DNA, 601 bp, Human
gaagaagtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaatggtgcccgggccagcggggcttccgcagagcagagccagaccctctgcctgtgtccccagagtttgaygagactttgtgttttcaattctaaagagtgctcagttgaccgggcacagtggctcatgcctgtaatcccagcactttgggaggccaaagcaggcagatcacctgagatcaggagttcaagaccagcctggccaacatggtgcaaccccgtctctactgggaaaaaaaaaaaaaaaaaaagagccgggcatggtggcacatgcctataatcccagctacccgggaggctgaggcaggagaattgttggaacctgggaggtggaggctgcagtgagccgagattgcactcctgcactccagc

SEQ ID NO: 37561 - DNA, 601 bp, Human
tcagcaaactgaagaagtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaatggtgcccgggccagcggggcttccgcagagcagagccagaccctctgcctgtgtcccyagagtttgatgagactttgtgttttcaattctaaagagtgctcagttgaccgggcacagtggctcatgcctgtaatcccagcactttgggaggccaaagcaggcagatcacctgagatcaggagttcaagaccagcctggccaacatggtgcaaccccgtctctactgggaaaaaaaaaaaaaaaaaaagagccgggcatggtggcacatgcctataatcccagctacccgggaggctgaggcaggagaattgttggaacctgggaggtggaggctgcagtgagccgagattgcactcct

SEQ ID NO: 37562 - DNA, 601 bp, Human
gaccatcgagggagctctgctgggtgggctgcgcctgaccactcagcaaactgaagaagtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaatggtgcccgggccagcrgggcttccgcagagcagagccagaccctctgcctgtgtccccagagtttgatgagactttgtgttttcaattctaaagagtgctcagttgaccgggcacagtggctcatgcctgtaatcccagcactttgggaggccaaagcaggcagatcacctgagatcaggagttcaagaccagcctggccaacatggtgcaaccccgtctctactgggaaaaaaaaaaaaaaaaaaagagccgggcatggtggcacatgcctataatcccagctacccgggaggctgaggcaggagaattgttgga

SEQ ID NO: 37563 - DNA, 601 bp, Human
gcagaggcagcatctcgaccatcgagggagctctgctgggtgggctgcgcctgaccactcagcaaactgaagaagtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaayggtgcccgggccagcggggcttccgcagagcagagccagaccctctgcctgtgtccccagagtttgatgagactttgtgttttcaattctaaagagtgctcagttgaccgggcacagtggctcatgcctgtaatcccagcactttgggaggccaaagcaggcagatcacctgagatcaggagttcaagaccagcctggccaacatggtgcaaccccgtctctactgggaaaaaaaaaaaaaaaaaaagagccgggcatggtggcacatgcctataatcccagctacccgggaggctgagg

SEQ ID NO: 37564 - DNA, 601 bp, Human
acagcccctgccatatgagggccgagggctccaatgctaacctacactacccagcacgcgcactttgtggcaacagctggcatatggctgttaaaacacaaagtgacgtggaagaaacggagcacccagccctacaggtgcactgccacactgcacgcgctcatgctgagcatggcagaggcagcatctcgaccatcgagggagctctgctgggtgggctgcgcctgaccactcagcaaactgaagaagtacaggagggagtcttcaggtttctcccccaaacagaagctggaaatgagaygtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaatggtgcccgggccagcggggcttccgcagagcagagccagaccctctgcctgtgtccccagagtttgatgagactttgtgttttcaattctaaagagtgctcagttgaccgggcacagtggctcatg

SEQ ID NO: 37565 - DNA, 601 bp, Human
cttccgaataaagtgtgggcttcgtctgggccacgtgacacaggctgcttattacagcccctgccatatgagggccgagggctccaatgctaacctacactacccagcacgcgcactttgtggcaacagctggcatatggctgttaaaacacaaagtgacgtggaagaaacggagcacccagccctacaggtgcactgccacactgcacgcgctcatgctgagcatggcagaggcagcatctcgaccatcgagggagctctgctgggtgggctgcgcctgaccactcagcaaactgaagargtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaatggtgcccgggccagcggggcttccgcagagcagagccagaccctctgcctgtgtccccagagtttgatgagac

SEQ ID NO: 37566 - DNA, 601 bp, Human
tgcctgtggacagggcacccgtgaggcctgaggaccctccgcctggggtgaccacccggatctcaggctctcaggccaccacattttctggccaaaagctggctcttccgaataaagtgtgggcttcgtctgggccacgtgacacaggctgcttattacagcccctgccatatgagggccgagggctccaatgctaacctacactacccagcacgcgcactttgtggcaacagctggcatatggctgttaaaacacaaagtgacgtggaagaaacggagcacccagccctacaggtgcacygccacactgcacgcgctcatgctgagcatggcagaggcagcatctcgaccatcgagggagctctgctgggtgggctgcgcctgaccactcagcaaactgaagaagtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattg

SEQ ID NO: 37567 - DNA, 601 bp, Human
gatgctgccagtgcctgtggacagggcacccgtgaggcctgaggaccctccgcctggggtgaccacccggatctcaggctctcaggccaccacattttctggccaaaagctggctcttccgaataaagtgtgggcttcgtctgggccacgtgacacaggctgcttattacagcccctgccatatgagggccgagggctccaatgctaacctacactacccagcacgcgcactttgtggcaacagctggcatatggctgttaaaacacaaagtgacgtggaagaaacggagcacccagcccyacaggtgcactgccacactgcacgcgctcatgctgagcatggcagaggcagcatctcgaccatcgagggagctctgctgggtgggctgcgcctgaccactcagcaaactgaagaagtacaggagggagtcttcaggtttctcccccaaacagaagctggaaatgagacgtctatatgtgaagcccccagagaggcctggacctgcccctgtcttctgtgagggagtgaactgcctggaggtgccttagaatcacccacagggaactgggctcgcaggcgggcccctgactttgaaaggtg

SEQ ID NO: 37568 - DNA, 601 bp, Human
tcagccaggcccctacctccaaggtgttgggatcaccattgaccagcaagcagaggacagggatctcgatgctgccagtgcctgtggacagggcacccgtgaggcctgaggaccctccgcctggggtgaccacccggatctcaggctctcaggccaccacattttctggccaaaagctggctcttccgaataaagtgtgggcttcgtctgggccacgtgacacaggctgcttattacagcccctgccatatgagggccgagggctccaatgctaacctacactacccagcacgcgcacttygtggcaacagctggcatatggctgttaaaacacaaagtgacgtggaagaaacggagcacccagccctacaggtgcactgccacactgcacgcgctcatgctgagcatggcagaggcagcatctcgaccatcgagggagctctgctgggtgggctgcgcctgaccactcagcaaactgaagaagtacaggagggagtcttcaggtttctcccccaaacagaagctggaaatgagacgtctatatgtgaagcccccagagaggcctggacctgcccctgtcttctgtgagggagtgaactgc

SEQ ID NO: 37569 - DNA, 601 bp, Human
ccctggagatcctctgagacggggagggaggggagagcggaccccagattagcccgacgacatctggatgcaggtgtcaggggtgcccccatcccttcagccctgtcccaggggtgcccagaacccaccgcacccctccacaaggcttcggccagccagggggcctcagccaggcccctacctccaaggtgttgggatcaccattgaccagcaagcagaggacagggatctcgatgctgccagtgcctgtggacagggcacccgtgaggcctgaggaccctccgcctggggtgaccacccrgatctcaggctctcaggccaccacattttctggccaaaagctggctcttccgaataaagtgtgggcttcgtctgggccacgtgacacaggctgcttattacagcccctgccatatgagggccgagggctccaatgctaacctacactacccagcacgcgcactttgtggcaacagctggcatatggctgttaaaacacaaagtgacgtggaagaaacggagcacccagccctacaggtgcactgccacactgcacgcgctcatgctgagcatggcagaggcagcatctcgaccatcgagg

SEQ ID NO: 37570 - DNA, 601 bp, Human
tcggccaccttgggcaccaggaggtggggctggttcactagggcagcaagcacatcggcgatgccccccgagcctgccaggatcagccacggggcagcctgctccacggccctggagatcctctgagacggggagggaggggagagcggaccccagattagcccgacgacatctggatgcaggtgtcaggggtgcccccatcccttcagccctgtcccaggggtgcccagaacccaccgcacccctccacaaggcttcggccagccagggggcctcagccaggcccctacctccaaggtgytgggatcaccattgaccagcaagcagaggacagggatctcgatgctgccagtgcctgtggacagggcacccgtgaggcctgaggaccctccgcctggggtgaccacccggatctcaggctctcaggccaccacattttctggccaaaagctggctcttccgaataaagtgtgggcttcgtctgggccacgtgacacaggctgcttattacagcccctgccatatgagggccgagggctccaatgctaacctacactacccagcacgcgcactttgtggcaacagctggcatatggctgtt

SEQ ID NO: 37571 - DNA, 601 bp, Human
cccccggaggaggggtcgggaggacaggggagggggcagcacataccagcttggtccagcgcacgatgtcctcccaagagaaatgcttgctggggaacttctccttaaactgcttctcggccaccttgggcaccaggaggtggggctggttcactagggcagcaagcacatcggcgatgccccccgagcctgccaggatcagccacggggcagcctgctccacggccctggagatcctctgagacggggagggaggggagagcggaccccagattagcccgacgacatctggatgcaggtktcaggggtgcccccatcccttcagccctgtcccaggggtgcccagaacccaccgcacccctccacaaggcttcggccagccagggggcctcagccaggcccctacctccaaggtgttgggatcaccattgaccagcaagcagaggacagggatctcgatgctgccagtgcctgtggacagggcacccgtgaggcctgaggaccctccgcctggggtgaccacccggatctcaggctctcaggccaccacattttctggccaaaagctggctcttccgaataaagtgtgggcttcgtctgg

SEQ ID NO: 37572 - DNA, 601 bp, Human
tgcaggaactctcccagaggaccagccccacccccggaggaggggtcgggaggacaggggagggggcagcacataccagcttggtccagcgcacgatgtcctcccaagagaaatgcttgctggggaacttctccttaaactgcttctcggccaccttgggcaccaggaggtggggctggttcactagggcagcaagcacatcggcgatgccccccgagcctgccaggatcagccacggggcagcctgctccacggccctggagatcctctgagacggggagggaggggagagcggaccccwgattagcccgacgacatctggatgcaggtgtcaggggtgcccccatcccttcagccctgtcccaggggtgcccagaacccaccgcacccctccacaaggcttcggccagccagggggcctcagccaggcccctacctccaaggtgttgggatcaccattgaccagcaagcagaggacagggatctcgatgctgccagtgcctgtggacagggcacccgtgaggcctgaggaccctccgcctggggtgaccacccggatctcaggctctcaggccaccacattttctggccaaaagctggc

SEQ ID NO: 37573 - DNA, 601 bp, Human
ctgctccctgtgggcctgaagcgagagtgggtggggggcccagcagcctgaggtgggaggagtgggctggaggctgcattgcaggaactctcccagaggaccagccccacccccggaggaggggtcgggaggacaggggagggggcagcacataccagcttggtccagcgcacgatgtcctcccaagagaaatgcttgctggggaacttctccttaaactgcttctcggccaccttgggcaccaggaggtggggctggttcactagggcagcaagcacatcggcgatgccccccgagcctrccaggatcagccacggggcagcctgctccacggccctggagatcctctgagacggggagggaggggagagcggaccccagattagcccgacgacatctggatgcaggtgtcaggggtgcccccatcccttcagccctgtcccaggggtgcccagaacccaccgcacccctccacaaggcttcggccagccagggggcctcagccaggcccctacctccaaggtgttgggatcaccattgaccagcaagcagaggacagggatctcgatgctgccagtgcctgtggacagggcacccgtga

SEQ ID NO: 37574 - DNA, 601 bp, Human
aagcatggaatggcatacgcttcaacacggaggaaccgtcaaaccctcccgctgcctgcagggaaccatggacacgaaatgcccgtcagcaaatctatagagacaggaagcagatcgatggttcccaggggctgggggaaatggggagtgagtgccaaggggtatgggctctttctggggcgatgaaggcttctggaattagataaaagtgatggtcgccccacctcacgaatatactaaaaaccactgaattggctagtgcggtggctcacgcctgtaacctcagcactttgggaggccraggcaggcggatcacgaggtcaggagatcgagaccatcctggctaacacggtgaaaccccgtctctactaaaaatacaaaaacaaaattagccgggcatggtggggtgcacctgtaatcccagctacttggaaggctgaggcaggagaatcacttcaactcgggaggtggagcttgcagtgagccgagatcgcagcactgcactccagcctgggcgacagtgcgagactccgtctcaaaaaaccgaaaaccaaaacaaacaaaaaacaacccccccaccaaaaaaataccactgaattga

SEQ ID NO: 37575 - DNA, 601 bp, Human
catcagcgggtgaacagacgcatcaaccacggtctgtccacaggctggaacctgactccgccttacaaaaggaatgaagcatggaatggcatacgcttcaacacggaggaaccgtcaaaccctcccgctgcctgcagggaaccatggacacgaaatgcccgtcagcaaatctatagagacaggaagcagatcgatggttcccaggggctgggggaaatggggagtgagtgccaaggggtatgggctctttctggggcgatgaaggcttctggaattagataaaagtgatggtcgccccacstcacgaatatactaaaaaccactgaattggctagtgcggtggctcacgcctgtaacctcagcactttgggaggccgaggcaggcggatcacgaggtcaggagatcgagaccatcctggctaacacggtgaaaccccgtctctactaaaaatacaaaaacaaaattagccgggcatggtggggtgcacctgtaatcccagctacttggaaggctgaggcaggagaatcacttcaactcgggaggtggagcttgcagtgagccgagatcgcagcactgcactccagcctgggcgacagtgcg

SEQ ID NO: 37576 - DNA, 601 bp, Human
agaagaggcgggggagttcctaaacggggaggtttctttgacctccttgtcctggtgaggtttctaaacccagagccacccgcagtccagacacccttcccagagcgtcccctcaaggtgtccccagcccctgcttagcagtgcctctccctgctggggctgtgtctgcctgccagcgtccagcccttcagcacgcgttcgtctccagcaaaaagcacatcaaatgctcatcaaaattttccatcagcgggtgaacagacgcatcaaccacggtctgtccacaggctggaacctgactccrccttacaaaaggaatgaagcatggaatggcatacgcttcaacacggaggaaccgtcaaaccctcccgctgcctgcagggaaccatggacacgaaatgcccgtcagcaaatctatagagacaggaagcagatcgatggttcccaggggctgggggaaatggggagtgagtgccaaggggtatgggctctttctggggcgatgaaggcttctggaattagataaaagtgatggtcgccccacctcacgaatatactaaaaaccactgaattggctagtgcggtggctcacgcctgtaacctc

SEQ ID NO: 37577 - DNA, 601 bp, Human
ctgggaggcaccttccactccacgtccccattgaagatctcactcttggcgatgtccacgcggtcccaggccacggccagcttgagctcatccagatagtcctgaggctcctggctgtggctcttgcaggctgtgggcagagcaggcaggcactggtgagggtggagctgagggcctcacagagccggggcacagggtccccaaaggtgcgctgcctagagacgcggaaacgggaacttcacgctgggacttgagggggcacatgcgccacctctgagcaccagcaggaggcacgagactktgtacaaaccgcaggagaaagcgtgctgccctggtctgcgtcgggacggcccgtctgctcccatgtgaggcaacttcctcggctgcaacgggggtaccccagctaacacctgggcctcgaggccacttcctggcactgaaggtccaggacacccttcctggatgttgtcgggggagcaagctgggccacgtttcctccacgggcaagggcatttggccatgacttggtgaggtcaccagggtcactcaaggggggcctgcagcacctgggctgggtgcgcctgctggaaaccgctgtcct

SEQ ID NO: 37578 - DNA, 601 bp, Human
acctcgtgcagggagaaggccggtggccccgcgggtggctcccgggcctgctgggtgcccaggccggccagcgtcagccgggcctcctcctgcttccgctgcagcaggtcgaagagcaggctcttgcgtgacacggagcggtagagctcctgcagccgcccatacgtcaggaagtcggccacgtctgcgccgttgtccacaaagaggcgcacaaactcgggcttgttgctgaccagggcgtccaccatcacctcctccaggtcacaggacttggcggccatgggcacccgagggaaggggracaagagagtgagcgagagacaggaggagggggtccaaggaaggagagagcagggagcatggggatccatccccagggccaggtcacgcagaccctctcgctctcctgcaccccagcctgccccctgcattggggcgggcacagaggggccagtcgtgagcaaatgctgagggtgtcacaacccccttgggctttggggacagccggcacccagccagctctgcctgggccagtgagcgaggcagaagcccgggcagaaccgtggcctggtcttgccccggaccttgggacagctgggca

SEQ ID NO: 37579 - DNA, 601 bp, Human
acctctgccacgctaaatgtccctcgtcctgcggcagggcccagtgtatgcccggggtgtgaggctgtatcgtcctcaccacgtgcacagcggtcccacactcagggtctggggccgcctccaccccaggcagagccgtctgtcctctcctacggaggaggcccctgagggcacctggagccccacggcggtaacaggcagccctggcgaggcccaggacccttcgtccgacccctccgtcacatcctcccccgccgcgcgggcccggccccagctgccggtcactcaccgagggccagcygctcgtatttcgcctcgcgcgtggctcgggccgcctcggcctccgtctccaggtgcgacatctctttgaggattttgcaggcggccagtgcggctgccacaccttcctggccctacgagacctggtctcaggaggccgcccctcccctgcccccgcgctgggcccgcggcctgggctcaccatggcccagaagtaggtggccatctcgtggcggttctgcagcacggcccacaggaacaggtcccgccaggggttctcgctcttctggttcaggtccagcagccacttctggcccgtggg

SEQ ID NO: 37580 - DNA, 601 bp, Human
tccctcccccagcaggacaaagggaacctctgccacgctaaatgtccctcgtcctgcggcagggcccagtgtatgcccggggtgtgaggctgtatcgtcctcaccacgtgcacagcggtcccacactcagggtctggggccgcctccaccccaggcagagccgtctgtcctctcctacggaggaggcccctgagggcacctggagccccacggcggtaacaggcagccctggcgaggcccaggacccttcgtccgacccctccgtcacatcctcccccgccgcgcgggcccggccccagcygccggtcactcaccgagggccagctgctcgtatttcgcctcgcgcgtggctcgggccgcctcggcctccgtctccaggtgcgacatctctttgaggattttgcaggcggccagtgcggctgccacaccttcctggccctacgagacctggtctcaggaggccgcccctcccctgcccccgcgctgggcccgcggcctgggctcaccatggcccagaagtaggtggccatctcgtggcggttctgcagcacggcccacaggaacaggtcccgccaggggttctcgctcttctggttcaggt

SEQ ID NO: 37581 - DNA, 601 bp, Human
ctccgtccttctccggctctgtccctcccccagcaggacaaagggaacctctgccacgctaaatgtccctcgtcctgcggcagggcccagtgtatgcccggggtgtgaggctgtatcgtcctcaccacgtgcacagcggtcccacactcagggtctggggccgcctccaccccaggcagagccgtctgtcctctcctacggaggaggcccctgagggcacctggagccccacggcggtaacaggcagccctggcgaggcccaggacccttcgtccgacccctccgtcacatcctcccccgccgcgcgggcccggccccagctgccggtcactcaccgagggccagctgctcgtatttcgcctcgcgcgtggctcgggccgcctcggcctccgtctccaggtgcgacatctctttgaggattttgcaggcggccagtgcggctgccacaccttcctggccctacgagacctggtctcaggaggccgcccctcccctgcccccgcgctgggcccgcggcctgggctcaccatggcccagaagtaggtggccatctcgtggcggttctgcagcacggcccacaggaacaggtcccgccaggggt

SEQ ID NO: 37582 - DNA, 601 bp, Human
cccctgcccagacctgggctctgcagccgcaccctgcgttcaacacgcagggcccagccaggccttctgccccctccggcctgctccgggcccttcctgaacctccgtccttctccggctctgtccctcccccagcaggacaaagggaacctctgccacgctaaatgtccctcgtcctgcggcagggcccagtgtatgcccggggtgtgaggctgtatcgtcctcaccacgtgcacagcggtcccacactcagggtctggggccgcctccaccccaggcagagccgtctgtcctctcctayggaggaggcccctgagggcacctggagccccacggcggtaacaggcagccctggcgaggcccaggacccttcgtccgacccctccgtcacatcctcccccgccgcgcgggcccggccccagctgccggtcactcaccgagggccagctgctcgtatttcgcctcgcgcgtggctcgggccgcctcggcctccgtctccaggtgcgacatctctttgaggattttgcaggcggccagtgcggctgccacaccttcctggccctacgagacctggtctcaggaggccgcccctcccctgccc

SEQ ID NO: 37583 - DNA, 601 bp, Human
aatgcccttcccccaggtgcctggcccacgtgagctgaaggggtgcccagcccagccctccctcccggagcccccgtcctggtgggcatgtgctccttgggccactcatcccaggggtgtgggttgagctgctgtacccttcactagggaaaagattgggcttgggggttggggaggactgagaggaggaagtgccacttccactgaggccagaggcaggaggagtgtgcctggtggaggaagccaggtgggcgccttccaggaacagaagccccaccccgccccctctgtgctgaggacrggagtgacagggcagctgcaggctgggaagtcaactcaagctgggcccagctcgcccgcccaccccaccccctggcagctctcctcgaggacagctggcactcacctgaacgccgtcgtgggcaaagaaggccttggcgtcagcctcggtggccaggtgcaggcaggtggtcttgctccagcagcggttccggcgcaccagcagggcgaaggcgcgggcctcactgttgctgtagcactcggagaagaggtctgcccccggaggccctggccgctaggacgagacgccgatgcccggccc

SEQ ID NO: 37584 - DNA, 601 bp, Human
cccactgggatgcaggggctgtggggagtgggacccgcagggaggctggacttgggggctacagagtcaggctaccaccagcacctgcgaggcccaggccctccccgtagctccggcactcgcactgctgcctgtcctggccgggcagctcacaggcctcacccacctgaaggtgatgaggttggtatagacgagggcggggcagaggaaggctcctagcagccgcaggatgggcgtgcctgcggccatgtccccccaccagatcctggtcaggaaggcctgaggtgaaggcaaaactgtyggctccaactctgcacctttgcccaggctgcgccctgccccaggaatgcccttcccccaggtgcctggcccacgtgagctgaaggggtgcccagcccagccctccctcccggagcccccgtcctggtgggcatgtgctccttgggccactcatcccaggggtgtgggttgagctgctgtacccttcactagggaaaagattgggcttgggggttggggaggactgagaggaggaagtgccacttccactgaggccagaggcaggaggagtgtgcctggtggaggaagccaggtgggcgcc

SEQ ID NO: 37585 - DNA, 601 bp, Human
cgggctcttctccgtgtccaggctgtccaggtcctgcaggtcctccaggcctgtcctcaggggagcttcctcactgcgagcacaggagagctcagggcccgcaggaagggctcccagaggcgcctgcctggctccaggcgcttggccatcaaagtgcccactgggatgcaggggctgtggggagtgggacccgcagggaggctggacttgggggctacagagtcaggctaccaccagcacctgcgaggcccaggccctccccgtagctccggcactcgcactgctgcctgtcctggccggrcagctcacaggcctcacccacctgaaggtgatgaggttggtatagacgagggcggggcagaggaaggctcctagcagccgcaggatgggcgtgcctgcggccatgtccccccaccagatcctggtcaggaaggcctgaggtgaaggcaaaactgtcggctccaactctgcacctttgcccaggctgcgccctgccccaggaatgcccttcccccaggtgcctggcccacgtgagctgaaggggtgcccagcccagccctccctcccggagcccccgtcctggtgggcatgtgctccttgg

SEQ ID NO: 37586 - DNA, 601 bp, Human
agtcccctccaccctgcctggccctgtgcctcgcaccggctctgcaggccatacagcgggctcttctccgtgtccaggctgtccaggtcctgcaggtcctccaggcctgtcctcaggggagcttcctcactgcgagcacaggagagctcagggcccgcaggaagggctcccagaggcgcctgcctggctccaggcgcttggccatcaaagtgcccactgggatgcaggggctgtggggagtgggacccgcagggaggctggacttgggggctacagagtcaggctaccaccagcacctgcraggcccaggccctccccgtagctccggcactcgcactgctgcctgtcctggccgggcagctcacaggcctcacccacctgaaggtgatgaggttggtatagacgagggcggggcagaggaaggctcctagcagccgcaggatgggcgtgcctgcggccatgtccccccaccagatcctggtcaggaaggcctgaggtgaaggcaaaactgtcggctccaactctgcacctttgcccaggctgcgccctgccccaggaatgcccttcccccaggtgcctggcccacgtgagctgaaggggt

SEQ ID NO: 37587 - DNA, 601 bp, Human
gcctccaccagctcctccaccctgtgccgcagagaagttcgcagtggtgaggctggcgcccagccgggtgccccaccagagtccagcctcccagccaccacccgccagtcccctccaccctgcctggccctgtgcctcgcaccggctctgcaggccatacagcgggctcttctccgtgtccaggctgtccaggtcctgcaggtcctccaggcctgtcctcaggggagcttcctcactgcgagcacaggagagctcagggcccgcaggaagggctcccagaggcgcctgcctggctccaggygcttggccatcaaagtgcccactgggatgcaggggctgtggggagtgggacccgcagggaggctggacttgggggctacagagtcaggctaccaccagcacctgcgaggcccaggccctccccgtagctccggcactcgcactgctgcctgtcctggccgggcagctcacaggcctcacccacctgaaggtgatgaggttggtatagacgagggcggggcagaggaaggctcctagcagccgcaggatgggcgtgcctgcggccatgtccccccaccagatcctggtcaggaaggcctga

SEQ ID NO: 37588 - DNA, 601 bp, Human
gccgtcatgggggtgcagcagcgcctgggtggtgacaccgtaggccacgagccacacgctcagaaagaagaggaagaagaagacgtccttcatctccacggggcaggggcagagagagggacgtcagcggccagccgggtggggcccaggcagggggttgctgtccctccagggccagggccagggcccccgggggctcaccatgcgctctaccacgatgatcttggggcccagctgcttgtgtatggcaaagatatggatcagccgcagcgtgaacaccatgaagtccatggcgaggacygtgcggccagcctcaaacgccgacggcagcatcctggaggatgggaggctgatgcggctgcggggcccagagaggggcagaggcttccccaggggcacacagcatgctggctgcgggcagggccagggccaggccaggactccttgggccctgagtggcttcatcttttgtttatttatttttaagagacagggtcttgctctgtcactcaggctggagtgcagtggcatgatcacggcttgctgctgcctcaacttccctggctcaagtgacccacccacctcagcctcctgagtagct

SEQ ID NO: 37589 - DNA, 601 bp, Human
ctgtttgtgaagccgtaaatctgtctgataaaagcagctctgaggaatgagacccccacaccctccccgactctgtgatttgggaaggcgccaccaggccgggctggaaattaaattgtccctggggcctggagacccagagaacaagctcgtcaccacagctcaaccccagctccggctcggcacgagtgcagagtggggcaggggtctgttctgggctctgaggagacctgcaggctgtacaggaactgtctgagcctcagtctccctctcagcccagcatgtgttagtgaataactcyctgcctagcagcatgaggggctgggtcacagtgagtggctggggttcaacctgaagggcccagatacttgctcggcagctgaacggagcccaaggaattgcagctcagggaggggaagtgacaagtctgagactctcagtgggcggccggggctggccctgttgcaggcgtttcagcacggggctctgagatccccgcagcaccgcagacctccctgaggcagcactcggagcaggggcccctcgggagtctgtttccctgccttctcccgtcgagaaggaggctatggccaggcctgtc

SEQ ID NO: 37590 - DNA, 601 bp, Human
ggggtccgttctccctcccagggtgaattcctgccttgtttctcccgagtgagttagtgtgacgcgttggcccgtgtgtgagttattgagtgtctgtgtgtgcactggcagtcagtgagcgccagccctccccacgctcccaccctaggcctgcccctcctctgtccgccctggccacctccagcccatgaatctgttcctgggcagactgatgaccccctctcctccctgcactctggaggagcgggccggggccagcctggagagcctgtttgtgaagccgtaaatctgtctgataaargcagctctgaggaatgagacccccacaccctccccgactctgtgatttgggaaggcgccaccaggccgggctggaaattaaattgtccctggggcctggagacccagagaacaagctcgtcaccacagctcaaccccagctccggctcggcacgagtgcagagtggggcaggggtctgttctgggctctgaggagacctgcaggctgtacaggaactgtctgagcctcagtctccctctcagcccagcatgtgttagtgaataactctctgcctagcagcatgaggggctgggtcacagt

SEQ ID NO: 37591 - DNA, 601 bp, Human
gtagagccaagacccctggagggatggaaggtgggggacagaggggtcacgggacccaggtttctcctggttgttggatgtgttaaaacctccacccctcctccgaaaaaagcctctgctgttgaaggtttggggagagctgccgaggaaagggagatggggcccaggacttctcagagcctctgcagcactaatgcctgtgattaaaccccaagctggcgagtaattccgccacctttccaaaatgtattgagccagcaggctccagactgggcttgctgcaagctctgagggcaccgaycccgcactgggccactcaagtcaagaacattcttcaggcggcacactctgggagcttgcaggctgagctccctcggccctgggcagggacaccctggaggggtggcagatctcactccagtcccttaaaaccagaccctcacacctgcttctcccttgtagggctcaaccctggaccctcaccccaccccagcctgcggggcaggaggagggaggagggaggaaggagccgcagtgggcgtcagggtgctcagggtcccagccagaggccagagtgtgccctggccgtccaggaccacat

SEQ ID NO: 37592 - DNA, 601 bp, Human
gccccaccctgggccccctctgccatgtctgctgagcttccaccaggggctggagtcagccaagatcacaggccctggaagtagagccaagacccctggagggatggaaggtgggggacagaggggtcacgggacccaggtttctcctggttgttggatgtgttaaaacctccacccctcctccgaaaaaagcctctgctgttgaaggtttggggagagctgccgaggaaagggagatggggcccaggacttctcagagcctctgcagcactaatgcctgtgattaaaccccaagctggcragtaattccgccacctttccaaaatgtattgagccagcaggctccagactgggcttgctgcaagctctgagggcaccgaccccgcactgggccactcaagtcaagaacattcttcaggcggcacactctgggagcttgcaggctgagctccctcggccctgggcagggacaccctggaggggtggcagatctcactccagtcccttaaaaccagaccctcacacctgcttctcccttgtagggctcaaccctggaccctcaccccaccccagcctgcggggcaggaggagggaggaggga

SEQ ID NO: 37593 - DNA, 601 bp, Human
ccccatcacagcaaaccagaaccagacgggtggtgagccccaccctgggccccctctgccatgtctgctgagcttccaccaggggctggagtcagccaagatcacaggccctggaagtagagccaagacccctggagggatggaaggtgggggacagaggggtcacgggacccaggtttctcctggttgttggatgtgttaaaacctccacccctcctccgaaaaaagcctctgctgttgaaggtttggggagagctgccgaggaaagggagatggggcccaggacttctcagagcctctrcagcactaatgcctgtgattaaaccccaagctggcgagtaattccgccacctttccaaaatgtattgagccagcaggctccagactgggcttgctgcaagctctgagggcaccgaccccgcactgggccactcaagtcaagaacattcttcaggcggcacactctgggagcttgcaggctgagctccctcggccctgggcagggacaccctggaggggtggcagatctcactccagtcccttaaaaccagaccctcacacctgcttctcccttgtagggctcaaccctggaccctcaccc

SEQ ID NO: 37594 - DNA, 601 bp, Human
tccttcttgaagacccggcggagcgtcaggctcaggtggctgagcaggatgaagggcggggccagggcggggcgctcgtggtactccacaatcaggttgtagcgctggaacttccagaacatgtctgcgttgccctgcaccacctggaacgtgtagctgcaggggcacagctgagccgtcacctaccggctccccacgaccacttgggggacgcatccccctgcaccctgattgctgttggggagccctttttgaaactgaggcccagcactgcttctgcgttgcctctggggtgtgtcaygaggggtccactctccttgggtcttcccctgtccactctgctctcctggacaagcccagagttcttgccacagcaccggtcccccaaagacccaggccctgcttcctgggactgggagggtggcccacagagttcccggtcttgggcaggcaaagccctgcagtccaggctatgccaccttctatctgccctgaggcaccaagcctcaccctctgcagcacaccaggtgggttgcaaaggaggcggtgttggggaatgaccctctgctccctccgctccagggctctctcctccaggggt

SEQ ID NO: 37595 - DNA, 601 bp, Human
ggcaggtctctctctgggaaagccaggtggcagccagcattactagagcatgtgggcgtcagtggcagagcccaggcctggtcccggggcgaggtgggccaggcagaaggagtgagtggggcccagccagggatggagggcaagcatggccctgtgcaaggacggccaagctgcgggtggacgggctcagctgtgccagcctgcacagagcccagctgaggacccacagggctgaggaggggtccaggtctctccagacctgcctccagcgcacagccccgccctgggacccgccacctcggcctcacccaggtgctcccgcttgtgctcggcctcacccaggtgctcccgcttgtgctcagcctccttcttgaagacccggcggagcgtcaggctcaggtggctgagcaggatgaagggcggggccagggcggggcgctcgtggtactccacaatcaggttgtagcgctggaacttccagaacatgtctgcgttgccctgcaccacctggaacgtgtagctgcaggggcacagctgagccgtcacctaccggctccccacgaccacttgggggacgcatccccctgcaccctgattgctg

SEQ ID NO: 37596 - DNA, 601 bp, Human
ctggcaggtctctctctgggaaagccaggtggcagccagcattactagagcatgtgggcgtcagtggcagagcccaggcctggtcccggggcgaggtgggccaggcagaaggagtgagtggggcccagccagggatggagggcaagcatggccctgtgcaaggacggccaagctgcgggtggacgggctcagctgtgccagcctgcacagagcccagctgaggacccacagggctgaggaggggtccaggtctctccagacctgcctccagcgcacagccccgccctgggacccgccacctcggcctcacccaggtgctcccgcttgtgctcggcctcacccaggtgctcccgcttgtgctcagcctccttcttgaagacccggcggagcgtcaggctcaggtggctgagcaggatgaagggcggggccagggcggggcgctcgtggtactccacaatcaggttgtagcgctggaacttccagaacatgtctgcgttgccctgcaccacctggaacgtgtagctgcaggggcacagctgagccgtcacctaccggctccccacgaccacttgggggacgcatccccctgcaccctgattgc

SEQ ID NO: 37597 - DNA, 601 bp, Human
tggtccagggggtctggcaggtctctctctgggaaagccaggtggcagccagcattactagagcatgtgggcgtcagtggcagagcccaggcctggtcccggggcgaggtgggccaggcagaaggagtgagtggggcccagccagggatggagggcaagcatggccctgtgcaaggacggccaagctgcgggtggacgggctcagctgtgccagcctgcacagagcccagctgaggacccacagggctgaggaggggtccaggtctctccagacctgcctccagcgcacagccccgccctgggacccgccacctcggcctcacccaggtgctcccgcttgtgctcggcctcacccaggtgctcccgcttgtgctcagcctccttcttgaagacccggcggagcgtcaggctcaggtggctgagcaggatgaagggcggggccagggcggggcgctcgtggtactccacaatcaggttgtagcgctggaacttccagaacatgtctgcgttgccctgcaccacctggaacgtgtagctgcaggggcacagctgagccgtcacctaccggctccccacgaccacttgggggacgcatccccct

SEQ ID NO: 37598 - DNA, 601 bp, Human
ggaggaggcacaggtggggacggcctgtcttccccagaacgctcctctgcccactggggtgctcctgtcctggctctggcctgcctcatctctgtgagtgaccgggcagggctgtggacccatcccagtagccccacgcagccacccgcctcccatcagggagaggagctctggggctcgcttgcctgtgactccagacacttgatgcgcttttcttgctctctcagccccccgaggtacttggcaatgaagtccactctgcggcaggagcaggtggtcaggctgtggatggccacgcggygctctgcgtgtggggagcctccccatccccccaggcctccctgtgtgcccgagtttggggtgccctggccctttcccttcctccctcatgcccagatctggtggcaccaggacccctcaaagtgcacctggtgcagtacagagcgctctatgccttcccagtagggctagggtgccatccctgcctgggcgcaccacccagaaagacggtgcagggcaggcagtcggggacaggcccctggagccagggctggagggaagccaggggtgggtagtcccaaccctgagaccacagcaggga

SEQ ID NO: 37599 - DNA, 601 bp, Human
ctccctctgagagctgccgctcacaggcaggggtgagtgaggctcccgtgaggcgtgtagagtgaaaggcgaggggtcttcaatgtgagacccctcatttaaggctgtagcctcccaagtggcagggtgggaggaggcacaggtggggacggcctgtcttccccagaacgctcctctgcccactggggtgctcctgtcctggctctggcctgcctcatctctgtgagtgaccgggcagggctgtggacccatcccagtagccccacgcagccacccgcctcccatcagggagaggagctcyggggctcgcttgcctgtgactccagacacttgatgcgcttttcttgctctctcagccccccgaggtacttggcaatgaagtccactctgcggcaggagcaggtggtcaggctgtggatggccacgcggtgctctgcgtgtggggagcctccccatccccccaggcctccctgtgtgcccgagtttggggtgccctggccctttcccttcctccctcatgcccagatctggtggcaccaggacccctcaaagtgcacctggtgcagtacagagcgctctatgccttcccagtagggctagg

SEQ ID NO: 37600 - DNA, 601 bp, Human
cctacggccccccagccgctgcagagtgggtgcccatgcccaccctcatcccacgctccccaaacaggcttactccgggggccgccaccctgggccagcacgtcagccacggaggacacgagcaccgagcagtagttgatctggagaagggaaacacgtccgggaagctccagggctctctcaggacagcaggggacaggcagcctccccatctcccctctcctgccagggcccccgctgccctgtgactcctccctctgagagctgccgctcacaggcaggggtgagtgaggctcccgtsaggcgtgtagagtgaaaggcgaggggtcttcaatgtgagacccctcatttaaggctgtagcctcccaagtggcagggtgggaggaggcacaggtggggacggcctgtcttccccagaacgctcctctgcccactggggtgctcctgtcctggctctggcctgcctcatctctgtgagtgaccgggcagggctgtggacccatcccagtagccccacgcagccacccgcctcccatcagggagaggagctctggggctcgcttgcctgtgactccagacacttgatgcgcttttcttgctc

SEQ ID NO: 37601 - DNA, 601 bp, Human
aagtgctcccaattagcacaggctgtattacttgcttttcaatggacatttactattttacattaagatctacttataggaacaaagagacaattcccagccccctctggtgtatcacctaaaagactgaatacaaatgttaatgtaatccaagcttttctttgacaacaatactaaaaattgccttacaattttttacaagtacgagtatcaacagtttactgtctgagggaaaggaaatataagaatataaagtgacagaagcaacacacttcactgtggcctgcaactgctcccagcstcctattttataaacatgatttgggttctcacattatagcaggatcactattcctagcctctggtggaagcagacatgtgacacttagcactgcacaagtgtttctttggcttcttgagtagtgctgtgtatactgcctatacatttttataacatctctaaatgcataatgtcaacgtatgtgctatcacatttcactcccaactgcagaatattttaattttaaatttatctaccaaatcttgactatgacatttatttttgggttgttacattaagatcaacctatctgggccgggc

SEQ ID NO: 37602 - DNA, 601 bp, Human
taacatctctaaatgcataatgtcaacgtatgtgctatcacatttcactcccaactgcagaatattttaattttaaatttatctaccaaatcttgactatgacatttatttttgggttgttacattaagatcaacctatctgggccgggcacggtggctcacacctgtaatcccagcactttgggaggctgaggcaggagaattgcttgaagtcaggaggcagaggttacggtgaaacaactgccattgcactccagcctggacaacagagcgaaactccatctcaaaaaaaaaaaaaaaaccccaaagatcaacctatctgaattgggtaagtcaaaagcttattcctggccgggcacggtggttcatgcctgtaatcctagcactttgggaggctgaggcgggtggatcaactgaggtcaggagtttgaaaccagcccggccaaaatagcgaaaccccgtctctactaaaaacacaaaaattagccaggtgtggtggtgcatgcctgtaatcccagctactcgggaggctgaagaaggagaattgcttgaacccaggaggtggaggttgcagtgagccaagactgtgccactgcactcc

SEQ ID NO: 37603 - DNA, 601 bp, Human
aattgggttcataaaatggattcattgaaaactaggaaagaagaaagtattagtgaagcaaaaaagctgacaaatcttaagtttctgaaaggaaatcattttaaagttttaaattaaaaaccaaagacattccaaagtctaaagaccacatttttaagttttattgaaaatgctgcattgttaataacatcctcttaaggaaatttttattttggtgttttggttttgagaagtatctgtggcaaaactaatggcagtatgataaatgttgcctgtgtcagttaactttcagaatttaccstgtgtgtgaaatactcatattcattataaataaatggattaatctctatggccctttggctacataaaacaaaaaaatctgccatgtgctcagagttcagaaaaagctattcttgtgtggtaatcttttaacaatcaggtttttaatactctcctttaacacaagactgctaaatgatcagcttctcaaattagtgtatcataacgcatgacagaaaatcattaaatggaatcactaatgaggaaaggcattgctgatttttataccttaatcacttgacattgttcatctttataagag

SEQ ID NO: 37604 - DNA, 601 bp, Human
aaatgaaaaacaaaaagcaaccagttcgttgatacagtattcttcaaattagtcacatgcagtgtatttgtgatggaaaagttgaatatataaactgggtttaaaattagcttagttttatcataaagagaacataagctttcaaagttagaaaataactgtaaaataaagtaaaatcacccttgatagggtccagataaactctttttgtgtatgagacttagttttaaaattagctattaaacaaaatgtttttcccccctaaaaaaagaaaagtagccccataaatggaaacttacaytttcacctgactgtgaagtctacagactcagagcctggcatctatgttccatgttcttctggtttgtgagcccaaactttagttagttacctttactaagaaggtaaggatatgccccgcagtgacaaatgccgacacaaaccactcgttgaacttgtccacagttttcaagtacatgttgttcgatagccacatgttctcatctacgaggtcgagagcagcatgagctatgaactggttcagatgacgatggtcgtcctagatgacagtgtgagcaaccacagattaacatttgcatat

SEQ ID NO: 37605 - DNA, 601 bp, Human
gagaaaaatgccacatgaagactggagttatgctgccacaagccaaggaactcccagaagctgggagagaggcctggacagacccttgtctttgtgccttcatagggagcatggccccactgacaccttgatttcagatggtggccctcagaactgagacaataaatttctgctgtcccaagccactcagtttttcgtactttgttacaacagccataggaaactgagacggcttccttgccaaggaggctgttctcatgcctgggctggaggagggcggcccgttgccgtggaatcccaygcatagttaaagcatgttttacttcactcatgttgccatgacaaagctaagtgaatccttagagaaatggatgtttttgtgtctggctcacagcagtgttttcttttacaatgatgatcaatcctgaagaattaggagcaaactgaaaacgctttaagaaagtgagtggtagcaggagaaagaactaaaatcaagttatgcaacaaagtatttttatgtgtgctttgtccaacacaagggcagtggagtgcacagaaattacatacaagtagctgcatcccacaaagcagtactggtaca

SEQ ID NO: 37606 - DNA, 601 bp, Human
cagtaggtcctgatgaaaaacatgattcatgaaaacagcctggactttcatggtatttcaaggcggcaatccactacaggtgaactatgtctttatgtgcttaagcaacagcaattcatggtgggtgacatagtgaactgagtatgatgggaatgccagagcgtcatgctagtctgtgctgaactaaaggatgaataaacatctccaaggacataccctggctggcttctatcagtctgtgggctcctgagcaagcctcatttaattgtggtggatttcagttaccttatctgtccagatcttccagttctaaaatcatattataccatatcattacaatagcataaaaattcttacgtactttggattctgccttcccagctggcaaaaactccatttcaaaaactggattatcatggtggccaacaattacaaagtagaagctcccagacatggtcttcaatatatggctcctaattaagtgaaaaatagtacatatttttagtagtcaatcttcaaattaaaaaatgactaatgggaagtgtagaattcttttttaaatttaaacctgacattgtagaggaagatgctactaagcttg

SEQ ID NO: 37607 - DNA, 601 bp, Human
caccacgtgaccccagcggtcgtcatctgtctttttgaaggcaccacccttgttggggcacagcacacagtcggcgggccgggcccgcgactgcaggcagtggcggcagagccactggccctcggggatgtagggcaccccgtagcactcctggtgcacggccaggttgcacatgtcgcagaagaggatcacgttgctgttctgacactccccgtccatgcagatgcagcacacggcgtcctcgtcgatcagagactgctgctcgccctgcttctggttctcgcagtgcgactccttctcraagcggtccatcaggaactcaaacatgctctgcgacacggcggggacgcagtcgcccttgcgcttctcattgacgatctccagccaggcatagtcctcctcgtccatgtcatactccacctcgttgtccagttcctcggccgacttctcgatgaacttgtagtacacaggaggcctcctgggggcggacggagggctgtactccacgatgcgcaccttgggctccgggagggcactggccgaggccggcgtgccgtgggcgctggggagggcctcgtttttctttttgactctgttgttt

SEQ ID NO: 37608 - DNA, 601 bp, Human
caagatctgaaccctcaacttcctcccaaaaaagcctctcttccattccccaacatcgcaggggcggagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccactctcttccattccccaacatcgcaggggccgagaccaatgcctccactctcttcctttccccaacatcgcgggggcsgagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccagcccccagagcttcccgccgctcagccacttcctgactctggcctcttaagagccccccaaaccgtgctgtcctttccaggagccctggaggctacgaggtgaggacagaggagagatggaaagccaagtcacatcatggaac

SEQ ID NO: 37609 - DNA, 601 bp, Human
aagacccaagatctgaaccctcaacttcctcccaaaaaagcctctcttccattccccaacatcgcaggggcggagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccactctcttccattccccaacatcgcaggggccgagaccaatgcctccactctcttcctttccccaacatcgcrggggccgagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccagcccccagagcttcccgccgctcagccacttcctgactctggcctcttaagagccccccaaaccgtgctgtcctttccaggagccctggaggctacgaggtgaggacagaggagagatggaaagccaagtcacatca

SEQ ID NO: 37610 - DNA, 601 bp, Human
caacagctcctctgtgacttacctggagttctgtccagccccgagataagacccaagatctgaaccctcaacttcctcccaaaaaagcctctcttccattccccaacatcgcaggggcggagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccactctcttccattccccaacatcgcrggggccgagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccagcccccagagcttcccgccgctcagccacttcctgactctggcctcttaagagccccccaaaccgtgctgtcctttccaggagccctgga

SEQ ID NO: 37611 - DNA, 601 bp, Human
agggattctggccctcgtgtcccagcttatgagagtagaaatgatgattcccaccgctggacgtcccgtttggccacatccatgcccactttccatggaatctgcccttcaacagctcctctgtgacttacctggagttctgtccagccccgagataagacccaagatctgaaccctcaacttcctcccaaaaaagcctctcttccattccccaacatcgcaggggcggagaccaatgcctccactctcttcctttccccaacatcgcgggggccgagaccaatgcctccactctcttccwttccccaacatcgcgggggccgagaccaatgcctccactctcttcctttccccaacatcgcgggggccgagaccaatgcctccactctcttccattccccaacatcgcaggggccgagaccaatgcctccactctcttcctttccccaacatcgcgggggccgagaccaatgcctccactctcttcctttccccaacatcgcgggggccgagaccaatgcctccactctcttcctttccccaacatcgcgggggccgagaccaatgcctccactctcttcctttccccaacatcgcgggg

SEQ ID NO: 37612 - DNA, 601 bp, Human
tgccgcccccgttctccctgcggccttcaacggccacacacaccagaacaaaaaccagggcctatatgcgcagccagcacagacccgccatcgctgcagcaccctcggcgcctgctggcctctcaagagaccccgtccagttcatccacctgcccccaccacagggtcaggctggggcaggtacacagagacacagaggaatcaaatgcatcaggtacttccaaagcttcaaaaccatgaaaccacaccaagccgtggccatccctggccaggagaaggcagaagcacagtctctcccaayagcccgttcacacagaggcaggtttccaggctctccacgccgactgctctgctgcggctcaagtccaggcagctccttctgctccttcccaggtgacttcgagaagctgccccctctgccagaagagctgctctggccgggctgtggggatgttctctccttacaaacgtattctgcacacaacaggacgtgaggcctaacaggcagcgatgaagcagagggggcccagctggcaggttccagcgggtcacctcttctttgcaaccctcccccttcccttgcctggctccaccacgcccc

SEQ ID NO: 37613 - DNA, 601 bp, Human
agttggcctgagtgggcccccaacacctgtcatcctccacagctgcaggacacgcgcgccctgccagcctcaggacagccgtggccatcagtttctggcacatgcttcacagccctgagaccctcctctcccccaacgcctctgtccccgggttcccacctgcccacctcagggtactgtcatagcttttcaaaggaccgagggtgtgaaggcaaagactgctggactacaagatgcaaggaccccggactccaaactgctcagaaaaggaggctcaaggagggaggccgagccccgcacycccacccccaaggccaggcctctccatggcgaggcagagcgttgctgcgctgatgtcccctgaagtgaggatctctgggttttcctcaatgctgctgaacaccctcaggcaggaaatcggggctaagagtaacaagatccacatcaactcaagcaaaggcaggaaaatgtgggctccaaaaaccaagctccccggagcatctgagtattgcctgtccctcagcttgcaatcgacacttctgaaaacctcggccaaaaggacatttggcctgggaatctgttacgaagcggaagaaatctc

SEQ ID NO: 37614 - DNA, 601 bp, Human
atagcacctgctcccttctcagtggacagaagagtgcgccagacagcacaggccgccagcctcaacccagccaacatccacaccagggtgatcagaagaaaatcagagccctgcaaaggccatgacacagatggtcgcaggagagtaggccacctgggtctgccctcagccctgtcctcaccatgtcccccaggcctggccgcatgaggcctgctcgtcacagtgccggggcaccctgaccctacctcaaaggggagaggaagtcaacgagggagttggcctgagtgggcccccaacaccygtcatcctccacagctgcaggacacgcgcgccctgccagcctcaggacagccgtggccatcagtttctggcacatgcttcacagccctgagaccctcctctcccccaacgcctctgtccccgggttcccacctgcccacctcagggtactgtcatagcttttcaaaggaccgagggtgtgaaggcaaagactgctggactacaagatgcaaggaccccggactccaaactgctcagaaaaggaggctcaaggagggaggccgagccccgcacccccacccccaaggccaggcctctccat

SEQ ID NO: 37615 - DNA, 601 bp, Human
ctcaccgcggctctatagaacacggtgtccctggcattgtacttcatgcagttatctataatgagatcaaaatcctcctcaaactcatggaggtttttatacccttgagcttctaaccgtttcctcattgtggcaaagtccatgggatgtttaatgtgatccaaataatctggtacctaattttagggaggaaaaagaatcatttacaaactaaaacaggatattagttgactctatatttattattccatataacccacaagcccatcctatctgagagccacacacagacacgcagackgtacagacataagacccaagtactgcagggaccttcccgaccccagctccttcagctaaagcacgctggagggtgccgggcggatgctgccacagcccagggtactgtctgcacagggcctcttgcccactgcactttcagtattttacaatgaaatgtatcacttttataatttaaaaacaaatacgttaaataaaaacgagaattaagaacacaagggatgtactctagccaatcacacgtttcccggtcaaacggcagcacaaatccacagtcacacatgcggcaggacagacgagc

SEQ ID NO: 37616 - DNA, 601 bp, Human
aggtgcccgccaccatgcctggctaattttgtttttgtatttttagtacagacagggtttcaccacattagccaggatggtctcgacctcctgacttcgtgatccacccgcctcggcctctctcttttttctttttttttttggagatagggtctcactctgtcacccaggcttcagtgcaatggcacaatctccgctcactgcagcctccacctcccaggttcaagcgattctcctgcctcagcctccgaaatagctgggattacaggcatgcgccaccatgcccggctaattttttgtrtttgcagtagaaacggggtttctgcatgttggccaggccggtctcaatctcccgacctcaagtgatccacccgcctcggtatcccaaagtgctgggattacaggcatgagccacagaacctggccctatccccagtctttaaaagagtacagcccatcctccaatcctcacaggtgccgagtgctgcgggaccccacgggaagcagggagcccagcactgctgccatgaggggaacagagggcgaagcaacgatggcccagcttggttgaatcccatgatggcgggaagcggaccccacg

SEQ ID NO: 37617 - DNA, 601 bp, Human
cttccaggacaagcatgagcccatggagccctgggctcactctgaggcggctcagccctggctcctctcaggtccccaagggaatgtttcggaaaaggatagctggtctgatcagcctggagagcgcagcttcagagaggggttaaagctccacccgggttcaccaagagccagcagcactgtttggagcctgtgtttattttctaaatttctccaagaaaaacgtgttactcttaaaatcagaaaatcagagacaaagaataaaaatatatttccattgtgttttcttttttttttttttgagacagtcttgctctgtcgcccaggctggagtgtagtggcgtaatctcggctcactgagagcaccgcctcccggattcacgccattctcctgcctcagcctcccgagtagctaggactacaggtgcccgccaccatgcctggctaattttgtttttgtatttttagtacagacagggtttcaccacattagccaggatggtctcgacctcctgacttcgtgatccacccgcctcggcctctctcttttttctttttttttttggagatagggtctcactctgtcacccaggcttcagtg

SEQ ID NO: 37618 - DNA, 601 bp, Human
ggtgtgaaaatattgtggttatatttaagaaaaatgatggagaggctttactgatgagaacgttcatgctgggtttttaaatgtctgattcttggttttcatcctattataagtatcgtaagtcacatttctataccaaccaacaagcttgcttgtggctgtcttccctaatgacttccccattccagtctggcactcgcctctccacagacccccatcttctctgaggggcaggaccccgcccgccccacctctccagagacccccaacttctctgaggggcaggaccccacccgcctcrcctcggagtggactttcaggccacttgcttctccacccaccttcccatcagctcacaggaaacgcccttttcatcaattgagtcattgtgaacattgggtgtaacaggtgattcgaggccacctgtgtctcagtcacattgtgttttccttacaatggccccagaaaaaaaataaaaataaaatgattccagagctacaaagcaacaaaaatggtctccaaaggctcctgctaagcgttgggtgttatgaggagccacgctcaccacagcggagggccaagcagctccaaccatgcgagg

SEQ ID NO: 37619 - DNA, 601 bp, Human
tggaagcaaaatataaacacaacacacagactgttaaattacagtttaagtgagactgtgtatttgccattgaggaattactcttttcaggtgtgaaaatattgtggttatatttaagaaaaatgatggagaggctttactgatgagaacgttcatgctgggtttttaaatgtctgattcttggttttcatcctattataagtatcgtaagtcacatttctataccaaccaacaagcttgcttgtggctgtcttccctaatgacttccccattccagtctggcactcgcctctccacagayccccatcttctctgaggggcaggaccccgcccgccccacctctccagagacccccaacttctctgaggggcaggaccccacccgcctcacctcggagtggactttcaggccacttgcttctccacccaccttcccatcagctcacaggaaacgcccttttcatcaattgagtcattgtgaacattgggtgtaacaggtgattcgaggccacctgtgtctcagtcacattgtgttttccttacaatggccccagaaaaaaaataaaaataaaatgattccagagctacaaagcaacaaaaa

SEQ ID NO: 37620 - DNA, 601 bp, Human
tgcttcaagtggaagcaaaatataaacacaacacacagactgttaaattacagtttaagtgagactgtgtatttgccattgaggaattactcttttcaggtgtgaaaatattgtggttatatttaagaaaaatgatggagaggctttactgatgagaacgttcatgctgggtttttaaatgtctgattcttggttttcatcctattataagtatcgtaagtcacatttctataccaaccaacaagcttgcttgtggctgtcttccctaatgacttccccattccagtctggcactcgcctstccacagacccccatcttctctgaggggcaggaccccgcccgccccacctctccagagacccccaacttctctgaggggcaggaccccacccgcctcacctcggagtggactttcaggccacttgcttctccacccaccttcccatcagctcacaggaaacgcccttttcatcaattgagtcattgtgaacattgggtgtaacaggtgattcgaggccacctgtgtctcagtcacattgtgttttccttacaatggccccagaaaaaaaataaaaataaaatgattccagagctacaaag

SEQ ID NO: 37621 - DNA, 601 bp, Human
agtcgcggctacggcagagcctgcgggagggcctgtacaaggggcagaccggggccaacagtgcagcccaggaggcatctccttccttcagacactaaagtctcaggggcctggcactcaacggctacagccttgttcaagctgcttcaagtggaagcaaaatataaacacaacacacagactgttaaattacagtttaagtgagactgtgtatttgccattgaggaattactcttttcaggtgtgaaaatattgtggttatatttaagaaaaatgatggagaggctttactgatgagaaygttcatgctgggtttttaaatgtctgattcttggttttcatcctattataagtatcgtaagtcacatttctataccaaccaacaagcttgcttgtggctgtcttccctaatgacttccccattccagtctggcactcgcctctccacagacccccatcttctctgaggggcaggaccccgcccgccccacctctccagagacccccaacttctctgaggggcaggaccccacccgcctcacctcggagtggactttcaggccacttgcttctccacccaccttcccatcagctcacagga

SEQ ID NO: 37622 - DNA, 601 bp, Human
caaaccagctactctaagaaactaaaacctagttaagtctgcaagaacaattccgcaatattttgcccacctggccacctgctatgtcaatcaaaggtttctgtatcgaagccacaagacgctttggaaaatcacagcgtaacacaggcagacatttcagctcacgagcagcaaccacactgtccctccaacaaccctgcctcaagcctccgtcctctgcaatcctgaagggacaaagctgcgtactccgcaccttctaccccgaggaacatgcatccttcctttcctgagggccacagtkctccacgtgctcagcgcccgtgcacggcagggggacttccacacgtgcacttcaagggaccacagctgccctggactaaaggggacgccccggagcctctggcaagggcatcactgtgactggaaatcccaaggactcgaaatgcaagcccctttcaccagctcacggtgcggaccctgctcctcctgactgcactgacctgcctcaccatgtcagcagacaccaacctcagcacagggtggagacaagccctctgccagctgcagatccgtcccacaggctcatcagacaggctggaat

SEQ ID NO: 37623 - DNA, 601 bp, Human
aggatcacctgagcccaggagttggaggctgcagtgagccactcactccagcctgggtgacaaagcaagactctcttaaaaaaaaatcagagaggaagtatgtggcagaagacaggaccaaggaccatcgacccctggcccagggcagcccagcaaggttgcacaatctctcgtggcaaacaggccccccacgaaggcgccggcctcagacccgcaactcaaggcttttcaaagaaaacactgcactgttgtcttctctggaaattaagagaatgctgcaaaaacagaagctggacacccscccccccccgtcacaccaatgatcctgaaggacgctccaggcactggtcggcaagggcgcctctcagggccgcccgcggcatttacctgcgtccaggcgctttcctggggactcctcctccacctcggagtctccgcatgtgctccgcgaccttttccttggctgcagaagagtctccaacctcggaaggactacagacaaaaaggttttggtccctagctgaggagaagttggctgggtttcagtgttcttggcagactttggggggcttacacttttcgatttgcagaagagaacaga

SEQ ID NO: 37624 - DNA, 601 bp, Human
tcaagatgaccaattaaaactacacctgaattcattctcagtacttttttaaagatcagaaggggccaggtgcagcggctcacacatctaatcccaacactttgggagtcagaggccaggagttcaagaccagccgggacaacacagcgagacccccatctctaccaaaaattttcaaattagctgggagtggtggtgtgcacctgtagtcccagctacacaagaggctgaggcaggaggatcacctgagcccaggagttggaggctgcagtgagccactcactccagcctgggtgacaargcaagactctcttaaaaaaaaatcagagaggaagtatgtggcagaagacaggaccaaggaccatcgacccctggcccagggcagcccagcaaggttgcacaatctctcgtggcaaacaggccccccacgaaggcgccggcctcagacccgcaactcaaggcttttcaaagaaaacactgcactgttgtcttctctggaaattaagagaatgctgcaaaaacagaagctggacacccccccccccccgtcacaccaatgatcctgaaggacgctccaggcactggtcggcaagggcgcctc

SEQ ID NO: 37625 - DNA, 601 bp, Human
gcgagtggacaaagacatccccacactctcaagccccagcacatgcacacagagactcgcagcaggggtctccgcaacggcggtgagtggacaaagacacccccgcgctctcacgccccagcacgtgcacagggagactcgcggcaggggtctccgcaacggcggcgagtagacaaagacacccccacgctctcacacgccccagcacgtgcacacagagactcgcagcaggggtctccgcaacggcggcgagtggaaggccgcttcaggtgacggttcactgctggtgagcgtgcagtcrcggaggaaggaagccacgagtcagggccagactctggggctgggccatcgcaggaacagaagcctggcgcacagcacagccggcccgcgggcgacacgggcaggaggcccacagtgagtgcgtcgcctcaggaccagcgaccctgttcagcctaactcagaattgtgcgtgtgctggaaaatgccagataactccctaaagttcagagcacacagatgcatgtatggaaaacatcagaaggttccggataattcctgtcctaagactgcgaagaactgcagctctgggcaagaaatcccc

SEQ ID NO: 37626 - DNA, 601 bp, Human
cagagacagacccaaggcccatcgtgctgggacccgctccgcgacaatgcagctgggatggtcagagacagacccaaggcccaggccagatgcctgcacaagacttgctctgtgacaatgccgctggggacagtcagagacagacccaaagcccatcttgctgggacctgctccatgacaatgcagctgggacggtcagagacagacccaaggcccatcgtgctgggactcgctccgtgacaatgcagctgggatggtcagagacagaaccaaggcccaggccagacgcctgcacgagacctgctcttgctgggacccagctccatgacaatgcagctgggatggtcagagacagacccaaggcccaggacagacgcctgcacaagatcccacgcacagatgccccaccccacgagcaggacttctcagttggccgcaggggcactcagcgtggtgaccagcaagagacaaacagcagcactgctcaagaatccactgggcattgtggggaaaaaacagaggaaggggaagtaaggggagaaggaaatcaggtagaaaacccagaaatacagaagatgctagcgagtgagtgagcacgcac

SEQ ID NO: 37627 - DNA, 601 bp, Human
ccctcaagggccttcccagtgacctcctaggaggccaaagactgaacacagaaatgtccctctctgcccccaaaggagatggcgcaaaggtgtcccacagcccagccaagcgcagtccccggaagcctgcccgtcaccaggtacgtccacagcacacctgaaactgtcccgggaggtccccaaagggtcttctgagagactgaaggccacagcggctgagacaccgcccctccccacagggaagagaagccccagggcccacctggggaggcggaggcctgcaggtctgactgatgggccrtagtctcctctggtctcaggctcccagcccccaacccatgtggacaccacaaatcctccaggccacaggtgtaagaacaccaggccctgatcagtggctgccgagacacctgagggcacggagccatgggaacgcaaccccacaacacgggatacaagcccgcccctgcccgcccctgccgctggcacccaagctgccacctcggcttctccggctcatgggaagcttggccgtatgaagcaggtgggctgagcctgcaccctgaagaccagagccctgagggccccacgcagtgacaaa

SEQ ID NO: 37628 - DNA, 601 bp, Human
caatctcggccctgccaactcccgccctgggaggctcttccagccagctgggagatgtccaccatgacccgcacctcagcacccctgcaaggacctcagcccagaacattctgaagcccaggccagccttgaggtggggcccaacgtggggaacccagggcctaaggtctgcagagatgggtgcccggtccatgaggcatttgcaaacagcaggcactgaggccgagcccaagcctctaaatcatgtaaatagcaaggggcaactttcagcaactttttcagcacgaggtttttttttaaygctgaaagtaaagctggtgactgtgagaaatacgttaaaagaggcggcggctgccaggaaagagccgctgccccatcaacacaggagctgcacggaattcccacagcggccagggtccacccaccctcaagggccttcccagtgacctcctaggaggccaaagactgaacacagaaatgtccctctctgcccccaaaggagatggcgcaaaggtgtcccacagcccagccaagcgcagtccccggaagcctgcccgtcaccaggtacgtccacagcacacctgaaactgtcccgggaggt

SEQ ID NO: 37629 - DNA, 601 bp, Human
tcagtattttccccctaaaaatcctgactttgtcagtcaacgggaaacaacacatctgcccaaggccccccgatgaggtcccccatgggagtcacaacggggggatgatgttcctgctgggggccctctgggtgtcagagctaaaggggtgtgtgattttttttttcttttttgaggcggagtctcactctgtcgcccaggctggagtgcagtggcacgatcttggctcactgcaagctccacctcccgggttcacgccattctcctgcctcagcctcccgagtagctgggactacaggcrcccgccaccatgcctggctaattttttgtatttttagtagagacggagtttcaccgtgttagccaggatggtctcaatctcctgacctcgtgatccgcctgcctcggcctcccaaagtgctgggattacaggcatgagccatgacacccggccatgtgaatttttttatccaaaaagaaccccgttttcctgcctacctacctcatccttaaaaaatttttaaatctatttccaaaggaaattatgtaaatttgtaaatagagcatttctgtagaatttttttggaaacgatgtctcact

SEQ ID NO: 37630 - DNA, 601 bp, Human
cagggaataggaaatcaggttttaaaaagaaaaaaccttggttcaaaagacaagtgttaacatgaagtcaaaaatgctgacgaaacactttaaaacacaaaatccggggccatcgccgtgtctgagtgtgtctggcctcactcaccatgaagctgcaagtactgtacacagctaaacaaaacaccactcacaattccatcatctcaatgtttaaaaaataaggcaaatctcagtattttccccctaaaaatcctgactttgtcagtcaacgggaaacaacacatctgcccaaggccccccratgaggtcccccatgggagtcacaacggggggatgatgttcctgctgggggccctctgggtgtcagagctaaaggggtgtgtgattttttttttcttttttgaggcggagtctcactctgtcgcccaggctggagtgcagtggcacgatcttggctcactgcaagctccacctcccgggttcacgccattctcctgcctcagcctcccgagtagctgggactacaggcgcccgccaccatgcctggctaattttttgtatttttagtagagacggagtttcaccgtgttagccaggatgg

SEQ ID NO: 37631 - DNA, 601 bp, Human
ggtgggcgggacgacgggagcggggacacacccaccggcggtcacgggcagcggagtgtttttggtgatctgcaagtgatgtacacagcataactttattctcccctctttccacaaagtaccattcaaaataatgtcattttctttcttaaaatacacatttgtcattgtaaatttacatcccgtcttattaaataagtggtactctgtgtaaagagcatgatttacaaaattattaaacattcaaaagtctttaagaaaaagctacatatcaaagaaagtgacgccagcagcacggccyggggacgtgcgacagacgcactgggctgcccggacgtgcccaccccactcacagcgcccagacggagatgggttcctagaaaacttggaaataaaacctcccccctccccggggaaaaagaattaaagagctataactaaaaatcagaataagttaagttttgaacaatatacaaacatgtacagcttatcaacactatggacaagacccgcgctggcggccgggccgtcagtcaatgtcactgaggtcgctggtcggctccccgtggacgcggctcaggtggttcatggcgcggtcaaa

SEQ ID NO: 37632 - DNA, 601 bp, Human
agctttcagagcagaacactgttccctgactccattccctgacagttcccaacctcagaggagctcgcaccgtcttctggttgctagggaccttcaaggtcctccaactcaggcttctatccccttcaaaaactccttctataatttaaacactcctaggaggagttctccacacttactatattttggccatttgagctctttctggcctggaaagaaagtcaacttccttatcatttcaaccccactggtcctgaatctcaggacagcgttgattcctcctcagcaatttgaagacagmtaggacgtctccttttatatttcttgagccaggggaaaatgttatctaaatgcacccaccgagtcaattcaatcagttttcccttctctcaaggacctcaatcctgtgctccctgctgtccaacatctgaaaatgatcatttggtatattttttctggttttccagttgttcaggaagagaggacaattctggaccctatttttcatggcaacaagcagaagtctcttagcattgttttaatccctccattttcttgtcatcgtacaaatgatttgaacatcaagtgaatttgtctttga

SEQ ID NO: 37633 - DNA, 601 bp, Human
gctcactttactgtacaagctctcaagttgcatgcagaagagcatctgagacccagcacagcctgcccatggtgacaggccggaaagggaggggagcgattttcctctcacgccgtggaactctcttgatttctaaaccttaacagcatgacaccaagtagccacagatttttgtttttaattgtcaaagagaagcatgaggctttttagtaaatctgaaccctccccaggatgtgtttccttcttctgacaaagccttcccaatacacatccatctccccagccagaggggttttctgasctctctccctgctgggtcctgttcacaaatttcttgaagaaaatattcactgcattctaacggcagtatttatgctaaagagtttaaaagttgctgaagctccgaggctatgatcttggaaaacaattttaataattctttagagcaggagtttgcaaactttttttgtaaagggccagaaagtacatattttaggctttgtaagccagatactctctgttgtaactactaactctgctgttgttgccccagatcaaccacagacaatatgttaatgagtggtcatggctgtgttccaat

SEQ ID NO: 37634 - DNA, 601 bp, Human
agccgctggtggacctcatctacttctggaaggatggtgcaccctggtgcggccgccattactgcgagagtctgcggccccggtgctccggctgcgatgaggtgggagatagccgcgagatgggttagggggcttgagggacactgctgagggtaaaagcccagaggccaagaggagcatggctttgtggatgatgtgttctacagattgggaaactgaagtcaggcctcactgcatgctctcaaccttcattttctcatctgcaaaatgaggcagacaaccatgggattgttgggagggstcagacacagtgccggtgaatcttgtccttggcataatgcctagcacttagtaagtactcagaacatagcaggatgaaccaggaggcattgcccacgttcaaacctgtatctgcatctcttattattattatcatgtggttacctaactccggagcctcagctgagtctcagttttactacttataaaatagggatgagaccagcgcccatcccatagagtggctatgaggatagatgagataatgcatgaaaatgcttgccacagggcctgacctaggaacttataaatggtagctgct

SEQ ID NO: 37635 - DNA, 601 bp, Human
attggccattggcagtttatctatccttaagctttcttcaccagggtgtgtaatcccaccttggaactaaactttagatttgacccaaagagtatcacagatacctagataagtaaaacctgcctgtagtggaggattttttttattccatctgagaagctaagatgcaaccacaaccttcaccaaatattatccttactgcctcaaatttatgccagatttttccactaaggctttaaaaggtcaaaacaagaataggatgggatgaaccaccaccctataacttgtcctagatataccrtctctacctagggacagaaactgagtcatgcatttctcctgctcccctccccagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtg

SEQ ID NO: 37636 - DNA, 601 bp, Human
ggcagtttatctatccttaagctttcttcaccagggtgtgtaatcccaccttggaactaaactttagatttgacccaaagagtatcacagatacctagataagtaaaacctgcctgtagtggaggattttttttattccatctgagaagctaagatgcaaccacaaccttcaccaaatattatccttactgcctcaaatttatgccagatttttccactaaggctttaaaaggtcaaaacaagaataggatgggatgaaccaccaccctataacttgtcctagatataccgtctctacctrgggacagaaactgagtcatgcatttctcctgctcccctccccagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagca

SEQ ID NO: 37637 - DNA, 601 bp, Human
accgtctctacctagggacagaaactgagtcatgcatttctcctgctcccctccccagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgaygtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttg

SEQ ID NO: 37638 - DNA, 601 bp, Human
ttcctttcttccttaacgtccaccaaatatgagtcaaaggatctttttacaaagctatggttcacagcagagccacattcctccagaactcgtgtagagttgcttgtctccaaagccccacctgggtttccaccatatgctttcggtcaacgacactcaccacagcatcctctctggcggttgtgatctcccgccctggtcatgacactacgcgaccccgctggctcttctgcggctgctatcgctgctgctgctctcgctgaggtgcttgttaacaggagtgcaaggaactggagatagsacctctaaaaacacaacagccttgggcaaaaagactacaacgacgactttggcaaagaacaaaagaaaaggggcccagggattttcttttttccttctttccaaacttagctaacactgtagctgaagttggaaaggcaaagccttatggaagcggtttgggaggctcagcaggtcgtccgagcctagcggacgccctgagccagctctctcgccgccgccgccgccgccgccgtgggccgggcccagctcttataccgagtcgggggcggagctccctgcgacctccgactggggccgc

SEQ ID NO: 37639 - DNA, 601 bp, Human
gttttgtttcttttttacacaaggcaatccaaactgcccaatctactccatccgtgcctgtgtgcaaaccccttttcccacaccctgaatttcctttcttccttaacgtccaccaaatatgagtcaaaggatctttttacaaagctatggttcacagcagagccacattcctccagaactcgtgtagagttgcttgtctccaaagccccacctgggtttccaccatatgctttcggtcaacgacactcaccacagcatcctctctggcggttgtgatctcccgccctggtcatgacactasgcgaccccgctggctcttctgcggctgctatcgctgctgctgctctcgctgaggtgcttgttaacaggagtgcaaggaactggagatagcacctctaaaaacacaacagccttgggcaaaaagactacaacgacgactttggcaaagaacaaaagaaaaggggcccagggattttcttttttccttctttccaaacttagctaacactgtagctgaagttggaaaggcaaagccttatggaagcggtttgggaggctcagcaggtcgtccgagcctagcggacgccctgagccagctctc

SEQ ID NO: 37640 - DNA, 601 bp, Human
ttaataccattcactaaattcagttattgacctagtcaataactgcccaacttcacatttcacatacagtgaagaaactcttgtttcagcattcttttttgggttggttggtttgtttgttttgtttcttttttacacaaggcaatccaaactgcccaatctactccatccgtgcctgtgtgcaaaccccttttcccacaccctgaatttcctttcttccttaacgtccaccaaatatgagtcaaaggatctttttacaaagctatggttcacagcagagccacattcctccagaactcgkgtagagttgcttgtctccaaagccccacctgggtttccaccatatgctttcggtcaacgacactcaccacagcatcctctctggcggttgtgatctcccgccctggtcatgacactacgcgaccccgctggctcttctgcggctgctatcgctgctgctgctctcgctgaggtgcttgttaacaggagtgcaaggaactggagatagcacctctaaaaacacaacagccttgggcaaaaagactacaacgacgactttggcaaagaacaaaagaaaaggggcccagggattttctttttt

SEQ ID NO: 37641 - DNA, 601 bp, Human
tcggccaaggatcctgcaaagacacaggcggggtgagaaaaagcgatggtagtcacttaatgagctgagggcagaatgcttatccatttgatctcattagaacatgattattaaaaactactttgcaggacaaaccacgtacattttatcaagttacctatgaaccgatgtatttcgttcacttaataccattcactaaattcagttattgacctagtcaataactgcccaacttcacatttcacatacagtgaagaaactcttgtttcagcattcttttttgggttggttggtttgtttgttttgtttcttttttacacaaggcaatccaaactgcccaatctactccatccgtgcctgtgtgcaaaccccttttcccacaccctgaatttcctttcttccttaacgtccaccaaatatgagtcaaaggatctttttacaaagctatggttcacagcagagccacattcctccagaactcgtgtagagttgcttgtctccaaagccccacctgggtttccaccatatgctttcggtcaacgacactcaccacagcatcctctctggcggttgtgatctcccgccctggtcatgacactac

SEQ ID NO: 37642 - DNA, 601 bp, Human
cctcctggaacaaccacggtgccactggttttctggcaaatctgacctcctaacctattaaccaaaggtcacataaaccataatcagaacttggaagagaggcatcttcttcctctaagagcaaggccagaccacaggctgagaatttcagatactatttccatcacatgttattaatacttaatatttactgaattaaactgggggaacaaactattgctttttatttattaagggttgtttcactaggtttctacttagcatcatcagctgttggaattaaaacaaactcacaccaatyccactttgtttacatgtatttgcagagtcacccctgtgtaagcctctggtaagataggagcttgcttttctaaaatgtcatctataaactgctatttcttagagaaccaataatgtagcttaacaatttctcaaaggcattgggtatagatttcctcttccagtggtttccatccatgtcttaaggatgatccaatataagtttccaatttaaaaggaaaataacattcaaaaaatttactctcaaaattctttccattctttttaaatacatatgagccatggacagaatatagccaga

SEQ ID NO: 37643 - DNA, 601 bp, Human
ctaaaccttatatgattgtagttgctgctgtttgtttaatccaactttctcatgagaacttcctttgcttgacttactgtaaagttgggataagcatgtgtcacctttcttgtgggacttttaatgaacatgacaaaatatcctcctggaacaaccacggtgccactggttttctggcaaatctgacctcctaacctattaaccaaaggtcacataaaccataatcagaacttggaagagaggcatcttcttcctctaagagcaaggccagaccacaggctgagaatttcagatactattyccatcacatgttattaatacttaatatttactgaattaaactgggggaacaaactattgctttttatttattaagggttgtttcactaggtttctacttagcatcatcagctgttggaattaaaacaaactcacaccaattccactttgtttacatgtatttgcagagtcacccctgtgtaagcctctggtaagataggagcttgcttttctaaaatgtcatctataaactgctatttcttagagaaccaataatgtagcttaacaatttctcaaaggcattgggtatagatttcctctt

SEQ ID NO: 37644 - DNA, 601 bp, Human
tcccaaagtgctaggattacaggcatgagccactgcacctagccaggatccacttcttacactatattgtattttgataatatagagtaaaatgcattgatccattggcagatagaaatgaagtcagaaataaaaggcattcaaccccacacaaaactaacctgaggcaaccttctactctaatgcccctacgttcagtgcataagaaatcatgacttggcagggtgggacggaaaatgcatatatatataatacatatacacacacacataatacagaaacataaatgttttgttgtaayaaaatcaggcagagtgccacacaagagaaaaaacataaaaagcataattacctagtgttagagacattcctcttttgcactcctttgcagcggaaaggagtaaaaatccactaaaccttatatgattgtagttgctgctgtttgtttaatccaactttctcatgagaacttcctttgcttgacttactgtaaagttgggataagcatgtgtcacctttcttgtgggacttttaatgaacatgacaaaatatcctcctggaacaaccacggtgccactggttttctggcaaatctgacctc

SEQ ID NO: 37645 - DNA, 601 bp, Human
tatgttgcccaggctggtctcagactcctgggctcaaggaatcctcctgcctcccaaagtgctaggattacaggcatgagccactgcacctagccaggatccacttcttacactatattgtattttgataatatagagtaaaatgcattgatccattggcagatagaaatgaagtcagaaataaaaggcattcaaccccacacaaaactaacctgaggcaaccttctactctaatgcccctacgttcagtgcataagaaatcatgacttggcagggtgggacggaaaatgcatatatatawaatacatatacacacacacataatacagaaacataaatgttttgttgtaacaaaatcaggcagagtgccacacaagagaaaaaacataaaaagcataattacctagtgttagagacattcctcttttgcactcctttgcagcggaaaggagtaaaaatccactaaaccttatatgattgtagttgctgctgtttgtttaatccaactttctcatgagaacttcctttgcttgacttactgtaaagttgggataagcatgtgtcacctttcttgtgggacttttaatgaacatgacaaaat

SEQ ID NO: 37646 - DNA, 601 bp, Human
catggtcctcaatccacttaatacttactaagtggctactatgtacccgacatttgcaagcactagagcttcagcagcgcacaaaaggttttcatgcagctcacattccagtgagcacagaccaaaagcaaatctagcacagggcacgtgctgctatgaggaaatataaagtaggatggagctggtggcaacaaaggcctccatgagcaaagtgagcctctgggaaacgagggctggagaaatgcagacatattggggtttaaatggagagagtttgtaagatcatgttatcagatataascaactggcccctctttttcactgtcttacactgtcatctttttgttattagatatcttttttaaagcccatactaaattgtattataagctccttgacaatagtatccacttttttttttttttttttgagacagggtcttattctgttgtccaggctggagtgtagtggtgtgatcacagctcactgcagcttcaaactcctgggttcaagcaactcttccacctcagcctctcagtagctgggactacaggtgtgtctcatgacacctggctaatttttaaatttttttttgcagaga

SEQ ID NO: 37647 - DNA, 601 bp, Human
tggatgacctatttatgtgtccatgtacccccacgggactgagagctgaaggcaaacctaataactgtcaatgaatgatcatggtcctcaatccacttaatacttactaagtggctactatgtacccgacatttgcaagcactagagcttcagcagcgcacaaaaggttttcatgcagctcacattccagtgagcacagaccaaaagcaaatctagcacagggcacgtgctgctatgaggaaatataaagtaggatggagctggtggcaacaaaggcctccatgagcaaagtgagcctctkggaaacgagggctggagaaatgcagacatattggggtttaaatggagagagtttgtaagatcatgttatcagatataagcaactggcccctctttttcactgtcttacactgtcatctttttgttattagatatcttttttaaagcccatactaaattgtattataagctccttgacaatagtatccacttttttttttttttttttgagacagggtcttattctgttgtccaggctggagtgtagtggtgtgatcacagctcactgcagcttcaaactcctgggttcaagcaactcttc

SEQ ID NO: 37648 - DNA, 601 bp, Human
ctgaaaagcaaatttagatttgattaggataaaatgggatagggagaggggagatactttattctaatctccattcctctgaatagctcccaaggaaaagacaaaaatacacacatgtcccaaatgataggttgcctctgtcagcgagttttctctttcttaacatacaggttaagaaacacttttctaatactgttgtttctttctttttttcttactcttattgtattttttaattgtcttagagtcctctaaagcaagacatcaagacaaatgctattaaagttttgaatcttgcttwttcttgcatgccataccacctctttgatggaaagaaagaaattgctcacattaccccaatttccaacgggcttaggctttaagaagcaacagattctatgtttacaaaaagcccaatatttgggtaaagtctatgtaaatattgaccaagtgcccatccttccttatttccatttcttgccttcccaccaattctcactaaacttggatgacctatttatgtgtccatgtacccccacgggactgagagctgaaggcaaacctaataactgtcaatgaatgatcatggtcctcaatccac

SEQ ID NO: 37649 - DNA, 601 bp, Human
tacaaaaaaacttcctgtagaccagtagttctcaactagagatgactttgcttctcctacccccaccccacctccccggggatcatttggcaatgtctggagtaattttgagttgtcacaacagcaggggggtggagctgttacttaatctttaacctgaaaagcaaatttagatttgattaggataaaatgggatagggagaggggagatactttattctaatctccattcctctgaatagctcccaaggaaaagacaaaaatacacacatgtcccaaatgataggttgcctctgtcagmgagttttctctttcttaacatacaggttaagaaacacttttctaatactgttgtttctttctttttttcttactcttattgtattttttaattgtcttagagtcctctaaagcaagacatcaagacaaatgctattaaagttttgaatcttgctttttcttgcatgccataccacctctttgatggaaagaaagaaattgctcacattaccccaatttccaacgggcttaggctttaagaagcaacagattctatgtttacaaaaagcccaatatttgggtaaagtctatgtaaatattg

SEQ ID NO: 37650 - DNA, 601 bp, Human
cattcaaaacttaaattgatgcatgttagcaatcatttacaaaaaaacttcctgtagaccagtagttctcaactagagatgactttgcttctcctacccccaccccacctccccggggatcatttggcaatgtctggagtaattttgagttgtcacaacagcaggggggtggagctgttacttaatctttaacctgaaaagcaaatttagatttgattaggataaaatgggatagggagaggggagatactttattctaatctccattcctctgaatagctcccaaggaaaagacaaaaayacacacatgtcccaaatgataggttgcctctgtcagcgagttttctctttcttaacatacaggttaagaaacacttttctaatactgttgtttctttctttttttcttactcttattgtattttttaattgtcttagagtcctctaaagcaagacatcaagacaaatgctattaaagttttgaatcttgctttttcttgcatgccataccacctctttgatggaaagaaagaaattgctcacattaccccaatttccaacgggcttaggctttaagaagcaacagattctatgtttacaa

SEQ ID NO: 37651 - DNA, 601 bp, Human
cagaaatacttctactcctagttcttcccaaagtctgttaacatcttcacgaaaaaatccatgtattagaagcaaatactatcctggtatgtcaaataattttaaaaatttaatgaagccaagataataattttatacattcaaaacttaaattgatgcatgttagcaatcatttacaaaaaaacttcctgtagaccagtagttctcaactagagatgactttgcttctcctacccccaccccacctccccggggatcatttggcaatgtctggagtaattttgagttgtcacaacagcargggggtggagctgttacttaatctttaacctgaaaagcaaatttagatttgattaggataaaatgggatagggagaggggagatactttattctaatctccattcctctgaatagctcccaaggaaaagacaaaaatacacacatgtcccaaatgataggttgcctctgtcagcgagttttctctttcttaacatacaggttaagaaacacttttctaatactgttgtttctttctttttttcttactcttattgtattttttaattgtcttagagtcctctaaagcaagacatcaagac

SEQ ID NO: 37652 - DNA, 601 bp, Human
ccaaattccaggcctcatagatttgaccctacagaaatacttctactcctagttcttcccaaagtctgttaacatcttcacgaaaaaatccatgtattagaagcaaatactatcctggtatgtcaaataattttaaaaatttaatgaagccaagataataattttatacattcaaaacttaaattgatgcatgttagcaatcatttacaaaaaaacttcctgtagaccagtagttctcaactagagatgactttgcttctcctacccccaccccacctccccggggatcatttggcaatgyctggagtaattttgagttgtcacaacagcaggggggtggagctgttacttaatctttaacctgaaaagcaaatttagatttgattaggataaaatgggatagggagaggggagatactttattctaatctccattcctctgaatagctcccaaggaaaagacaaaaatacacacatgtcccaaatgataggttgcctctgtcagcgagttttctctttcttaacatacaggttaagaaacacttttctaatactgttgtttctttctttttttcttactcttattgtattttttaattgt

SEQ ID NO: 37653 - DNA, 601 bp, Human
atttgtaaaatgatgggaatggaccatatgatctccaagttttctttcatgtctaatatcctaaaacctatgagatttcataaagtcataattcgaaagtcataaaacagcagagcgattggaaagaggagtagtaacagcaaattctggcactgcataaacagtgatgtcagaaataaacttaaatgcctaagtaagtagttacgttaacattttaatacagatgagttttgaaagggggaaaaagctacttatttcttcacacaaactccggagaatatagggaattttggagttcatyaccgtgaaatgtgatttaacagaaacttttaagtgaattaggcaaattaatgtcttaaaaaatctacagtggaccttattatgagattttaggctccatccctgacttctgaaattaacattaaggaggacaaccatgttccatcataacttatctctgggaatccctataggaaaccaaattccaggcctcatagatttgaccctacagaaatacttctactcctagttcttcccaaagtctgttaacatcttcacgaaaaaatccatgtattagaagcaaatactatcctggtatgtc

SEQ ID NO: 37654 - DNA, 601 bp, Human
ccaagatggctttttgagacaaaaacgtgttctcctgtgtgtcaggtttctcctggggcctggaatttgcctatcttgattgcagaggcataaagtagtttgctattgaaccagaaatcaattacagtacagttcacaaacattagtataccttgagcatcaagaaaaagccagttttccaatttgtaaaatgatgggaatggaccatatgatctccaagttttctttcatgtctaatatcctaaaacctatgagatttcataaagtcataattcgaaagtcataaaacagcagagcgatyggaaagaggagtagtaacagcaaattctggcactgcataaacagtgatgtcagaaataaacttaaatgcctaagtaagtagttacgttaacattttaatacagatgagttttgaaagggggaaaaagctacttatttcttcacacaaactccggagaatatagggaattttggagttcattaccgtgaaatgtgatttaacagaaacttttaagtgaattaggcaaattaatgtcttaaaaaatctacagtggaccttattatgagattttaggctccatccctgacttctgaaattaac

SEQ ID NO: 37655 - DNA, 601 bp, Human
taagtaaacttgaaaaggcatgatattaatgaaccgcacattctctttttcattctagaaacaaaatgcagtttccagacccaagatggctttttgagacaaaaacgtgttctcctgtgtgtcaggtttctcctggggcctggaatttgcctatcttgattgcagaggcataaagtagtttgctattgaaccagaaatcaattacagtacagttcacaaacattagtataccttgagcatcaagaaaaagccagttttccaatttgtaaaatgatgggaatggaccatatgatctccaagktttctttcatgtctaatatcctaaaacctatgagatttcataaagtcataattcgaaagtcataaaacagcagagcgattggaaagaggagtagtaacagcaaattctggcactgcataaacagtgatgtcagaaataaacttaaatgcctaagtaagtagttacgttaacattttaatacagatgagttttgaaagggggaaaaagctacttatttcttcacacaaactccggagaatatagggaattttggagttcattaccgtgaaatgtgatttaacagaaacttttaagtgaatt

SEQ ID NO: 37656 - DNA, 601 bp, Human
gaaaagagaaaatgttttgatggaatatttttcgtttctagtctattgtactcaggaagttgcttccttatcaaaagggcacttcctggctacattatgagactttcaaagtcagtaattactcttagattgaatactgctcagatgttaaaacgttcatcccagcacaatggaaaatattcttgcccaattattaagtaaacttgaaaaggcatgatattaatgaaccgcacattctctttttcattctagaaacaaaatgcagtttccagacccaagatggctttttgagacaaaaacrtgttctcctgtgtgtcaggtttctcctggggcctggaatttgcctatcttgattgcagaggcataaagtagtttgctattgaaccagaaatcaattacagtacagttcacaaacattagtataccttgagcatcaagaaaaagccagttttccaatttgtaaaatgatgggaatggaccatatgatctccaagttttctttcatgtctaatatcctaaaacctatgagatttcataaagtcataattcgaaagtcataaaacagcagagcgattggaaagaggagtagtaacagcaaatt

SEQ ID NO: 37657 - DNA, 601 bp, Human
ggttgacattcccaaacagaagtaacaattattattggaggaacgcaattatgactgactaatatagatatggataacatttattaaatagcacaaacaaagtataggtcactaaaaagctgaaaacaaacaactgaattctatagtaaactcttagaaatgccattagaaaccaataggacaaaatttaaattcaaacaatacttaatgagtgcctgttgtgggcaaaacaacaacaaaacaaactataggggatattacagtagacacagaaatcaatattaaaaggtcacactggccaaaaaaaaaaatagcttcaaagcattttcatcctttaccactaccagatattcaattttctgccatcaagaatctcattgagaacttacgagaacccatccatggtacatggtcagaagctcatgtttatgtaagaaaaccatcatcaggatgattccacacaggatgactgaaacattctgtaccaccagcgaggtctgggccactgtgcagaggaagagagaaagtgtacattacatcaaaatgtctcagtgagactgttcttatccacacataattgttctactataatacattaata

SEQ ID NO: 37658 - DNA, 601 bp, Human
cccaatgaacaactaagatggtaagcttcttaaaaactatattctgtcctctatttctttggtatttgtaacagcaattatattacattgtacataatgtaataaaattatagattataactttaagatggaagaaattaacttctagagtctctcctacaattgtttccatttgatttagagaaaaataacatccatatgattgataagcaccagtaataacattcataggtatgaccagtaaaatctcatgtcagatttgcactgttctaagtataaacatttagaaagttgattgaattttttttttaaaaaaaaaaagaggaaagaaaagttattccatttgccaagtttgtgtaggataaaagagaagttagctatcctataagttaacttcgtaacagtgagataaatcagcactaaaactgacaataaggtaagaaaaaaagtatgctttcaatttatcattcttaaaaaatacccagaacaaaaatacaaggcttacagcctcatttatcaccaccgatttaaagtgaatcctaacatgctcatttcattaaaagagaaagccaaattacttgctagtttgcttctgtcttct

SEQ ID NO: 37659 - DNA, 601 bp, Human
aacatcactatgtactccataataagcacaattatgtgtcagtataaaaaattaattaaaataaaataaaaccaaaagttttaggacaaaaagaaagtgaagaaagtgatctactttttcacttcctgtctcacagaacagagtgaaaattagtgagacaagtcttaagcaatcatttgggtcaccttaacagaaaaacaatacgtgacgaagaagtacattaacagaagattgcctttattccttctgtaattcttcctggtcctcaattgctttccaattagccctatgagtatatatygcatatatgataacaggagaactttgacatatttcacctttcacttgagaggcaaaggcagccttcattgatcttacacttgactgccaccgcagaggtttcactaccatctgcctcccactaactaataagtttccaactcatatgccaacagagaagtgtggaatttatccaaataactcaataattggaatccaaaaagcaagtaactaaagaaaacatatatttgaatcttaaagtcccagaatgacaacaacaaattattttagttaaaattatttcttaccctttcactacttc

SEQ ID NO: 37660 - DNA, 601 bp, Human
gcctaagactgagattatgggaggagagaatttagtggtgataacaaagtctagagtttgactacgggaatgtattcctgagtcagagtgcaggacaaaatcaataaagaggaagttaaaaaaatgtccaacacaaagaaatgatacatgtttgagatgatggagatgtatctccatctcatctcatcacaacatcactatgtactccataataagcacaattatgtgtcagtataaaaaattaattaaaataaaataaaaccaaaagttttaggacaaaaagaaagtgaagaaagtgatstactttttcacttcctgtctcacagaacagagtgaaaattagtgagacaagtcttaagcaatcatttgggtcaccttaacagaaaaacaatacgtgacgaagaagtacattaacagaagattgcctttattccttctgtaattcttcctggtcctcaattgctttccaattagccctatgagtatatattgcatatatgataacaggagaactttgacatatttcacctttcacttgagaggcaaaggcagccttcattgatcttacacttgactgccaccgcagaggtttcactaccat

SEQ ID NO: 37661 - DNA, 601 bp, Human
ctaaccccaccagattcaacccggagtttttccctagatcctcaaaagcctgctcttgcctcgtctaccaaagcgatatatttaacctcatctggcccccactggtaataaaacctgatacaaattcaaaatagttttgatcttcaccaacatttaaggtctgaacatgagaacaaaaggagagatcattgtgttcagtttacctttgtgtaaattcagctgtttcaattcagtttcctcttctttaagaccagctttcacagctagagctggggttttctggtaaaccttccagagcagracgtactccacgcacatggataccaagttccatcccgaaataaagccacagccgatgactggggagccaaatgtcataatctggccaacagccatgggggctaagatgttggttaactggtcaatccttcgtattgtggcattcatatctagagaggcaggtgaaagaggcaggtaagtgtgcaaacccatcaaagagagactgcccatttacacaatacaaagctgtaaaccaagagtatagattcctaaaatgtggttttctaaaagtacatttgtaagaaagacattttgttggaaa

SEQ ID NO: 37662 - DNA, 601 bp, Human
ccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccytcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagcctccccatcttatggatgatgaaaccgaggcccaggaggcacaatggaagagctcctggtctctggagcgccttatgttggtggggatgtcttacgtcttcactttttagcaacacatcattcacgggcaaaacct

SEQ ID NO: 37663 - DNA, 601 bp, Human
gccagtactccactgggaagaccaccttcatcaggtgagccggcccagggtcctggcagcccaccccggagcccagcgcctagtccctccggtcactcctggtgctccatcccagacaggggaccaatgggaagccttcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagyctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcaggcctgggaacggaggtggcctggggatgctacttgtcctccttttatcatttccttctctaaagcagagctcctgtgtatatatcttgga

SEQ ID NO: 37664 - DNA, 601 bp, Human
cccttcccatcctacccaatacctgtccactctacttggcccttggctgtggtggtcaacctgaagtattcaagtgtaaagccattcccagcctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcrggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatggaagggatattggcattgtctcatccagttgctgagtttgcaggtgagataaccgaggcgcagagaagttaaatgaattgtgcagagccatctaaagagtgggcagc

SEQ ID NO: 37665 - DNA, 601 bp, Human
acccctgatctaagccatgcttcttgttttattaagcacccattgctgccaaaggcacttcagagctgcctgggttgcctgcagagtttcctttgtgagccctggcctccacttggcccattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagsgtctcggctataggaggttcccagtagacattttgcagaatgggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagct

SEQ ID NO: 37666 - DNA, 601 bp, Human
cattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagcgtctcggctataggaggttcccagtagacattttgcagaatgggagggaagatggggagaggtgaggatccccaagcagcagacaggtttgagcgccttttgtctgagacactctccyggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagcgctgtaggaggggtcataccacagggaaccctccagaaccaaatcatgtacttttcttctttctcataaaatcca

SEQ ID NO: 37667 - DNA, 601 bp, Human
ggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagygctgtaggaggggtcataccacagggaaccctccagaaccaaatcatgtacttttcttctttctcataaaatccagtaaacagttgtttttaattggaaaatatagaaaagaataaatttaaagaagaaaaaaagtcacccataatcccatgacttaggagaagctattttaatttacatataaaatatatttatatataaagcatataatttatatataaatatatttccagtatttgtagctattttatagcacagttgagatcatgctatacatataattttgtatgctggcttgtt

SEQ ID NO: 37668 - DNA, 601 bp, Human
taatcccatgacttaggagaagctattttaatttacatataaaatatatttatatataaagcatataatttatatataaatatatttccagtatttgtagctattttatagcacagttgagatcatgctatacatataattttgtatgctggcttgtttatttttgtttttgtttttgagatggagtctcactgtgtcacccaggctggagtacaatggcacaatctcggctcagtgcaacctccgcctcctgtgttcaagcagttctcctgcctcagcctcccaagtagctggggttacrggcacccgccaacacgcctggccaatttttgtattttaagtagagatggggttttgccatgttaggcagactggtcttgaactcctgacctcaggggatccacccacctcagcctcccaaagtgctggggattacagacgtgaaccactgcgtctggccagtttttcttacttatagcatgaacatttcctatgttataagcgttatttgtcagcattatttttaacaactgcatactatttcactatttgtatatacaattattcattcaactaatgaatagcattgtttttaacagct

SEQ ID NO: 37669 - DNA, 601 bp, Human
tttttaacaactgcatactatttcactatttgtatatacaattattcattcaactaatgaatagcattgtttttaacagctgcatactattccattgtgtgtatatacgattcttcacttaatctacttctcttggatgttttaggctatttctaattttttgttattgtagaataattctgaatatctctgtgtataatattttttcctatattgtgtgtgtgtgttttttttgtttgtttttgtttttgtttttttgagattcccagaagtggaattgctaggccaaaggttgggcagrgttttgtttaaaatattttttaactttaaaatttttgtactaagagtcatattttgcagttgttttccgagagggtgagttgacactgcatcccttccccattgcgagtaaggctgctctggggtggataagtgcgtccatgcctaggtctcagaaggcctcctcctctcccttctcccatccctgcttcttgccttgattcttgtctccatgccaggcctgaacctgtgaggggccttttcctcagaaacaaagatttgcctctttattcccccagttcttggcgttttgcccctgagg

SEQ ID NO: 37670 - DNA, 601 bp, Human
ctcctctcccttctcccatccctgcttcttgccttgattcttgtctccatgccaggcctgaacctgtgaggggccttttcctcagaaacaaagatttgcctctttattcccccagttcttggcgttttgcccctgagggtccatccactttcagtaatatgtgcttgccacagcgtctatttcttgtctgaggaagaacacacagaaaaggacattcttttaataactagttaatgtgctgtgatctctgcctgaaataacttccccggcctaaggcccggcaacacagagtaataaaatraacagtaaattggcttggcggctgccctctccaacacaggctgcctctttggagtacagtagctctgtgtccctctggccctggcagcctttcctcctgcctctgctattcttctccctttgctatttctctgcccggcatgcagccttgaatccctccttccttggaccatctggcccctggtcactccttctcgctgcctacttctgtggccccttattctgcaggtagtggaggtgagtagctggctgctccaggggctgaggaaggcctgagtacttccatgggccatgagggagg

SEQ ID NO: 37671 - DNA, 601 bp, Human
ggccatgagggaggcctccctggaccttggcagagctgagagagaggctctagtggattggctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggcygcaccagctctcatcaccaccctgacatccccaccccaggcattacagcgccactgcgccgggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaag

SEQ ID NO: 37672 - DNA, 601 bp, Human
ctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggccgcaccagctctcatcaccaccctgacatccccaccccaggcattacagcgccactgcgccrggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaagcagaaggccttaggccagaggaactgtgtccgcgtgcctcggcctggcttaggggctgcct

SEQ ID NO: 37673 - DNA, 601 bp, Human
gtggggagggggaggcagaaccagtttagcaccagctgtgctccaggcaccgcgcatggggctttatcatttcctctcctctctcgagctgactctctaacaggagacttagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggcygagggtgctttcgacagggccaattatagctgctccagggaacacggagctgactcatgcctcaacttggccgtggagagtctcccatccactttctcgcttgtgtctgtgggatgcgttacagtctccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatct

SEQ ID NO: 37674 - DNA, 601 bp, Human
tagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggctgagggtgctttcgacagggccaattatagctgctccagggaacacggagctgactcatgcctcaacttggccgtggagagtctcccatccactttctcgcttgtgtctrtgggatgcgttacagtctccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatctgtatcgcttcccataaagaatcagtgcatgagattcctcaatagatttttcctttctggacacagtggtggctttgttacaggggcacctgctgctgtaagccataccc

SEQ ID NO: 37675 - DNA, 601 bp, Human
aacctgactttaactaccatggaactgcagagtaaattcacagctcagaacgctgctcaaaggcacaaatgggatgttgatgagtgggaggaagccctggcaagcctccctggccaccacccctctgtgcagaccaggcctgctgctgcagtccacctgtgcacattacaacatccttcatggttacaaagcatgcacacgttgtggggaggggtgtgtgtgtgggtgttgggtacagaaggaaggcattgacagatagaaggtaactttttgacacctgtttaggtagtgcaggtaaaamaccaaacacatttaaaaacatagcacaattataatctttatctgggaatcccaccatatactattacattcgtaatgaaattgcctaatacccaagggcacaagggaggactcatttgctgaacatacctattttgccaggtactatacaaggcattttgaatgtagtctcttctttgaaagttggaattaaatggataatgacaagaaagatagaatgaaaggtgtgcaggttgcttctatgctaaaaaataagatcaggttgctgggtatggtggctcatgcctgtaatcccagcact

SEQ ID NO: 37676 - DNA, 601 bp, Human
tgaatgtagtctcttctttgaaagttggaattaaatggataatgacaagaaagatagaatgaaaggtgtgcaggttgcttctatgctaaaaaataagatcaggttgctgggtatggtggctcatgcctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagmatcacttgaacctgggaggcggaggttgcagtgagctgagatcatgccattgcactctagcctgggcaacaagagtgaaactccgtctcaaataataaataaataaataaataaataaaatcaggtcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttc

SEQ ID NO: 37677 - DNA, 601 bp, Human
cctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagaatcacttgaacctgggaggcggaggttgcagtgagctgagatcatgccattgcactctagcctgggcaacaagagtgaaactccgtctcaaataataaataaataaataaataaataaaatcagktcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttcagaggctgaggcaggagtctcacttgaacctgggaggtggaggttgtggtgagctaagaacacgccactacactccagcctgggcgacggaatgacactccatgtcagcaagataaataaataag

SEQ ID NO: 37678 - DNA, 601 bp, Human
tgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggtgagtgtggagggaacacaacactttcaggtgcwctcttttcttcttggggtatggggagtgaaagaacagtaggcagggtcttgggatgcttggtgcctagagtctcctgtcaatctttccatacctagattgtcccttgcttgctgagagtgtaactgagtcagttgtgagatgcagcagctgcaaatgctgggttgattcctccttatcagggagcagggaaggatacaacaatgactcaggtcacattcccctaccctgcacctacccctagtaaaagtggaggaggatgctccatatagttcccagtatttgcctaaatattcagtggc

SEQ ID NO: 37679 - DNA, 601 bp, Human
aagctggagtgcaatggcgcgatctcagctcatcgcaaactctgcctcccaggttcaagcaattctcctgcctcagcctcccgagtagctgggattacaggcatgtgccaccacgcccgactaattttgtgtttttttttttttttttttttttttagtagagacagggtttctccatgtttgtcaggctggtctcgaactcccaacctcaggtgattgacctgcctcagcctcccaaagtgctgggattacaggcgtgagccaccgtgcctggccccaaataatattttttataaacctmtgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacgctgagaaatcttgggaacttggcctggcagagagagaggcccaggcatggggcttggtttatgttgggaatgaagctgaggtccctttaggaagaatgaggaggtcgtggtggtaaggtgcagtggggcaggtgtcctggagtccaggggtgtctc

SEQ ID NO: 37680 - DNA, 601 bp, Human
ttttttttttttagtagagacagggtttctccatgtttgtcaggctggtctcgaactcccaacctcaggtgattgacctgcctcagcctcccaaagtgctgggattacaggcgtgagccaccgtgcctggccccaaataatattttttataaacctatgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacrctgagaaatcttgggaacttggcctggcagagagagaggcccaggcatggggcttggtttatgttgggaatgaagctgaggtccctttaggaagaatgaggaggtcgtggtggtaaggtgcagtggggcaggtgtcctggagtccaggggtgtctcttatacctggaactgagtaaggaggtcctggatgcccaaaatgctaaaatgcataaatggagggggtgggatgagcatgattcaggagaatgagtcgctggagctgaagagaagcagggatatctgagcaagggggtaggcaag

SEQ ID NO: 37681 - DNA, 601 bp, Human
caggcgtgagccaccgtgcctggccccaaataatattttttataaacctatgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacgctgagaaatcttgggaacttggcctggcagagagagaggcccaggcatggggcttggtttatgttgggaatgaagctgaggtccctttaggaagaatgaggaggtcrtggtggtaaggtgcagtggggcaggtgtcctggagtccaggggtgtctcttatacctggaactgagtaaggaggtcctggatgcccaaaatgctaaaatgcataaatggagggggtgggatgagcatgattcaggagaatgagtcgctggagctgaagagaagcagggatatctgagcaagggggtaggcaaggaatttgattttggacacattgagtttgcagtgttagtgagtcagctgaggagcatcgtcctatctgaaggcagagaggaggagctggaccccaggggagaggaggg

SEQ ID NO: 37682 - DNA, 601 bp, Human
cttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtgaggcagccccctgggaggtgggcagcttgggcaggggcccagagtttggggtcagctgcacgagctgagggttgctgcctccaacagccagtgcatcaygtgtgtgacaccaaggggcaggacagtgcgggagccatggttacaagctctcaggtcagatggccagattggaactgactccattgtttactgtctgtgggattcccagccttggcaaggcctttagtctctctgtgcctctgtttgcatctgtaaaatgaaggggttgttggaggataaagtgaaataaagagtctcaaagccctcatcacagtgtctggcaccttcagagatgctcagcaactgtcagctgctggtattgccttcagcagcagcaacatgaccacctcaccctgcctt

SEQ ID NO: 37683 - DNA, 601 bp, Human
tggggggctgacacctccagttaatgaccttctctagtcacagccaccacaggcttgacgtccccaccatctctggtgcagtgggatgggtcacctgaccaaggttctccaggctcttaaagtgctcgagtttacatctgaggtcccccttgtgagcaatctgggacacgagcttcggggaggcagaagtgcacacgggaactcgtcatctttgggtcctattgcaggtgcctatcttgggccagtggccatcacacatggtttcttacggttttccccaaagcactcatcagagggaggyatttttcatctgcctttttacagaagaaacagaggtctcagcattttctgagtgtagcattcacataggccacaagaagaaaagccaggagctgggcccaaaggtccaagcaggaaaccacaacattgactggatcctctgagcctccatttcctcatctgtaaactgaagctacaaaatcacgccttatacaggtgttgtgagcaccagtgagataatctttgcaaagcccttagcacaaagccagacagactatgcccttagtacacagtagcaaatcattaggtgggcagagggagg

SEQ ID NO: 37684 - DNA, 601 bp, Human
atctttgggtcctattgcaggtgcctatcttgggccagtggccatcacacatggtttcttacggttttccccaaagcactcatcagagggaggtatttttcatctgcctttttacagaagaaacagaggtctcagcattttctgagtgtagcattcacataggccacaagaagaaaagccaggagctgggcccaaaggtccaagcaggaaaccacaacattgactggatcctctgagcctccatttcctcatctgtaaactgaagctacaaaatcacgccttatacaggtgttgtgagcaycagtgagataatctttgcaaagcccttagcacaaagccagacagactatgcccttagtacacagtagcaaatcattaggtgggcagagggaggtgggtgctgagcacaaagcacccacccactgtacaatgtttgcaacttcttatgattctagaattaggaaattagaggccaggcacagtggctcacgcctgtaatcccagcagtttgggaagccgaggcgggcagatcacctgaggccaggagttcgagaccagcctggccaacatggcaaaacttgtaataaaactacaaaaaaat

SEQ ID NO: 37685 - DNA, 601 bp, Human
tttgtaattttagtagagacggggttttcaccatgttggccaggatggtctcgatctcttgacctcgtgatccgcctgcctcagcctcccaaagtgctgggattacaggcatgagccaccgcgcctagcctacaaactttttgactcttgttgtaacaattagcttaaaatgtacattgtatatctatacacaaatattttctttatatccttattctataagttttttctatttaaaaaaatttattttttacttttttatttttgtgtgtgctaaaaactaagatgcaaacacccatgstagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacactctaaaataacaataaaaagtacagtatagtaaatatttacataaaccagtaacatagccgttatcattatccggtattatgtactctatgg

SEQ ID NO: 37686 - DNA, 601 bp, Human
tttgtgtgtgctaaaaactaagatgcaaacacccatgctagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacactctaaaataacaataaaaagtacagtatagtaaatatttacataaaccagtaacrtagccgttatcattatccggtattatgtactctatggaaatgtgtgtgctagatttttataccactggcagcacagtaggtttgtttacaccagcatcaccacaaacacataatgcgttgtgttatgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaacca

SEQ ID NO: 37687 - DNA, 601 bp, Human
tgtgctaaaaactaagatgcaaacacccatgctagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacactctaaaataacaataaaaagtacagtatagtaaatatttacataaaccagtaacatagccrttatcattatccggtattatgtactctatggaaatgtgtgtgctagatttttataccactggcagcacagtaggtttgtttacaccagcatcaccacaaacacataatgcgttgtgttatgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaaccataattt

SEQ ID NO: 37688 - DNA, 601 bp, Human
gttatgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaaccataatttggggatgacctttggcttctgttatgatttggttttagtaccctgtgccctgtttggtttttgtttttgttttcactaagtggggatagaatgtgattttcctacctcagaagggygctgggggagtgaacgaggtaatgtagtgaaggcacttgcggtgattttcaagtacagtataacccttattaaagtagaggcccacatgacccagtctcagaggtacagcattcaagagacatgattcaatagccaaaactgacttaaagagaaatgtaatgatttcctctctggaatgacattgaaggggattgaaataaatagatcatgccaatacttgttaaatttccctttcttccccagcccctacaacccttctaccccctactgaaaaatcccatcatcagcccagtgggcct

SEQ ID NO: 37689 - DNA, 601 bp, Human
tcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccaca

SEQ ID NO: 37690 - DNA, 601 bp, Human
gacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccaygtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatc

SEQ ID NO: 37691 - DNA, 601 bp, Human
cctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcsctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgtt

SEQ ID NO: 37692 - DNA, 601 bp, Human
cggggcgctgcacccggcgccgccttacctggagtcaatgtccgtctttggcggagagctgcgggcggacgctttttattcggctcggtgggaacttgggagagccctgcgtccagctcgcattccgggcacggcgcggggactgcaggcgtgggggtacctggctcctagcagcctggctcatactcagccgtaaagtccccttcgctggtcccgaggacaggcatgaatcccggctccggaaggcggtcactactccctctgcctcccggctctctcgctctcgctctcgctgttgctsgctcgctctctccctctctcgcgggttcgctcgcctgcgctctcctcctccccgcgcgccagatcagtttgcagccgtggggtccgggagcgaggcggctggcgaatggagagggaagtccaagtgcgccgcggtctccgggcggggagcggcggaggccgggctacgccgggggagggacttagccggcgacggccgaaaatgaatgggggagcggcggccggggggcggggagggaggagctgaacgccggggttgcttccgaggagtgttttgtacatctttaggcggaggaggagg

SEQ ID NO: 37693 - DNA, 601 bp, Human
cggtggctcacacctgtaatcccaacactctgggaggccaagacgggcggatcacgaggtcaggagatcaagaccatcctgtcaacacggtgaaaccccgtctctactaaaaaaaaatataaaaaattagccgggcatggtggtgggcgcctgtagtcccagctgctcggcgggctgaggcaggagaatggcgtgaacccgggaggcggagcttgcagtgagccgagatcgcgccactactgcactccatcctaggcgacagagcgagactccgtctcaaaaaaaaaaaaaaaaaaaaaaagagatgactgacattggatcaaaaacagaatgcaggctttgtgcatggaaaacactcacttaaaaacttagctttatcacttactagctgtacttcttctgggtctcagcttccttatttataaaatggaggtaatatgacatgtgcagttttgagggctaaagacaatgtacaatgtctgctatatagcaaataactgttaagtagtggataatattattgtaggaatgaataaatttgcctaaccaatctctccaccacattccccacattatgaatcgggtcttcctacattgtatg

SEQ ID NO: 37694 - DNA, 601 bp, Human
gactaaggaaaatttctatgcctgttttcttgtgtgtttttcccttcaccccccttcataggagtattcacatgatgtattttattagtttaatagatttcaccaaaaatctggagatcccatggaaatctcttatttgttggccctcccatcacctctgcttctccattcccatagccttcccttcctctttcctcttcctaaagagtgaaacaaacacatttatttgtctcataggtgacaggttaagaagcatcttttagtatttgattatccccttgtgaacttacctgacatgtcraagagtttatcaaagcattttttctcaatgaacacagtggtcttagaaaaaaattacagtgaataaaattatttgcacctccttctttatagataaagaaatttatattcagacagaaaagtgagtttctcagtgtctcccactcatctagtgagtagcagaattgggccttaatctggattcccaagtttcttagccccattaagtaacaacaataatagtaagaacaagagtagtaacatagcaacaatttgttaagtgtcagacagtgtgctaagcactttcaatagatgattttat

SEQ ID NO: 37695 - DNA, 601 bp, Human
aattagctgggcatggtggcgcgcacctgtagtcccagctacttgggaggctgaggcaggagaatcgcttgaaaccgggaactggaggttgcagtgagccaagatcatgccattgcactccagcctgggtaacagagcgagtctccatctcaaaaagacaacaacaacaacaaaaacagacccaatagtgagacaagttttagacagcttggtcttgaggtagtggcaagaaatggcatgaaaaatccaagggccaaattaagtgcagaagacagtgcctaccataagaaatggtttcttgagtggcctctgcaatttctctgagaaattcctcctatggaggcagactgcacttctaggatacacgaaggaggattatcttctgacagagcttcaatatctcaattccacatcccatccagcgaggagagaaccatttggtgataatgaaaaccaggcctctgcagcactctgactccgatggcttcataaagatccatctctctgtgctgagttccctaacaacataatctcccaaatacaggcgattcttttcggataaactggccctttgtttgttggtctgatttatttctctcct

SEQ ID NO: 37696 - DNA, 601 bp, Human
agcagcatctcagttttctgtgtttcctcatccatccacttaaagtggtttcttttccttgggaataaggattgtatgctaaagagtcttactccttgtgcatatagcctaaattccctctgttttttttttgtttgtttttgttttttgtagtaatcagccaaatctttctgcaaaagcattttatcaaatgcttcctttgtttggggccaaataatcatcatagtacatttccatcatgaacttttctcttttatgggctcccaggattttcagtggactaatgggtgtcgttataagrcatccacagttccatttgagctgtacagcactgtaggagcaggatccctgatgcattctgggctcccagagctgggttagggcttagagttcacagaaaccagttattttcaaatgctattccatagaactctgcttttatctgtggtacacagtggctcctaggtaagattttgcttgatcaaataatttcttgtctaaagacttgaataaactcaaatattaaaaacacaaacatgtcttctcatttatcagatgagggaacctcaggcctgggggacaaagtaaaattaagttacca

SEQ ID NO: 37697 - DNA, 601 bp, Human
gcccttcttggtctcccaaagtgctgggattacaggcatgagccactgcacctggccaactttcttgaataaaagtagaagtactacaacgaatcccctagcaaggagatgtagactgccatttatgtatagaaactaggccctatttggccacccacactctggagccatcaaggaaccaatggcttttactttgggctggtcattaatctctccaaatcacctgggctgagtagcgaaggttaagggctaaaaatggaccaaaggaaaactcatatgcacaaggctgtgatgcacatayggatgaatggatttgtcttaaagggtaaaaccatttcaaatagagaagcacaggagatctagagggagtgtatgccttttggggagaaagtgtgacataaatcattttcttggcctgttcagcttattcagcagcatctcagttttctgtgtttcctcatccatccacttaaagtggtttcttttccttgggaataaggattgtatgctaaagagtcttactccttgtgcatatagcctaaattccctctgttttttttttgtttgtttttgttttttgtagtaatcagccaaatctttc

SEQ ID NO: 37698 - DNA, 601 bp, Human
ctcagctcactgcaacctctgcctcccaggttcaagcgattctcctgcctcagcctccccagtagctgggattacaggcatgtgccgccacacccggctaattttgtagttttagtagagacagggtttcatcatattggtcaggctggtctcgaactcctgacctcaggtgatccgcccttcttggtctcccaaagtgctgggattacaggcatgagccactgcacctggccaactttcttgaataaaagtagaagtactacaacgaatcccctagcaaggagatgtagactgccatttrtgtatagaaactaggccctatttggccacccacactctggagccatcaaggaaccaatggcttttactttgggctggtcattaatctctccaaatcacctgggctgagtagcgaaggttaagggctaaaaatggaccaaaggaaaactcatatgcacaaggctgtgatgcacatacggatgaatggatttgtcttaaagggtaaaaccatttcaaatagagaagcacaggagatctagagggagtgtatgccttttggggagaaagtgtgacataaatcattttcttggcctgttcagct

SEQ ID NO: 37699 - DNA, 601 bp, Human
tttgggacagctagactctcctctcatggaaaacataaagcttatcttgcagagggctccgtggatgtcaaaggggaaagcaggccttcaatgaacccaaatttgggtctgataagaaaatagaatttaagagttaaatacattaactttatttatttatttatttatttatttatttatttatttatttattttttgagacacagttccactcttattgcccaggctggagtgaaatggcactatctcagctcactgcaacctctgcctcccaggttcaagcgattctcctgcctcagcctccccagtagctgggattacaggcatgtgccgccacacccggctaattttgtagttttagtagagacagggtttcatcatattggtcaggctggtctcgaactcctgacctcaggtgatccgcccttcttggtctcccaaagtgctgggattacaggcatgagccactgcacctggccaactttcttgaataaaagtagaagtactacaacgaatcccctagcaaggagatgtagactgccatttatgtatagaaactaggccctatttggccacccacactctggagccatcaaggaac

SEQ ID NO: 37700 - DNA, 601 bp, Human
ctcggttgatggtagcataagattgacaggatgacacaagactctacactgattgattgactcagtgagctggctgaaggcaggagacaggccctgatgactctgttctgtttgggacagctagactctcctctcatggaaaacataaagcttatcttgcagagggctccgtggatgtcaaaggggaaagcaggccttcaatgaacccaaatttgggtctgataagaaaatagaatttaagagttaaatacattaactttatttatttatttatttatttatttatttatttatttatttattttttgagacacagttccactcttattgcccaggctggagtgaaatggcactatctcagctcactgcaacctctgcctcccaggttcaagcgattctcctgcctcagcctccccagtagctgggattacaggcatgtgccgccacacccggctaattttgtagttttagtagagacagggtttcatcatattggtcaggctggtctcgaactcctgacctcaggtgatccgcccttcttggtctcccaaagtgctgggattacaggcatgagccactgcacctggccaactttcttgaa

SEQ ID NO: 37701 - DNA, 601 bp, Human
gaatgacatagtggcataggactgcatctacctaactagttcctgagacacagaaagtactcggttgatggtagcataagattgacaggatgacacaagactctacactgattgattgactcagtgagctggctgaaggcaggagacaggccctgatgactctgttctgtttgggacagctagactctcctctcatggaaaacataaagcttatcttgcagagggctccgtggatgtcaaaggggaaagcaggccttcaatgaacccaaatttgggtctgataagaaaatagaatttaagmgttaaatacattaactttatttatttatttatttatttatttatttatttatttatttattttttgagacacagttccactcttattgcccaggctggagtgaaatggcactatctcagctcactgcaacctctgcctcccaggttcaagcgattctcctgcctcagcctccccagtagctgggattacaggcatgtgccgccacacccggctaattttgtagttttagtagagacagggtttcatcatattggtcaggctggtctcgaactcctgacctcaggtgatccgcccttcttg

SEQ ID NO: 37702 - DNA, 601 bp, Human
ccaaggacattttaggtatactatgcatttatgctttcattttattttaaaaaatgcttacatagctcttgacaggcaccaggcacagtcctaatcacctaacatatataaccatattttatagcaaacctatgaggtaggtattttagagcccccattttaaagaaaatagggcacagagaagttgcccaaggtcaaatggccagtagataggagaattaagacttgagtctggctccaaatcctgtgttcttacttagtatattatatttcctctcgacacataaaaagggcaatcccsaggctcagtacattaggagaaaacagtaaataaaaggtgataaaaaatagaagtctctgactcctagaaaaaactcaggcatttaattatagacagttagacaggcaagagttggagtcacatcttgagtgctgaacagctgtgggacccttattctctcaaggcgtcagtttccccatctgctaacaggaataatagtatctaatccaaatgctgagaatgacatagtggcataggactgcatctacctaactagttcctgagacacagaaagtactcggttgatggtagcataagatt

SEQ ID NO: 37703 - DNA, 601 bp, Human
aggcatgctagcaccaaactgaaactttttgatgtaatctgcaggttccacagagaactgaaatggatcaacttccccacccggtgatccagtgttgtttgaagttgtatgggtgtcccatctagcatcaactcacatttcaaaaaactccagcttaagagatggtgacaaactcttgggcctcccaggtaaaagtttctgcctcagtttgtgatgctgagtttcagagtgtcaacttggcacatccatagaaattatctagttcagctcttttgttctatgaataggaaaactgaagccyaaaatgggaagatgatttcttaaaggtaacgtggctgataaatgacaagatccaggtctgtgtcctgagtttctgttttccaatctaataatccaatctgttgtaattctaatccctatcaccccatccctggaaaattaaaaatatcaaggggttgatcattttgtaggaaaaaaggccaatggttggatttatataaatattataaatcttcagcctaacacttttcacttcatgttataaaagctccaaggacattttaggtatactatgcatttatgctttcattttattttaaaa

SEQ ID NO: 37704 - DNA, 601 bp, Human
ctcgggaggctgaggcaggagaatcgcttgaacccgggaggcagaggtcaagtgagctgagactgcaccactgcactccagcctgggcaacagagcaagactctgtctcaaaaaaattaaaaaaaaaaggaaaacaaaatgtttattgaattctccaaagaaaatcactattgcatgccttcagaagatggtagctataaaaataaatatgttgaagataatgttaataaattctagtcagacactgttgcctgctaaaaaaatcaaacctccatgactgctctcatgttgaaatgcaggmaattagcaagtgttaggtgttaaaggcatgctagcaccaaactgaaactttttgatgtaatctgcaggttccacagagaactgaaatggatcaacttccccacccggtgatccagtgttgtttgaagttgtatgggtgtcccatctagcatcaactcacatttcaaaaaactccagcttaagagatggtgacaaactcttgggcctcccaggtaaaagtttctgcctcagtttgtgatgctgagtttcagagtgtcaacttggcacatccatagaaattatctagttcagctcttttgtt

SEQ ID NO: 37705 - DNA, 601 bp, Human
gtgctacgatctgttatgtatgtgtgaaaactatgctcgctttctaagggcgcataaataattcagtgtcgttacaatgaggattcccctcttattacactacaaagtcttcagcttccttcaacttctttataacccatttaagcttgatgactttatttccaccactccctcctcctgtttctcagagctgaggatggggtgagggtggggggcggggagcctgctgcctctgaaccccactatttgcttttcccctccccccagtgaaccccaattataacggaggggaacccaagckctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggc

SEQ ID NO: 37706 - DNA, 601 bp, Human
tatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgcccyccgggacggcactcaagcagccggccgtggtctacccctggatgaagaaggtgcacgtgaattcgggtaaggctagggtccagtaacctttctgtccacatcccagcccgttagcctgggtcctctggaagggggtgcgagtaggtgggggcgtgtggagcttccatgggcgccgcaattactctccccataaatttttatagctgagggagcaggtcaggaccatgtggctggctgctcggctgtgggcgcaaaagggggtggggatgggggggtgggggaggactccattttcagagc

SEQ ID NO: 37707 - DNA, 601 bp, Human
aatgtatataggggggccttaacccttccagaaggaagcaaaggattcactcaaagttgcattcttgaaaatatatttccacatgtgtttttttcagcactgtgcttacaaccagttctgggtgattaaaggaaagggaaaaaaaccaacaaatggtccaacattttccttctggggaaagaaaacaaaacctctatgcactgggtcattagataatgactgaattttctgttccaactggattccaaatgccctaaataccctcatatagcagtgttttacaggaattagtgtatggccygtgtaggggaggggctgtgcagtggggagaaagtgggaaggtgaggaactcttgctttaagaaggaaaaaaaaaaaaccctaattgaatctagaagtccacaaaagttagccttagagtttttttccccctgaagttttaatttttttaaaaaccaaatctaaggaagttttcctcagctcattaattagaagcagaatttgtaaaagtataaaagttttcaagcactcgtctttgccttgagaatagtggttttttaaagaatcactctcaacaggggagatgtcctctagtcgttttt

SEQ ID NO: 37708 - DNA, 601 bp, Human
ggtcaccctttgagaagagcctgctgccaactatacactgtctataggagacacactttatattcaaagatatgaacagactgaaagtaaaagatggaaaagatataccatatgaacagtaactaaagtagagcgggaatggctatcctaacatcagagaaaatggacttcaaaagaagcaaacatgttactagcaataaagtgggacattgtataatgataaaaggatcaatgcattagggaagtgtgtcaatgataagcatagatgcatctaaaaacagagttccaaaatacatgaggaaaaagacaaaaataattcaaagtagaaatagacaattcagtagtgacagttggagacttcaataccccactttaaacaatggatggaactagaaagacatggaagacttgaatagcactgtcaacaaatagacctaacagacatctacacagaacatctccacccagcaacaacagaataatacattcttttccagcatacatgaaacatcatctccaggatagataatatgctaggccataaaactaacttaaacaaacttaaaaggattgaaataacataaagtatattctcttatta

SEQ ID NO: 37709 - DNA, 601 bp, Human
atttcttcaagaccttgctcaaatataactgcctggttctgcttttgtttcctctccctaattggcttcttagggcttaccatcttaagtgaccagatctgagagcctttcccaaaaaccatggctgagtcagtgttgtatcttgtggcagtcatgcaggtgctcaggtcaccctttgagaagagcctgctgccaactatacactgtctataggagacacactttatattcaaagatatgaacagactgaaagtaaaagatggaaaagatataccatatgaacagtaactaaagtagagcrggaatggctatcctaacatcagagaaaatggacttcaaaagaagcaaacatgttactagcaataaagtgggacattgtataatgataaaaggatcaatgcattagggaagtgtgtcaatgataagcatagatgcatctaaaaacagagttccaaaatacatgaggaaaaagacaaaaataattcaaagtagaaatagacaattcagtagtgacagttggagacttcaataccccactttaaacaatggatggaactagaaagacatggaagacttgaatagcactgtcaacaaatagacc

SEQ ID NO: 37710 - DNA, 601 bp, Human
gccttgcttgaaacaatcagaatgaatgactgtatgtggttcttagagcatgccaagcaattcccaattgcttggtttcctagcattacttgtttcttacctgcttttattggaaaaaacaaattctccccagagatgaaggggagtcttatttcttcaagaccttgctcaaatataactgcctggttctgcttttgtttcctctccctaattggcttcttagggcttaccatcttaagtgaccagatctgagagcctttcccaaaaaccatggctgagtcagtgttgtatcttgtggcartcatgcaggtgctcaggtcaccctttgagaagagcctgctgccaactatacactgtctataggagacacactttatattcaaagatatgaacagactgaaagtaaaagatggaaaagatataccatatgaacagtaactaaagtagagcgggaatggctatcctaacatcagagaaaatggacttcaaaagaagcaaacatgttactagcaataaagtgggacattgtataatgataaaaggatcaatgcattagggaagtgtgtcaatgataagcatagatgcatctaaaaacagagtt

SEQ ID NO: 37711 - DNA, 601 bp, Human
accatgttttgtttgtcttcatgaggtttacaattttatgaggccagaacactgccttgcttgaaacaatcagaatgaatgactgtatgtggttcttagagcatgccaagcaattcccaattgcttggtttcctagcattacttgtttcttacctgcttttattggaaaaaacaaattctccccagagatgaaggggagtcttatttcttcaagaccttgctcaaatataactgcctggttctgcttttgtttcctctccctaattggcttcttagggcttaccatcttaagtgaccagayctgagagcctttcccaaaaaccatggctgagtcagtgttgtatcttgtggcagtcatgcaggtgctcaggtcaccctttgagaagagcctgctgccaactatacactgtctataggagacacactttatattcaaagatatgaacagactgaaagtaaaagatggaaaagatataccatatgaacagtaactaaagtagagcgggaatggctatcctaacatcagagaaaatggacttcaaaagaagcaaacatgttactagcaataaagtgggacattgtataatgataaaaggatcaa

SEQ ID NO: 37712 - DNA, 601 bp, Human
ggcactccttgatgatacggaattaatcttttttttctcagtgcttaaaaaatgcctgatacattgtaagtattcaataaatatttattgaataaatgaaagaatgatttgtgactatagacaaatttattttccttccttatcctccctccactttaaaaagctccaatgaataataactagccaaatataaaaatgtgataaagaggcccaacaaaacacattttgaaatgtgcttcttaaagtaacaggatctactaacccactgtaagtcctttgaggctgggaaccatgttttgtytgtcttcatgaggtttacaattttatgaggccagaacactgccttgcttgaaacaatcagaatgaatgactgtatgtggttcttagagcatgccaagcaattcccaattgcttggtttcctagcattacttgtttcttacctgcttttattggaaaaaacaaattctccccagagatgaaggggagtcttatttcttcaagaccttgctcaaatataactgcctggttctgcttttgtttcctctccctaattggcttcttagggcttaccatcttaagtgaccagatctgagagccttt

SEQ ID NO: 37713 - DNA, 601 bp, Human
gtgtttaccctgaaaatgtgcagagatacttttaaatgacaaaaagaatctggagaatgtctattagaagaaaaatagagaagttactgcacactactttaaaaataaacttcactttctgacccagtatcagaatctgagttcaattgcgtgtttatcactgatttaacttggtctgcttatttacatgttaagatatgccccaccagatgaggcactccttgatgatacggaattaatcttttttttctcagtgcttaaaaaatgcctgatacattgtaagtattcaataaatatttaytgaataaatgaaagaatgatttgtgactatagacaaatttattttccttccttatcctccctccactttaaaaagctccaatgaataataactagccaaatataaaaatgtgataaagaggcccaacaaaacacattttgaaatgtgcttcttaaagtaacaggatctactaacccactgtaagtcctttgaggctgggaaccatgttttgtttgtcttcatgaggtttacaattttatgaggccagaacactgccttgcttgaaacaatcagaatgaatgactgtatgtggttcttaga

SEQ ID NO: 37714 - DNA, 601 bp, Human
caagtagctggtattacaggtgtaagccaccatgcctggctaattttttgtatttttagtagagacagggtttcgccatattcgtcaggctggtctcgaactcctgacctcaggtgattcacctgctttggcctcccaaagtgctgggattacaggcgtgagccaccgtggccagcctcaattggattttaatttgccaattttcactggtgatagatctagaagatttgtgtttaccctgaaaatgtgcagagatacttttaaatgacaaaaagaatctggagaatgtctattagaagaraaatagagaagttactgcacactactttaaaaataaacttcactttctgacccagtatcagaatctgagttcaattgcgtgtttatcactgatttaacttggtctgcttatttacatgttaagatatgccccaccagatgaggcactccttgatgatacggaattaatcttttttttctcagtgcttaaaaaatgcctgatacattgtaagtattcaataaatatttattgaataaatgaaagaatgatttgtgactatagacaaatttattttccttccttatcctccctccactttaa

SEQ ID NO: 37715 - DNA, 601 bp, Human
cctttcagactgaccatacttctatctgtctcccataatgagcttggacctctggacatcaactccactagatcttaaggtcctgagatcagagaccatgtcttatggttagcacagagtctgagccacaagaaatgcttaatctatgttttttaaatccctataactgaagagcaatttgttatttgaatgctgaactttgcctgtttctcatgattggatctgagcacctggagtgggaactagctcagcttttctctgagaattcacaggactctgaccatatacacatcgtactcamatcagtccccagccattggtcctaagctaacttgctattccagcaagccttgccctggcatgtgggctctctgtaccaattctctctcttggctacctatgacctagtagtaatagtctctgaagaatatttgaataacctataagtaacagattggaaaattcagatatcatgaatcaagttacttcatttaatctgaggtccatattacaaatctgcatgggttgaagaaattggcaagtcaggagagaggtgtttagaaaaaaaagagtgtttttttaccagggcctttggctcttc

SEQ ID NO: 37716 - DNA, 601 bp, Human
gtcaaccttgtggtaggtatccaggcagggcaaaaaaaagaaaagacctaaaagagaggaggaggaagtgacagataaatagctagcatgaaggctgtttgggtttcacctttctggggtcaggttgcacactacattacttttcttagcctctaattacagaccattggcccatcccacctccacctgagggtaaaaggagagcactattatatattataatatgtaatccaggacaataggtataaacagggattattcccagcaaactgggctgtgtggtccttttagtcatggtgcygcctccccaggtctcaattgcgtgtctgtcctttcactagaattgaatttcctaagtagtgtcctatgcactattgttagccttagtgtctgacttagtgccttttaggtgctctctaaaattgtttttgaatccatgagtgtacccaggtgtcaaactttagagccagcaacctccatgtcatattcgttagaatgtgagccccagaagtaatcagaatagcaattatcatgataccagctttctggttggctagttagtcctcacccacccaatataatatataggatcaatgtgcaa

SEQ ID NO: 37717 - DNA, 601 bp, Human
attgcctttgcactctgttaattgtgtcctttgatgcacaaaagttttaagttatgatgtagtccatatcattatttttctttcctatttttgagtataaataatcattttgtccacggtaggtagaccatggaaaatgtatagagaaagcaaaagccatcatttggcttacctcatgaaaaggtatctccagagtttggagacgaaggtcaaccttgtggtaggtatccaggcagggcaaaaaaaagaaaagacctaaaagagaggaggaggaagtgacagataaatagctagcatgaargctgtttgggtttcacctttctggggtcaggttgcacactacattacttttcttagcctctaattacagaccattggcccatcccacctccacctgagggtaaaaggagagcactattatatattataatatgtaatccaggacaataggtataaacagggattattcccagcaaactgggctgtgtggtccttttagtcatggtgctgcctccccaggtctcaattgcgtgtctgtcctttcactagaattgaatttcctaagtagtgtcctatgcactattgttagccttagtgtctg

SEQ ID NO: 37718 - DNA, 601 bp, Human
gcaaatattttcccccattccctagattgcctttgcactctgttaattgtgtcctttgatgcacaaaagttttaagttatgatgtagtccatatcattatttttctttcctatttttgagtataaataatcattttgtccacggtaggtagaccatggaaaatgtatagagaaagcaaaagccatcatttggcttacctcatgaaaaggtatctccagagtttggagacgaaggtcaaccttgtggtaggtatccaggcagggcaaaaaaaagaaaagacctaaaagagaggaggaggaartgacagataaatagctagcatgaaggctgtttgggtttcacctttctggggtcaggttgcacactacattacttttcttagcctctaattacagaccattggcccatcccacctccacctgagggtaaaaggagagcactattatatattataatatgtaatccaggacaataggtataaacagggattattcccagcaaactgggctgtgtggtccttttagtcatggtgctgcctccccaggtctcaattgcgtgtctgtcctttcactagaattgaatttcctaagtagtgtcctat

SEQ ID NO: 37719 - DNA, 601 bp, Human
cagttgtataaatattctttaagaccctactttcaattcttttaggtatatatgcagaagtggaattgctgggtcatacagtaattctattcttaattttttgaggagctgctctactgttttctacagtggctgcaccattttacattttcctaccaacagtgcacgagggttccaatttgtctacatcctcttcaacacttgttattttccaggtttttaaaaaaacagtagccatgttaatgagtgtaaagtgatattttgtgatattgatttgtattttcctaatgtagtgatgctragcatcttttcatatgcttgttgcccatttatatatcttcatcttctttggatgtcatcctttgagaaatgtctgttcaagttcgtattagggttctctagagaaactatagaatgtgtatgtgtgtgtttaggtttcatcatacatatatatgtacacacacacgtacacatataggtatgctggggtggggagagaaaaaaatactgatttaaagaattggctcatgtgcttatggaagccagcatgtctaaaatcttcaggctgaagacccagggaagagtttatcttttctactga

SEQ ID NO: 37720 - DNA, 601 bp, Human
atacactgaaaaatctgaaaggatatactccaaaatatcaacagttaactatgggtaacaggattggggtgagttttttttccccaattttgtttattgtgttaaaatacatataccataaaacttaccatcttaaccatttttaagtatacagtccagtgatactgaatacactcataatattgtgcaactatcaccaccatccatctccataactctttcatcttgtaaaactgaaactctgtacccatgaaataataactctccaatttctccttctcctcaacccctgcaaccaccrtactactttcagtctctatgaatttgactactctaggtgcttcatatgagtaggatcatacagtattttgtgtgtgtgtgtgattggcttatttcagtcagcataatgtcctcaaggttcatctatcttgtagaatgtcagaatttcctttctttttaaggccgaataatgttccattgtgggttatatatcacattttatttatctcttcagtcatcagtagacacttgggttgcttcttccttttggttattgtgaataatgctgttatgaacacagttgtataaatattctttaaga

SEQ ID NO: 37721 - DNA, 601 bp, Human
ccatctgtaaatataaccacatacactgaaaaatctgaaaggatatactccaaaatatcaacagttaactatgggtaacaggattggggtgagttttttttccccaattttgtttattgtgttaaaatacatataccataaaacttaccatcttaaccatttttaagtatacagtccagtgatactgaatacactcataatattgtgcaactatcaccaccatccatctccataactctttcatcttgtaaaactgaaactctgtacccatgaaataataactctccaatttctccttctcctcaacccctgcaaccaccgtactactttcagtctctatgaatttgactactctaggtgcttcatatgagtaggatcatacagtattttgtgtgtgtgtgtgattggcttatttcagtcagcataatgtcctcaaggttcatctatcttgtagaatgtcagaatttcctttctttttaaggccgaataatgttccattgtgggttatatatcacattttatttatctcttcagtcatcagtagacacttgggttgcttcttccttttggttattgtgaataatgctgttatgaacacagt

SEQ ID NO: 37722 - DNA, 601 bp, Human
tagaagcatttagctaatatatgaaaagatgatcacaatatattgttgggttaagaaagacacattacaaaacagtatatatggtatgatatatgtgtgtatatatatatacccatctgtaaatataaccacatacactgaaaaatctgaaaggatatactccaaaatatcaacagttaactatgggtaacaggattggggtgagttttttttccccaattttgtttattgtgttaaaatacatataccataaaacttaccatcttaaccatttttaagtatacagtccagtgatactgamtacactcataatattgtgcaactatcaccaccatccatctccataactctttcatcttgtaaaactgaaactctgtacccatgaaataataactctccaatttctccttctcctcaacccctgcaaccaccgtactactttcagtctctatgaatttgactactctaggtgcttcatatgagtaggatcatacagtattttgtgtgtgtgtgtgattggcttatttcagtcagcataatgtcctcaaggttcatctatcttgtagaatgtcagaatttcctttctttttaaggccgaata

SEQ ID NO: 37723 - DNA, 601 bp, Human
atttaacatcaacaatagggaattggttgagtaaattgtgatacagccactaaatgaaatgctgtatgtccatttaaaataaagagatagaagcatttagctaatatatgaaaagatgatcacaatatattgttgggttaagaaagacacattacaaaacagtatatatggtatgatatatgtgtgtatatatatatacccatctgtaaatataaccacatacactgaaaaatctgaaaggatatactccaaaatatcaacagttaactatgggtaacaggattggggtgagttttttttycccaattttgtttattgtgttaaaatacatataccataaaacttaccatcttaaccatttttaagtatacagtccagtgatactgaatacactcataatattgtgcaactatcaccaccatccatctccataactctttcatcttgtaaaactgaaactctgtacccatgaaataataactctccaatttctccttctcctcaacccctgcaaccaccgtactactttcagtctctatgaatttgactactctaggtgcttcatatgagtaggatcatacagtattttgtgtgtgtgtgt

SEQ ID NO: 37724 - DNA, 601 bp, Human
ctgaggaccaagagatggataaaacatagcccctgctgctatggaggttgtagtctgggaaaaccagtgtcttagatagatggtccccaacttgcaatggtttgacaattttcgacttttatcatgggtttattaggatacatgcatttttgacttacgatattttttgctttatgatggtttataagtcaaagaacacttgcatatatattataatcagtgtaacaagggcaagcttgaatgtcaagtgtctggactttatcctttaaaggagaaggatgaataaggaaaggagggtgargggggacatcccataaagcataattgccaccagtgcctttgattcttggggtccctctatttgaggtcctccttccaactaccatggttcacaacctcctaacccagttctgggcctgggtgtccccactgcttcagtgacaggctccattgctggtggtaattgccactccattggccagctgcctggaatcctgctgtcttctcacttctcctctgaatacctgttgcctacctgccttggtaagaatcaaagccaccgaccctggccgtgaatgagcttgctgagcttgctgtctgt

SEQ ID NO: 37725 - DNA, 601 bp, Human
ctctcagaacctccagaagaaattggtccagctgacacctggactctagcccattgaaactgattttggactctgtggtcttcgaaactaagaaaataatttttgtttggttttaagccaccatgtttgtggtagtttgttacagaagtaataggaactaatacagatatattttaaaaatctgttttaaaatgcactgagttgagaaccagtctctagtctctcttccagatgtctttcatttataggatgttttcacttctacagctgatgctggtggttccagtttcctcctgcttcycagtcccatccacccccttgattgaagttggaaacaggagagggaagaaaatcgactgtggattctggaaaggaggggcagggcatggagctctccatgttgacccaaactcttctttttacacttcttttctcattattttttagtggttagacaaacagtaagcatagtgcattgagaaccttgagaagactaatttgggggtgtgggtgagagtaaggaatgttgataaagacgtcgcagaataggtggcatcttaaaggacaaataaaatcttgcctgtggagaaaagggaagtat

SEQ ID NO: 37726 - DNA, 601 bp, Human
ccagatgctggaaaaggcaaggaaacggattctcctctcagaacctccagaagaaattggtccagctgacacctggactctagcccattgaaactgattttggactctgtggtcttcgaaactaagaaaataatttttgtttggttttaagccaccatgtttgtggtagtttgttacagaagtaataggaactaatacagatatattttaaaaatctgttttaaaatgcactgagttgagaaccagtctctagtctctcttccagatgtctttcatttataggatgttttcacttctacarctgatgctggtggttccagtttcctcctgcttctcagtcccatccacccccttgattgaagttggaaacaggagagggaagaaaatcgactgtggattctggaaaggaggggcagggcatggagctctccatgttgacccaaactcttctttttacacttcttttctcattattttttagtggttagacaaacagtaagcatagtgcattgagaaccttgagaagactaatttgggggtgtgggtgagagtaaggaatgttgataaagacgtcgcagaataggtggcatcttaaaggaca

SEQ ID NO: 37727 - DNA, 601 bp, Human
aaccacagtttaaaatagcaaaaatgtgacatttctttttttctttctttgagacagagtctcactctgtcacccgggctggagtgcaatgcgcaatctcgactcactgcagcctccgcctcccgggttcaagtgattctcctgcctcagtctcctgagtagctgggattacaggcatttgccaacacccccggctaattttttttttttttttttgagatcgagtctcgctctgtggtcatggctgaagcacagtggcatgatcttggctcactgaaacctctgcctctcgggttcaagygattcttctgcctcagcctccctggtagctgggattacaggcatgtgctaccacgcccagctaatttttgcatttttagtagagacaagagttacaccatgttggccaggctggtctcaaactcctgacctcaagcgatccacccaccttggcatcccagagtactgggattacaggtgtgagccactgcgcctggcctaaaatgggaaatttcatgtaaattttatctaaaacaatttttagattcatagagaaaaaaataatcagagtaatttgtccaaatgttatagtgattgtgtt

SEQ ID NO: 37728 - DNA, 601 bp, Human
aaatgttctgaaattagataatagtaatggatgtaccccttagtaaatatattatactaaaaccacagtttaaaatagcaaaaatgtgacatttctttttttctttctttgagacagagtctcactctgtcacccgggctggagtgcaatgcgcaatctcgactcactgcagcctccgcctcccgggttcaagtgattctcctgcctcagtctcctgagtagctgggattacaggcatttgccaacacccccggctaattttttttttttttttttgagatcgagtctcgctctgtggtcrtggctgaagcacagtggcatgatcttggctcactgaaacctctgcctctcgggttcaagtgattcttctgcctcagcctccctggtagctgggattacaggcatgtgctaccacgcccagctaatttttgcatttttagtagagacaagagttacaccatgttggccaggctggtctcaaactcctgacctcaagcgatccacccaccttggcatcccagagtactgggattacaggtgtgagccactgcgcctggcctaaaatgggaaatttcatgtaaattttatctaaaacaatttt

SEQ ID NO: 37729 - DNA, 601 bp, Human
catgggggattcccacttaacaagtacaggcttcctttcgggatgatgaaaatgttctgaaattagataatagtaatggatgtaccccttagtaaatatattatactaaaaccacagtttaaaatagcaaaaatgtgacatttctttttttctttctttgagacagagtctcactctgtcacccgggctggagtgcaatgcgcaatctcgactcactgcagcctccgcctcccgggttcaagtgattctcctgcctcagtctcctgagtagctgggattacaggcatttgccaacaccccyggctaattttttttttttttttttgagatcgagtctcgctctgtggtcatggctgaagcacagtggcatgatcttggctcactgaaacctctgcctctcgggttcaagtgattcttctgcctcagcctccctggtagctgggattacaggcatgtgctaccacgcccagctaatttttgcatttttagtagagacaagagttacaccatgttggccaggctggtctcaaactcctgacctcaagcgatccacccaccttggcatcccagagtactgggattacaggtgtgagccactgcg

SEQ ID NO: 37730 - DNA, 601 bp, Human
ttaaggagtacatgggggattcccacttaacaagtacaggcttcctttcgggatgatgaaaatgttctgaaattagataatagtaatggatgtaccccttagtaaatatattatactaaaaccacagtttaaaatagcaaaaatgtgacatttctttttttctttctttgagacagagtctcactctgtcacccgggctggagtgcaatgcgcaatctcgactcactgcagcctccgcctcccgggttcaagtgattctcctgcctcagtctcctgagtagctgggattacaggcatttgycaacacccccggctaattttttttttttttttttgagatcgagtctcgctctgtggtcatggctgaagcacagtggcatgatcttggctcactgaaacctctgcctctcgggttcaagtgattcttctgcctcagcctccctggtagctgggattacaggcatgtgctaccacgcccagctaatttttgcatttttagtagagacaagagttacaccatgttggccaggctggtctcaaactcctgacctcaagcgatccacccaccttggcatcccagagtactgggattacaggtgtg

SEQ ID NO: 37731 - DNA, 601 bp, Human
agacagaaactaaattagtggttgccagggattaaggagtacatgggggattcccacttaacaagtacaggcttcctttcgggatgatgaaaatgttctgaaattagataatagtaatggatgtaccccttagtaaatatattatactaaaaccacagtttaaaatagcaaaaatgtgacatttctttttttctttctttgagacagagtctcactctgtcacccgggctggagtgcaatgcgcaatctcgactcactgcagcctccgcctcccgggttcaagtgattctcctgcctcagyctcctgagtagctgggattacaggcatttgccaacacccccggctaattttttttttttttttttgagatcgagtctcgctctgtggtcatggctgaagcacagtggcatgatcttggctcactgaaacctctgcctctcgggttcaagtgattcttctgcctcagcctccctggtagctgggattacaggcatgtgctaccacgcccagctaatttttgcatttttagtagagacaagagttacaccatgttggccaggctggtctcaaactcctgacctcaagcgatccacccacctt

SEQ ID NO: 37732 - DNA, 601 bp, Human
aaagtaatgaagtactgattcatgctcaagcatggttgaaccttgaaaacattatgctaagtgaaaagaagccagacacaaaaagccatatattgtatgattccatttatgtgaaatgtccagaagaggcaaatccattgagacagaaactaaattagtggttgccagggattaaggagtacatgggggattcccacttaacaagtacaggcttcctttcgggatgatgaaaatgttctgaaattagataatagtaatggatgtaccccttagtaaatatattatactaaaaccacagttkaaaatagcaaaaatgtgacatttctttttttctttctttgagacagagtctcactctgtcacccgggctggagtgcaatgcgcaatctcgactcactgcagcctccgcctcccgggttcaagtgattctcctgcctcagtctcctgagtagctgggattacaggcatttgccaacacccccggctaattttttttttttttttttgagatcgagtctcgctctgtggtcatggctgaagcacagtggcatgatcttggctcactgaaacctctgcctctcgggttcaagtgattcttctg

SEQ ID NO: 37733 - DNA, 601 bp, Human
taatgtattgcataaaaggtacaaaattgtcttttgaccctgattataactataaaaatgcatatatggaaaacaggttagctgcccctcaaaaagttaaatacggagttaccatgtgacctagtaattctacttctagatacagacccaagataattgaaaacgtgttcactcaaaaacttgcaaattaatgcttgctgtagcattattcatactagccaaaaagcagaaacaacctaaatgtccatcagctgatgaaccaataaaatgtggtatagcctcacaatgaaatattatttgrtcataaaaagtaatgaagtactgattcatgctcaagcatggttgaaccttgaaaacattatgctaagtgaaaagaagccagacacaaaaagccatatattgtatgattccatttatgtgaaatgtccagaagaggcaaatccattgagacagaaactaaattagtggttgccagggattaaggagtacatgggggattcccacttaacaagtacaggcttcctttcgggatgatgaaaatgttctgaaattagataatagtaatggatgtaccccttagtaaatatattatactaaaacc

SEQ ID NO: 37734 - DNA, 601 bp, Human
gcaaatttggagtgaccagagtgtgccattcctagacttctgaggtcaaaagtaggcagatctccaaggtcgatgcctcaaatgcagttttgtattattgctgatgctacagtagagctgtagtttctcattatcagcacagcaggttttgtattgatgagctgtgctcagtttttccgcttaggatataatctaagccccaactaataaatttgaacaatggcttgaagagccacactactgataataaagataaggggaattcatccaagtttataaaagagaagaattgattttgaaragggtacaactgaccaaataagaacaacgcttaatgtattgcataaaaggtacaaaattgtcttttgaccctgattataactataaaaatgcatatatggaaaacaggttagctgcccctcaaaaagttaaatacggagttaccatgtgacctagtaattctacttctagatacagacccaagataattgaaaacgtgttcactcaaaaacttgcaaattaatgcttgctgtagcattattcatactagccaaaaagcagaaacaacctaaatgtccatcagctgatgaaccaataaaat

SEQ ID NO: 37735 - DNA, 601 bp, Human
ttctgcccagtgcctaatgaatggacagtaaggaagcaaaggggaaatgttctccacgagcaggccttcctaaagggcagtctgggtgggaggatggagtgctcacccgcactttggcttgtctttgcgcttcagcctccacagccagtgagtgctgaagcccagctggcaacctcacatctttactgaaaaagaaagaatgcaggtatgtaggtgtgcagccatgatttaggggccaaagctttcacacagacttgcaagcctctctactgctgtctcatgatgagtagcaaatttggaktgaccagagtgtgccattcctagacttctgaggtcaaaagtaggcagatctccaaggtcgatgcctcaaatgcagttttgtattattgctgatgctacagtagagctgtagtttctcattatcagcacagcaggttttgtattgatgagctgtgctcagtttttccgcttaggatataatctaagccccaactaataaatttgaacaatggcttgaagagccacactactgataataaagataaggggaattcatccaagtttataaaagagaagaattgattttgaaaagggtacaact

SEQ ID NO: 37736 - DNA, 601 bp, Human
aggggatacctagaagttagaagttagggtgactacgattacccaggaaaagatgccagcactagagaagagggattgatgtgtgtggaggagatgcctttaaggagagagagggaaggtgagactcaagcagtgagtggtcactattatcagtagcttcagagagggagaggagttgcattagtcaggggactattaacacactttaagagagcaattttaatagagttgtaagggcccaagacagcttctgcccagtgcctaatgaatggacagtaaggaagcaaaggggaaatgttcyccacgagcaggccttcctaaagggcagtctgggtgggaggatggagtgctcacccgcactttggcttgtctttgcgcttcagcctccacagccagtgagtgctgaagcccagctggcaacctcacatctttactgaaaaagaaagaatgcaggtatgtaggtgtgcagccatgatttaggggccaaagctttcacacagacttgcaagcctctctactgctgtctcatgatgagtagcaaatttggagtgaccagagtgtgccattcctagacttctgaggtcaaaagtaggcagatctc

SEQ ID NO: 37737 - DNA, 601 bp, Human
tcagggactcagaagcagccttttccgcttctgcagcaatcatctagaaaacatgtgacgaaagcaaagtgattgttcttcattccctgaaggcttcaccactatgcagtatgactcagcagacaagcactgagcatctactatgtggcaagcacggttaagcatagaacatgtttattcttctttctgaagggtcttgagctggggagacagattaaactgttaatcacaatttaaggtggaatgcgttaggagccatcacaagtataaatgaagtattaggggagttattagcatctgrtgggccttgaaagattaggattttgccaacatagagaaaagattagccagcattccatgcaaaggcatgacgttatgaaagggtgacccccaactcagggaaagtgaatgggtaaacatttctgaagagaaagtgctgagctcactacacaaatgctacctgaaagtgggtgaagaggacttcactcagagatctagaagcaactgccctggggactatcctcctccccttcctcatccccgcctcccctcagtgatccacaggcaatgatcctcttactggttcaggtttttatcttca

SEQ ID NO: 37738 - DNA, 601 bp, Human
ggcaaccaaaggaagggcagggaatgaggacagagtgtctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaaggtaaaaccacagtggaaggcttctctgtggacagagactgaagggtgtggaggtatcgaagctgaacrgcagcaggggtgcctgacagaatctcagctgccatcctcagggactcagaagcagccttttccgcttctgcagcaatcatctagaaaacatgtgacgaaagcaaagtgattgttcttcattccctgaaggcttcaccactatgcagtatgactcagcagacaagcactgagcatctactatgtggcaagcacggttaagcatagaacatgtttattcttctttctgaagggtcttgagctggggagacagattaaactgttaatcacaatttaaggtggaatgcgttaggagccatcaca

SEQ ID NO: 37739 - DNA, 601 bp, Human
accttgccaaaggggtcagaggacatacagtgaaagggacatctgaaccaagttcccagaagtcaaaatttaaccacatctagactcaaaattctttccaaagtagaatgttgaccaaagctgtttcccataattgctctgactagatgagtcacggaaacatgttgtctgccttctctgtcattacatcatttcactgtcttctcatggatggtgcattgtgacttcgtgcattccatggccattccatatggcaaccaaaggaagggcagggaatgaggacagagtgtctccctcaggsatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaaggtaaaaccacagtggaaggcttctctgtggacagagactgaagggtgtggaggtatcgaagctgaacggcagcaggggtgcctgacagaatctcagctgccatcctcagggactca

SEQ ID NO: 37740 - DNA, 601 bp, Human
ggagcaaaaagattgagtgtggttgaggaaaactaagacttggtagtatcattggagagaagactgcatcttcgggacagaagagcaatagagtgtgacaagcccaatgataggtgcttgtaggaagggctgtgggagctgtggcaaccttgccaaaggggtcagaggacatacagtgaaagggacatctgaaccaagttcccagaagtcaaaatttaaccacatctagactcaaaattctttccaaagtagaatgttgaccaaagctgtttcccataattgctctgactagatgagtcayggaaacatgttgtctgccttctctgtcattacatcatttcactgtcttctcatggatggtgcattgtgacttcgtgcattccatggccattccatatggcaaccaaaggaagggcagggaatgaggacagagtgtctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaag

SEQ ID NO: 37741 - DNA, 601 bp, Human
gaaacatttaagtgtcactttaggtaactatcagggttaggtgtgaggaattcagggtggagcaaaaagattgagtgtggttgaggaaaactaagacttggtagtatcattggagagaagactgcatcttcgggacagaagagcaatagagtgtgacaagcccaatgataggtgcttgtaggaagggctgtgggagctgtggcaaccttgccaaaggggtcagaggacatacagtgaaagggacatctgaaccaagttcccagaagtcaaaatttaaccacatctagactcaaaattcttyccaaagtagaatgttgaccaaagctgtttcccataattgctctgactagatgagtcacggaaacatgttgtctgccttctctgtcattacatcatttcactgtcttctcatggatggtgcattgtgacttcgtgcattccatggccattccatatggcaaccaaaggaagggcagggaatgaggacagagtgtctccctcaggcatgtgacttttctatggcaggcccctttacagtcacattatgccccatccttcctataacatgggagagtctttctttttaggatttagtggctca

SEQ ID NO: 37742 - DNA, 601 bp, Human
ggtctgtgccagaaaatggtgaggctcttttgttgtgctttaaaatgttgacaaagcctttctatgttatttaagtagatactgcgaggcaagaatagaaagagaaatctgtgtacctgccaagtgttattactagctctgttttctaatttgattgacatcagatatactagcaaaacttccagctgctccataacctgaagaggataagaaaaacctacacaaatatcttcttcctgaatgaatcttccctaaaacaaacaaaagtcaaccagcctatggtctgttggttagcatttcrgtcaaatatggggacaagtcctggtatcaacaacagaatttagattacaaaagtttttacagctttgtcaaaacaaacaaaatgtggcattaattaatttcctttaaaaaaaaaaatatggccaggtgcggtggctctacacctgtaatcccagaactttgggaggccgaggccgaagccggtggatcacttgaggtcaggagttcgagaccagcctagccaacaaggtgaaaccccgtctctactaaaaatacaaaaaattaggggggcatggttgcatgtgcctgtaatcccaggcac

SEQ ID NO: 37743 - DNA, 601 bp, Human
aacatcaaattatgctaatattggcaatacttaaaagaatatgctgtgaactcttcaggcaacaacaacacaaaggttttaaaaatattttgagagaacaccaagttggaacaaattcttcccaccaacgtgattattttaaaaaggacactaatttgatgtatgaaattctagtaaaacagttttaaaaataacccctcatttccatatagtcttacttcttacactgtggcttaattgtgctgaacataatataggactaagatgctgaaatgaaactggtatctctgagaaacagtcratgtactagacttttgaactagcttaccactctttgggtaagaatatctcaaatgtcttttgggagtctattcatcctgtttcaaatcatatacaagctgagtgtctcaaatccaaaaatctgaaatctaaaaatgctcaaaaatctgaaacttcttgagcatttacatgacactcaaagataatgctcactggagcacttcagacgtcagattttcagatttgggatgctcaaccagtaagtatagtgtaaatattccaaaaaatgaaaaaaatgaaatccaaaatgctctggtcccaa

SEQ ID NO: 37744 - DNA, 601 bp, Human
tgtcaaaaaaaaattcaggtagacatatgcgttgggccatttttgtgtttgctataaagaaatacacaaggctgggcaatttataaagaaaagaggtttaactggctcatggttctgcaggctgtacaagcacggcgttggcatctgcttggtttctggggaggactcaggaaacctttactcacggtgaaaggcgaagtgggggcagacacgtcacatagtgagagcaggtgcaagagactgggggtgccacacaaaggtgccacacacttttaaaacaattggatcttgtcaactcagmaaaaactcattcatccccaagtggatggtgctaagccatccatgagggatctgcccccatgatccaaacacctcccaccaggctcacctctaacactggagttcacatttcaacatgagacttggaggggacatccaaaccttatcaacatattttgtcaaaatgcttgttataaaactcctatgtatgggccgggtgcagtggctcatgcttgtaatcccagtactttgggagaccaaggtgggcaggtcacctgaggtcaagagttcgagaccaacctgaccaacatggtgaaacccc

SEQ ID NO: 37745 - DNA, 601 bp, Human
agccagaagagaaatgccctactcaggcagaactgaatgtattcaagtcaatatgtgaaccagaagcaacactaagtaagaaagctcattaaagctagaaagtgatgtgccttcccttagaaaaagtgcaagtatgtgcattcagcatgctccctgcaccctgaaactttgtatggagaaaaattcctcatcccttcagttcctttttgacagcttagttcttcaacatgaaactaaagcttgtcttgccaacaacagtcctctgtacaatcaaccataaaaaactgctaaacggtccgtytgggccacgtaccagaggcctgagcacactgtgtaaggagggtgtaacccatgcaaacttacatattcttcttcagtctcctcaacaaagaaagcttctccgttatcacccaacttcatgtgaagatccactgcactgccgttgatttctatatcaatctatgggagaaacaaagtatgacttaatgttcaaggagtctttccttcaagttaaactaaaccagaactctgagttctcaagtcaaacttagcatagttttgaggttcctagaactacagcctctgagaaacactgctactt

SEQ ID NO: 37746 - DNA, 601 bp, Human
ttccccttcataaatcatagtgtttcaatgctgctttacctactggtacctaagttgttggtttctcaatcaaaaaatgataaacaatctcattttgctatcgtattttttggtaataattttctttgtaaatttattgtatcaaactgtaagttcatcttcaaagccaaaaaagtagtcctgtatccttaataacttgatgcttatcagttttgctatttgagactttattctttatgaagaatgatgtactgatgcctttgaaagaatttttaaaaagattcacattacgtgatctgarttctttagtgagaatgtaaaatctattattaataaataaataaataaaaagatccacattgaatccatcaagaatccgtcgttaactagcgttcaaatcagtacatacagaatgtgtgtgctggggaggggggattttaacaaatcatgctcgtttgctagaagaagtcaaacatgtaatcacttataaaaggatataggccaattaatttaactctcttgagatcataataaattaattcacctgactactcaaggtgagggatgtaatatcccaaccaaaatggtaaacatgagtccc

SEQ ID NO: 37747 - DNA, 601 bp, Human
ctgatcaagcttccccttcataaatcatagtgtttcaatgctgctttacctactggtacctaagttgttggtttctcaatcaaaaaatgataaacaatctcattttgctatcgtattttttggtaataattttctttgtaaatttattgtatcaaactgtaagttcatcttcaaagccaaaaaagtagtcctgtatccttaataacttgatgcttatcagttttgctatttgagactttattctttatgaagaatgatgtactgatgcctttgaaagaatttttaaaaagattcacattaygtgatctgagttctttagtgagaatgtaaaatctattattaataaataaataaataaaaagatccacattgaatccatcaagaatccgtcgttaactagcgttcaaatcagtacatacagaatgtgtgtgctggggaggggggattttaacaaatcatgctcgtttgctagaagaagtcaaacatgtaatcacttataaaaggatataggccaattaatttaactctcttgagatcataataaattaattcacctgactactcaaggtgagggatgtaatatcccaaccaaaatggtaaa

SEQ ID NO: 37748 - DNA, 601 bp, Human
gcaccagtctgatcaagcttccccttcataaatcatagtgtttcaatgctgctttacctactggtacctaagttgttggtttctcaatcaaaaaatgataaacaatctcattttgctatcgtattttttggtaataattttctttgtaaatttattgtatcaaactgtaagttcatcttcaaagccaaaaaagtagtcctgtatccttaataacttgatgcttatcagttttgctatttgagactttattctttatgaagaatgatgtactgatgcctttgaaagaatttttaaaaagatkcacattacgtgatctgagttctttagtgagaatgtaaaatctattattaataaataaataaataaaaagatccacattgaatccatcaagaatccgtcgttaactagcgttcaaatcagtacatacagaatgtgtgtgctggggaggggggattttaacaaatcatgctcgtttgctagaagaagtcaaacatgtaatcacttataaaaggatataggccaattaatttaactctcttgagatcataataaattaattcacctgactactcaaggtgagggatgtaatatcccaaccaaa

SEQ ID NO: 37749 - DNA, 601 bp, Human
gaggatttttaattcaatgatctttattttacttactgaaagctctttttgtttctggtggtatttcttagttctattatagcaatgtttgtaggatgaagataacctgaatgcctaccagcaagaaaatggttaaacaaactatggtatgtccatactatggaatactgtgcagctattaaaagcacagagttaggtttagaactagacttgaaaagaatgttgatgacatataattaaatgagaaaaatctgagagaaaaaaagcaaataaatggcaacaaactgggtttttggtcatytttatcctactctaaatgacgaacccctagaggaacagaggcatgttgtattcatagcatgtggcatagagtagtaattccaacatttgttggataaattaacaattttttattttaaggagaagcatactacacaagataaactctggtcaatgtagtcatatgtggaatagggagaaaaaggctggaaagttgacattttccaagttgtccttgctgagcataatttttagcggaactgtcagaataagccatgaaaacgaggttaacatcaataacccagtcctctcgcttacggtg

SEQ ID NO: 37750 - DNA, 601 bp, Human
ggtttctgtaattatttttttattaagcttttgaacttagctttgataaacatattaccctgaagctaaagtttgatttagctaggagaaatctgtgttcaccagaaacacacacttacagagaaattgtaataagatattctgaatgtccaaaagaaacccagatgagaggtcgtggtctctgactttgaggatttttaattcaatgatctttattttacttactgaaagctctttttgtttctggtggtatttcttagttctattatagcaatgtttgtaggatgaagataacctgaaygcctaccagcaagaaaatggttaaacaaactatggtatgtccatactatggaatactgtgcagctattaaaagcacagagttaggtttagaactagacttgaaaagaatgttgatgacatataattaaatgagaaaaatctgagagaaaaaaagcaaataaatggcaacaaactgggtttttggtcatttttatcctactctaaatgacgaacccctagaggaacagaggcatgttgtattcatagcatgtggcatagagtagtaattccaacatttgttggataaattaacaatttttt

SEQ ID NO: 37751 - DNA, 601 bp, Human
tggacctgagggggaggttgtagtgagccgagatcatgccactgcactccagcctgggcaacagagcgagactccatctcaaaacaaacaacaaaaaaattaacctcatataatttaaaatactcaagcttttaaacaatagttctgaaaatgtataggtttctgtaattatttttttattaagcttttgaacttagctttgataaacatattaccctgaagctaaagtttgatttagctaggagaaatctgtgttcaccagaaacacacacttacagagaaattgtaataagatattctsaatgtccaaaagaaacccagatgagaggtcgtggtctctgactttgaggatttttaattcaatgatctttattttacttactgaaagctctttttgtttctggtggtatttcttagttctattatagcaatgtttgtaggatgaagataacctgaatgcctaccagcaagaaaatggttaaacaaactatggtatgtccatactatggaatactgtgcagctattaaaagcacagagttaggtttagaactagacttgaaaagaatgttgatgacatataattaaatgagaaaaatctga

SEQ ID NO: 37752 - DNA, 601 bp, Human
actgagtccatctgaaggaactgacatgccaagtcagcatggaacaccccaaagccataattaaagctaagcctattaaattcttcacaaagcaaagatcaaagcagcaacaaaaatctcaggaggtgttacaaaggactctctcaagaactcacacagaacattcagaacaggaaaaagcagaaggcagagattaaggacactacatcagacaaagggcagcaggacaggtgagtgacgcgaggatgcagtgatacagagcggccaatgcttatgttttgccaaattaattggagaaagrcaattagagacaataccgtgtaacaaatgacattagtaaatttttaaaccataaagcatttatgtttaaaaataagaaatattccttcctgtaggaattcaaaagaagaaaataaggcccaatatttagaagcagtcaaactcctaatactaaataaacgatcaagtctggtgttcagtaaattcatgtcttagccatttgtttcattcctttttgtatcatcagaggaaatggaaggtacataatagagataaaaattaacttcaggcagaacgtggtggctcacgcctgcaatcccag

SEQ ID NO: 37753 - DNA, 601 bp, Human
tctggccgggcacagtggctcacgcctataatcccagcactttgggaggccaaggtgggcagatcacttgaggtcaggagttcgagattagcctggccaacaggatgaaaccctgtctctactaaaaatacaaaaattagccgggcatggtggcaggcgcctgtaatctcagctactcgggaggctgaggcaagataatttcttgaacccaggagatggaggttgcagtgagccgagatggcaccactgcattccagcctaggtgacagagcaagactttatctcaaaaaaaaaggtgtaygttaaatgttctactgtgaagttatactggagaagactgaggaaactgacaattttcagttactaagaagtagaaaatactcattttgggggagaaaactaaatgaaaatttcaccctccttggaccacatcaaggctctgttaaaacagtgtaaaagtggcaagtctaaattcgatcacaaatatatgcaaaatgtatattttaaaaacctaaattcaacagaagatctaaacattttctctctcaagaaatttatcttctcagttctttcttctttcattatgagctggaaaaaaagg

SEQ ID NO: 37754 - DNA, 601 bp, Human
gctcatctgtgtacccagggctctgggtttgggcttcactatggtacagacagtgtcttccatggaagcatccttctcaacttcactgatgaggttgtcctcactgggaattacccgaaaatgagtattttctgatggtgtaattgtagctgtcctaggatgatggtcagatcgttctcttttgctgacctaaaaaagttaaattgtttaaaaattaaactactttcagagtatttgttataatctatttcctaagctggcaatgtgttcattctatttttaacttaacacattcattaartatcttagtttgtacatgtaaaaattccataataaagtgagaaaaactaataattgccttttgttcaatatcatgatacttataaatgttctggccgggcacagtggctcacgcctataatcccagcactttgggaggccaaggtgggcagatcacttgaggtcaggagttcgagattagcctggccaacaggatgaaaccctgtctctactaaaaatacaaaaattagccgggcatggtggcaggcgcctgtaatctcagctactcgggaggctgaggcaagataatttcttgaaccca

SEQ ID NO: 37755 - DNA, 601 bp, Human
cagcctggccaacatggtgaaatgccatctctattaaaaatacaaaaaatcagccggggatggtggtgtgtgcctgtaaccccagctactcagaaggctgaggcaggagaattgcttgaacccgggaggcggaagttgcagttagccgagatcacacaattgcactccagcctgggtaacaagagcgaaactccagctaaaaaaaaaaaaaaaaaaaaaaaaaagtgcgacgggtttcgactggtgaatacaaatacagaggcagccatcacgttatgtggaacactgaaataatttaccrtctaatttgagagtacctggagccaaattaaacaaacgattacctttcttctttgacggcgagtctactttagctgccggtttggattctgagggcgcctccgctaaggctgcgttgggaaggtggtcagcatctaacatagatgaaatctgagtactctcaagaggaggttcgagaagctctgccacagatgttgggtcgctcatctgtgtacccagggctctgggtttgggcttcactatggtacagacagtgtcttccatggaagcatccttctcaacttcactgatgaggttgtcc

SEQ ID NO: 37756 - DNA, 601 bp, Human
gcctgcaatttgttttcaaatgttttattaataaaacactgtatgtggatgaatggagagatgtagggagagaggggttgaggagagagggagggcaaaaatgtataataaaaagtagaggggaaaaagaatgaggccaaaagaatagtaaaaaccactcagggttcctgtctctagtcagatcctgcactgtgtgctaagaacaggagtcattagttccaaaaacaaagcattcatcctaaaagaactggatttccccccttaacatttcttagagcataacaagtggctacaggccttyggtggaagagcaggtgccaagttaagccaccattcgctagatggttttatctgaccaccaacaccttcgacagtcacattctttcattttagataaattatttctgagtgaacttgaaggtccatacctaatatatattaagttggtttataattacctaatctttggtgctagaatttttttttaattgaaataggtaattggctatatatgatgttgggtaattttagagaaggtttcacactttcctaaaaataggatccaaggccagagttcagaatatgtatgttctgacccact

SEQ ID NO: 37757 - DNA, 601 bp, Human
taatggtgaagtcttttttgtatttataggtctaagaacaagcatgaccaaacttaaggcaaccacctgcattgggaacgagggcattactctaaaaccatgaaggcaaggttgtctgggcacaggatattcacatggtgcccaagtatccaccctgcattaccttctaactacaaaaggacaaaaaatacttcacaatggatagatgtggcagataacatcttaaacaataatcacgttcagcattactattagtggtcatcatgagatacaatatgagtacccaatacatgcaataaastaatcttcaattcaaacaataactctaagcctctagacctgtactgcccactctagtgaccaccagccacatgtggctactgagcatttaaactgttgctaaagtgaggtacacaaaatgttaaaaatgcgtaaaacacactaagatacttccttaataattttatattgattacatattaaaattatattttggatttattggcttagatgaaatatatcactaaacttaatttcaccttattttacttccttaaaagtggcaatgagatgattcaaaattacacatgtgattcatatt

SEQ ID NO: 37758 - DNA, 601 bp, Human
tttcgcattccctcgcatataattttttaaactgaacatttaagaggattacagaaagaatgtgacctatttaacttagtccctagaatgaaccattggccataacacactttaaatttcttgcaaaatataaagcaaacaaacaatgaagagacagggaagaggcataatgagcttcctgtgaccctggaaaggaaagacttcaggaacacatggtcctgagcctctggccatgcagtctgccacatcacaccttcagttcctctaagggagagggaagacaaaagatgacactagtcayggaaagaaaattttcccttagaagaaaatcatacaggggccacaggccaaactgagaaatactaagagttcagttttaaaaggaaggttaaaaaaaaatgctgatgaattgaggacggatgcacatggcactcagcccagcctataggcatcctgacatgtctgctaaactccctcctgattcctgagcaagctttactctcgtgggccaaccctccagccttatacagaaagtaatcctcctaatttttgccagaaagaccacgtactcagtggacaatcaattttctacaacttcagg

SEQ ID NO: 37759 - DNA, 601 bp, Human
ggcaccggccggctccttggagctggatggcaggtcactggctggcggtgcctcagattttccctccttggattctggcagctgtaacagcaagatgataatggcaacatgcaattttttccctacagataagccaagttcatcagcagccctctctaggaaagaacacaactgccttctgaacccacaacttaaaaatgctcaaaaaccagactttctctattctgagccaaagaattagaaacctaagacagaagtcatgtgcttctatgcaaatcactgtccctacagacccagaagkaaaacattttaagagcaccatttcaagtcacaaaacataatacaagcgacccaaacttgttaggtccccagcttccttctcctcctgggagtaactcaccacgtgcagaagggactgaaaggcagcccccttgctgacgtggacatgaacttggttcaggcaagacttcccttctgacatttgaaaaacaggtgagaactccctgaaccctctttttcagaaggtgttggggaaaaaaagacttgctctgctgcttgtttagtatggttctctggatgaatttctatggagacctggtgg

SEQ ID NO: 37760 - DNA, 601 bp, Human
agcatgcactggccgggggaggtggacaggcagaagcaggaacacggcgtatcgcgagcaactcctctcagggctgctcaccctaactgtccaaagaatgctgtttcttccaggaaaggaaacccacccaagccaacctggagattattttgtatgtctccctttggctccggatgggatgcagggggagcagaggcacctgggccaacatggctgaagcgttcctcacggccccttcccatacgctggcgccacggctccacaaggaggcagggtatttatttttctaagctggtgatgttttttagaaaagcagttgtcatctgctgagtggcacaaatatatcacagcatgtagtatctgcagaagatactcccaagaactaaacaagctgccaaaatcaacttagaagtaatggccctgctagagggcctgagtgctatgagccgggcagaggacagggcacccacctggcaccggccggctccttggagctggatggcaggtcactggctggcggtgcctcagattttccctccttggattctggcagctgtaacagcaagatgataatggcaacatgcaattttttccctacaga

SEQ ID NO: 37761 - DNA, 601 bp, Human
aaagatataggatggggggcggtaaggggcaagaaaataaaccctcagccttagacactaaatgagacagccaagggctgggagaagcaagcatgcactggccgggggaggtggacaggcagaagcaggaacacggcgtatcgcgagcaactcctctcagggctgctcaccctaactgtccaaagaatgctgtttcttccaggaaaggaaacccacccaagccaacctggagattattttgtatgtctccctttggctccggatgggatgcagggggagcagaggcacctgggccaacatrgctgaagcgttcctcacggccccttcccatacgctggcgccacggctccacaaggaggcagggtatttatttttctaagctggtgatgttttttagaaaagcagttgtcatctgctgagtggcacaaatatatcacagcatgtagtatctgcagaagatactcccaagaactaaacaagctgccaaaatcaacttagaagtaatggccctgctagagggcctgagtgctatgagccgggcagaggacagggcacccacctggcaccggccggctccttggagctggatggcaggtcactg

SEQ ID NO: 37762 - DNA, 601 bp, Human
aaaagatataggatggggggcggtaaggggcaagaaaataaaccctcagccttagacactaaatgagacagccaagggctgggagaagcaagcatgcactggccgggggaggtggacaggcagaagcaggaacacggcgtatcgcgagcaactcctctcagggctgctcaccctaactgtccaaagaatgctgtttcttccaggaaaggaaacccacccaagccaacctggagattattttgtatgtctccctttggctccggatgggatgcagggggagcagaggcacctgggccaacayggctgaagcgttcctcacggccccttcccatacgctggcgccacggctccacaaggaggcagggtatttatttttctaagctggtgatgttttttagaaaagcagttgtcatctgctgagtggcacaaatatatcacagcatgtagtatctgcagaagatactcccaagaactaaacaagctgccaaaatcaacttagaagtaatggccctgctagagggcctgagtgctatgagccgggcagaggacagggcacccacctggcaccggccggctccttggagctggatggcaggtcact

SEQ ID NO: 37763 - DNA, 601 bp, Human
gacacagtgagactctagaaaaaaacaaaaactagtaagaaaaattttagacaccccttaaaagatataggatggggggcggtaaggggcaagaaaataaaccctcagccttagacactaaatgagacagccaagggctgggagaagcaagcatgcactggccgggggaggtggacaggcagaagcaggaacacggcgtatcgcgagcaactcctctcagggctgctcaccctaactgtccaaagaatgctgtttcttccaggaaaggaaacccacccaagccaacctggagattattttktatgtctccctttggctccggatgggatgcagggggagcagaggcacctgggccaacatggctgaagcgttcctcacggccccttcccatacgctggcgccacggctccacaaggaggcagggtatttatttttctaagctggtgatgttttttagaaaagcagttgtcatctgctgagtggcacaaatatatcacagcatgtagtatctgcagaagatactcccaagaactaaacaagctgccaaaatcaacttagaagtaatggccctgctagagggcctgagtgctatgagccgggc

SEQ ID NO: 37764 - DNA, 601 bp, Human
cactttgggaggccgagttaggaggacaccttgagcccaggagtttgagaccagcctgggcaacatagggagacccagtttctacggaacatttaaaaattagccaggggtagtgacacttgtctgtggtcctaactacttgggaggctgaggcaggaggactgcttgagcccaggagtttgagaccagcctgggcaacacagcaagaccctgtctctacaaaatacaaatttaaaaattagccaggcatggtgtcccacacctgtagtcccagctacttaggaggccgaggcaggattgyatgagccgaggagctatgattatgccattgcaccccagcctgagtgacacagtgagactctagaaaaaaacaaaaactagtaagaaaaattttagacaccccttaaaagatataggatggggggcggtaaggggcaagaaaataaaccctcagccttagacactaaatgagacagccaagggctgggagaagcaagcatgcactggccgggggaggtggacaggcagaagcaggaacacggcgtatcgcgagcaactcctctcagggctgctcaccctaactgtccaaagaatgctgttt

SEQ ID NO: 37765 - DNA, 601 bp, Human
aacactttgggaggccgagttaggaggacaccttgagcccaggagtttgagaccagcctgggcaacatagggagacccagtttctacggaacatttaaaaattagccaggggtagtgacacttgtctgtggtcctaactacttgggaggctgaggcaggaggactgcttgagcccaggagtttgagaccagcctgggcaacacagcaagaccctgtctctacaaaatacaaatttaaaaattagccaggcatggtgtcccacacctgtagtcccagctacttaggaggccgaggcaggatygtatgagccgaggagctatgattatgccattgcaccccagcctgagtgacacagtgagactctagaaaaaaacaaaaactagtaagaaaaattttagacaccccttaaaagatataggatggggggcggtaaggggcaagaaaataaaccctcagccttagacactaaatgagacagccaagggctgggagaagcaagcatgcactggccgggggaggtggacaggcagaagcaggaacacggcgtatcgcgagcaactcctctcagggctgctcaccctaactgtccaaagaatgctgt

SEQ ID NO: 37766 - DNA, 601 bp, Human
caatagctcatgcctgtaatcccagcactttgggaggccgaggcggggagatcacctgaggttcggagttcaagaccagcctgaccaacatgatgaaaccccatctgtactaaaaatacaaaattagctgggcatggtggcatgtgccggtaatcccagctactcgggagactgaggcagaagaatcacttgaacccgggaggcggagactgcagtgagccaaggtcgcgccattgcacttcagcctgggcgacgagcaaaactccatctcaaaaaaaaaaaaaaaaaaaaaaaaaaaaawttaaaatacccagaaaataaaccaaaaatgaaaatcagctatcttattaaattctagctaaaaaaataactgtcattctagttatagatgtaggtagtgcctgaaacacagcactgtgaggattaactgagatgacacaggttcgatgccaatgccaggtgcacacggctcccacaccatcaacaggaaaggagtgaggaagagcgggaatgcttcagcataaacacatgactcatgtggactgaagacttacaccattgttctatagttcttaaagcaagcttccagctcaccagagcg

SEQ ID NO: 37767 - DNA, 601 bp, Human
tcaaagaaatacaattttaaggctgggcgcaatagctcatgcctgtaatcccagcactttgggaggccgaggcggggagatcacctgaggttcggagttcaagaccagcctgaccaacatgatgaaaccccatctgtactaaaaatacaaaattagctgggcatggtggcatgtgccggtaatcccagctactcgggagactgaggcagaagaatcacttgaacccgggaggcggagactgcagtgagccaaggtcgcgccattgcacttcagcctgggcgacgagcaaaactccatctcaaaaaaaaaaaaaaaaaaaaaaaaaaaaatttaaaatacccagaaaataaaccaaaaatgaaaatcagctatcttattaaattctagctaaaaaaataactgtcattctagttatagatgtaggtagtgcctgaaacacagcactgtgaggattaactgagatgacacaggttcgatgccaatgccaggtgcacacggctcccacaccatcaacaggaaaggagtgaggaagagcgggaatgcttcagcataaacacatgactcatgtggactgaagacttacaccattgttctatagttc

SEQ ID NO: 37768 - DNA, 601 bp, Human
atgcgtgcactatctactcaaagaaatacaattttaaggctgggcgcaatagctcatgcctgtaatcccagcactttgggaggccgaggcggggagatcacctgaggttcggagttcaagaccagcctgaccaacatgatgaaaccccatctgtactaaaaatacaaaattagctgggcatggtggcatgtgccggtaatcccagctactcgggagactgaggcagaagaatcacttgaacccgggaggcggagactgcagtgagccaaggtcgcgccattgcacttcagcctgggcgacaagcaaaactccatctcaaaaaaaaaaaaaaaaaaaaaaaaaaaaatttaaaatacccagaaaataaaccaaaaatgaaaatcagctatcttattaaattctagctaaaaaaataactgtcattctagttatagatgtaggtagtgcctgaaacacagcactgtgaggattaactgagatgacacaggttcgatgccaatgccaggtgcacacggctcccacaccatcaacaggaaaggagtgaggaagagcgggaatgcttcagcataaacacatgactcatgtggactgaagacttaca

SEQ ID NO: 37769 - DNA, 601 bp, Human
gaaaaaaatggaggtacaggcaactaaggattatgttaagtttgtaagtactgatataaaatgttcagcatctagtccatgaaagccagattagaggacagaaaaaaccttggactatctttaaattacccactgtgaagaaaaaatataggggatattatttataaaggcaatgtgcaagatgcaaaccactccatcagacaagaagcaaaattatacccaggtaactgacatattcgtaattttcatattatggtattctcaactaatgctgaagacactgagattcttcagatcaatrtaatatatgtattaggaacccacaaacgccatggcacggctatcttcccctcaaagggtgccccaagagagagcagcccatgcaagaactatttccctcatgcatgcgtgcactatctactcaaagaaatacaattttaaggctgggcgcaatagctcatgcctgtaatcccagcactttgggaggccgaggcggggagatcacctgaggttcggagttcaagaccagcctgaccaacatgatgaaaccccatctgtactaaaaatacaaaattagctgggcatggtggcatgtgccggt

SEQ ID NO: 37770 - DNA, 601 bp, Human
ataaacttcctctcatttactgtgaaaaccaaattctcaaatttagcaggaaactgcttaggattatagaggtttcaccttccatggaaaacgtgggaaaaaaatggaggtacaggcaactaaggattatgttaagtttgtaagtactgatataaaatgttcagcatctagtccatgaaagccagattagaggacagaaaaaaccttggactatctttaaattacccactgtgaagaaaaaatataggggatattatttataaaggcaatgtgcaagatgcaaaccactccatcagacaaraagcaaaattatacccaggtaactgacatattcgtaattttcatattatggtattctcaactaatgctgaagacactgagattcttcagatcaatgtaatatatgtattaggaacccacaaacgccatggcacggctatcttcccctcaaagggtgccccaagagagagcagcccatgcaagaactatttccctcatgcatgcgtgcactatctactcaaagaaatacaattttaaggctgggcgcaatagctcatgcctgtaatcccagcactttgggaggccgaggcggggagatcac

SEQ ID NO: 37771 - DNA, 601 bp, Human
tacatccctctgaatttcacccacatcagaacccagagcccaggagatactcacatttggacggtttccaaaggcagcatagaagggctgcttagacggggcaaacagattcttgatatcatttagacactcaattttgaacttctctggtttcttttctatcacttctctaagaaaaaaatacaaatacaatcaccaatctcaaaatggtcgttttccccagtgagtggtcctaaaattttagtgctcacaaccacccaatttcttcaaccctttgtaactggaatctttccttctcctyctttgccagtctgataactaagaaaatttgagtgatgaagtttagggaaggagaaaacttgacggttcctagaacctgcctttcttcaccaggcccgccacatggcaagtgagcagtatgtggtaggacaccaccagggaccaaagaactgggagaggcgtggcggctccaacatctgacttctgttcccacacatccccccaccttgggcccagccccgcccacatgctggggcggtgggcagagggctgcctgccggagaggtacctgtggaaggcggagaacaagctgctgggggac

SEQ ID NO: 37772 - DNA, 601 bp, Human
cacctgaggcccgatggccctgcagaagggaggcaggttgggaagtgctagcgaagggccagcactgaccctggctctggggtgatccaaggacgcagctcagaactgcttagaagaggagccggagctgcctgaggaaatggaatggcagccacagaaacgatggaaaagcgtccttcgtataaattctggggcagatctgcacctgcaggacctccccagttgctatagatatttggaatagatcaagtgaaaaccgaacaagcagaacagatgcctcattttgcttacaaaactgctytgagaattgggacgtggctacaccccacgaagtacatccctctgaatttcacccacatcagaacccagagcccaggagatactcacatttggacggtttccaaaggcagcatagaagggctgcttagacggggcaaacagattcttgatatcatttagacactcaattttgaacttctctggtttcttttctatcacttctctaagaaaaaaatacaaatacaatcaccaatctcaaaatggtcgttttccccagtgagtggtcctaaaattttagtgctcacaaccacccaatttcttc

SEQ ID NO: 37773 - DNA, 601 bp, Human
gcctgtgatacctaagagaaaggttggggaagaggcacaggctattacttcaagatcggtcaaaggcacaagatggggggctgtgaagctgtcactcagattgctcaggtgggcaggttcagaggcaggcctcagtcccatcacagggctcaaactccctcttacaagtctaggataaccagagacccctcaaacagatattgtgaaagagagatacccacagaggagatgtagctgatcctttgatcagggcctgatctcaaggatcagggggaaaaggacagggtctgtctgtccccawctgtacccctggctgcagggcgccgggctgagagctgagaatgtacttacgatgacttgtttcctttggttctttcttgtattaattcacccttggggttcacggtgaatattctacagtctggaactccaacttgtgtgtaggcatagacatcctgcagaagaaaatagcaagcgggtgattccagggaggagaattcaggagatacttctcaggctccttgtgagccagaagcactgcacagacagactcgacagaaaacatgcggaggcggcacagtgcagttgccaccaaaactga

SEQ ID NO: 37774 - DNA, 601 bp, Human
taaaatgatgcaatggaaggaggccccagctcacagcaggaaacatgtgtgcgacccacaaaggagggatcccaggcctccagccccaggcccagttcctcccttctccttccaggagctgagctgcagacctgccgagcctgagcagctggcctgggaaggcaaaggaggatggcgggaccagctccagaagcacccgtccccgctggggaaggctggtatctgaggtcagcagaagagccagctgccttcccttgctgtggggagggggaccaagccctgcccacccactgaggtgccrcctcaagacaggtcatccaggtccacttcagggatcgggtctcgccagtagcagaaggagctgaactccgggcagggaaaagcggaattctgctccttactgagaagggggaacacatgctccacgagctcactcagcctgtgatacctaagagaaaggttggggaagaggcacaggctattacttcaagatcggtcaaaggcacaagatggggggctgtgaagctgtcactcagattgctcaggtgggcaggttcagaggcaggcctcagtcccatcacagggctcaaactccctctta

SEQ ID NO: 37775 - DNA, 601 bp, Human
ccctaaaagcagagttgttgggggcggggcggggtttggtctgttttaagacccaccttcccacttttattacagacatcaaatatatacttgtgagacctgttcttctggtgaggtctaagaaattaagggctcgtggagttgtcacagatgagaggaggatgctctgtggggatctttccccaaagagggccaggtttatgggactgggctcagtggctctggtgcatgggccctgcaggggcgggggtcctgcccaacttggcccactggagcagctgaccccttcagtgtagcaggraatgaggcgaccagagaagaaacgtgcacaggcagcttcagccagcatcactgactgggcccgcagcagttcagggaccctgacatctgaagacagccctggttacagaagccacctcaactgcccagtggaaactggaacacttcactgtgtgcagtgttttggtccactcttttttagctgcttttttcttcctttaaaatgatgcaatggaaggaggccccagctcacagcaggaaacatgtgtgcgacccacaaaggagggatcccaggcctccagccccaggcccagttcctccc

SEQ ID NO: 37776 - DNA, 601 bp, Human
aaagctctcattcttcctctaaatagaaggtagtcaagaggacacacagatggcatctatgaaataaggtggctgcatggctgctgtactagaattcacaaactgggaagaacttcatataaacagaacccaggatccctaacctactgtagataaataaactcattaaacaattagtccttatcaactatttaagctgggggaagctttgcatgggagaaggctcatgtggtcccttctctgggaacatgagccttcctaggttttgccactgagaactgtgtttaggggatttcaacattgtctctgcatccgacaagcactaggaaaatggctgaaatcagtcagggactttcaactctccaatctggaaaaataaccacccctatttctctatctctagatcagcattattttaggtgaagcaaactaaaacatgtagaggttccactacaacggcaggggcatgaagagttggccacgagaccaccccgagcgccaagcctgtatctgcagatccctctctgctcaggaaccaccacgtcctgtgttctcgccaatggagaccaagacctggggttggttctgggctcctgacagt

SEQ ID NO: 37777 - DNA, 601 bp, Human
aattaccaatttctggcaagaatctagaaagatggtttcaatgtcccctgaagaaaagagccaaatgcattcagtttatgttatgttcgtttattgttgtaacattttgttttgaacatcaaacactgcaccaaaatattagccattcatcttgcaacaattgctttactgtaactaagagtactgtactgatgatgtttacaattaactttggacaacttaaaacttattagtgacattgctgtctaataatcaaatacttcatcataggctgaacataattattaaaagagcaaagttwcccctccctttcttactttcaaacaaaaccaaaagagtagttttcatctggaaagagcacttacttcagggaaagactcaatttttaaccagttttattaaaccctggaagctctacaacacgggaaaacatcaaaattccccggaagtctgtttttgccaacttgtaaaaagtgaaagagctgacttccttgtttattctttaaagggttggcctgcacctgcagtgccaactgtggaagggctgtgtgcaggccccacagttgcaggggctgttccgggccagcgcttcccagtcatc

SEQ ID NO: 37778 - DNA, 601 bp, Human
aagcaacaaaaaggagctcctgctgtagacaaatttaagtgtcagcaaagatcaagatgctaatttatggaaattaccaatttctggcaagaatctagaaagatggtttcaatgtcccctgaagaaaagagccaaatgcattcagtttatgttatgttcgtttattgttgtaacattttgttttgaacatcaaacactgcaccaaaatattagccattcatcttgcaacaattgctttactgtaactaagagtactgtactgatgatgtttacaattaactttggacaacttaaaacttaytagtgacattgctgtctaataatcaaatacttcatcataggctgaacataattattaaaagagcaaagtttcccctccctttcttactttcaaacaaaaccaaaagagtagttttcatctggaaagagcacttacttcagggaaagactcaatttttaaccagttttattaaaccctggaagctctacaacacgggaaaacatcaaaattccccggaagtctgtttttgccaacttgtaaaaagtgaaagagctgacttccttgtttattctttaaagggttggcctgcacctgcagtgc

SEQ ID NO: 37779 - DNA, 601 bp, Human
ctctcagtgggtcctgggaatagagatgaaggtgacatgaggtctgaattagagaggtcatttaaacaaattttccaggccactttaccatgtaaagatgagcagagaaagttcacaggaataagatttcttgtattttgttaaacatttcataccttagcgattctccgtcataagtgaattttagaccaagacatttcccgtttgcacagtgttgtcggaagttttagtttgaatataatttaccttagttttattatagttggcctgggaccatttttacttcccttgagagtcccaycaaacagcaggaatcattatcaagtacttagctgataaataataagaaagctacctgaccaggtaaaagtgtgaaatcacattcacacttaacaaaagggaatcattaaacgattgaattccaataggaggtgtcagacagacactgaagctacattaaactgacagttatttggtttgaaatgctacataatttccacacaaaatatttttatatacatatatatgttgtgagtttttacatttgcttccatttcctatcatgaaagtatagatcttgatcatgttacataatttgcac

SEQ ID NO: 37780 - DNA, 601 bp, Human
cttcccagccacttcacctatttataaaaatgcttttgttgcttatgttgtcaaagaaaaaacaaggtggggtaaacaatgataactctcagtgggtcctgggaatagagatgaaggtgacatgaggtctgaattagagaggtcatttaaacaaattttccaggccactttaccatgtaaagatgagcagagaaagttcacaggaataagatttcttgtattttgttaaacatttcataccttagcgattctccgtcataagtgaattttagaccaagacatttcccgtttgcacagtgtygtcggaagttttagtttgaatataatttaccttagttttattatagttggcctgggaccatttttacttcccttgagagtcccaccaaacagcaggaatcattatcaagtacttagctgataaataataagaaagctacctgaccaggtaaaagtgtgaaatcacattcacacttaacaaaagggaatcattaaacgattgaattccaataggaggtgtcagacagacactgaagctacattaaactgacagttatttggtttgaaatgctacataatttccacacaaaatatttttata

SEQ ID NO: 37781 - DNA, 601 bp, Human
gagacattttacattaaacatttagaagtttaatatatagcaatattgtattgtcaattgtaatcactgatcatttgaaagtctccctcatctgatatttttatcagtctctgcaaggaatcatattaaggtatttctgagaagttcagggctagatataaatatagcttttgtgtctttcttccttgctcatctcatgtgatttcgggtagccaagagtcacaagaatcataagttttccatctgagagcacatcaagtcactgaggggaaaacagttaacagcatttttttttttttttgcataatagtggtaatgttcaagatttctgctgcacttccttcctcattgtcattttcttatgaaaaagtaaagagaagttacagtagttggttgcttcccaaattaataaatgctgggtatacaaatgtgtagtcagcacattgtgtaaattgcattttgtagtattatttagttataaccctttttatccaaagactgtgcaactgagatctttcagagacattggatgagatggtgtcacttttacctagaaagtactttgctttgattcactgagcatcaatctttttcttttttg

SEQ ID NO: 37782 - DNA, 601 bp, Human
tgtgctccttcagtgatgtcaagcgcttgtagccccggtcgcagtaggggcaggtcagcagttgggcaaaagcatctggagttccaggtggcaggtctgtagccgagagacagagagagagagaagcgggccaaaaggtcagtaaatcaatggcagctaatgggctgactgcccgggatggtatgacaggaatcactgcaatctgctccacagagtgccatcattgcacccggccccctcgcacaccagtcccctcgcatgcccaggacagacttgtcggaatcagctcacactgtgctcraaaattaattaattacttcaggttttttttttttgggggggtgggggggacttaaacagctgataaatgaggaaattctctttaggtgactgacagttcctatgaaacctgtagccacagattactcaggaactcacagtgtgaaggggcgtttcaggtgtcggtggagaagaacaaaaggtgagggagtgtcggtctcaacttttttttcctcaaaagtaaaatatttcagaaagataggaatacatttagatatttttatctcttagaaatgggctctaattgttcttgttctttatt

SEQ ID NO: 37783 - DNA, 601 bp, Human
aaaaaagcagtgtgacttagaattctggaaaaaaaatgcagtcatccactctggatgctcaaggtaggaggtcagcctttttctagcagcaatgacacaaaagccttttgcaaaaagacagcacagaaacggtatgacaactgctagggtgtgctgaatcttcccacattcctagtgagacagatggtgttacatgggacacagggaggtttgttcaaacagcagcaaccttcaaagatcaagcagagcccagcccgccgagcgccattgagggaccagcgctcatatgttgctgagttgmataaacaaacagcaacagctgctttgtctccccccacagccctcagaggactactataaactttagttgtgccactgttaatatgatacaatcattttaatttactaattgtaaatgccatgagcaaatgaggggacttttcaacaccaaagctaccattcataatgcgccaacacaatcacacttctgcatgtgaaatttaaagcggttatgctagataaatatctaggcactttttttttccttgagtttttgtgcatataagcaaggggagataaactgttacataagtgcaactat

SEQ ID NO: 37784 - DNA, 601 bp, Human
tcattgaagtctagtggttctgttttaattttaagtaagcctgtctgttcagacatactaagtggttttccattctccaacttgtttcttaactgggtaatggctgaattagtaggagaagaagaaacagaattaggggaagaacccgtcttgatattgtttctcattcggccatttacagagattaaaccaatacatttcttgctgctgatgtgcgaactgtaggaaccagaatgggagaaacgtttcttgcagtttgggcactcgtaaggtttttcacctaaaatgataattaaaattrccgttacatttccttgattagataacaattgcaattgtctaccaagagaagaatctgtgaaaccaaacaaaaggaacacaatggggtacctctacattctaggtacttagattagaattatgtgaccataaccatttctgaactttatctgccctgggaggacataattcaagatgttcacagtggaaggtaagggctatctatgcctttttcagctgagatcccaaatcttgtctgccatcggcagcctcctatttaaacagagtgtcagactaatgtgtggtcaatagcacaataaag

SEQ ID NO: 37785 - DNA, 601 bp, Human
ttttaagaatactcttcaaaataaaccattctctgtaaaacaaatgtacctattaaaatgtgtatatacattattgcaagttgtgcacatctttatatttatttatttatttaagacagagtcttgctctgtctctcaggctggagtgctgtggcacgatctctgctcagtgcaacctcagcctcctgggttcaagtgattcttctgcctcagcctttcaagtagctgggattacaggcacccagcactacacccagctaatttttgtatttttaggacagatggtgttttaccatgttgrccaggctggtctcaaactcctgacctcaagtgatccaccctcgttggcctcccaaagtgctgggattacaggcatgagccatcacacctgtcctgtgtacatctttaaaagcacgtgacggttataaactttaacttctagcacctaggtaagtcctaccaaatattttcaccaaagtttaattttaaaagcagatgagtccatctaaatacatctcaaaataaatattaatttcttctttatcctttttgtttttaaagcaaatgtgcttagagtacagtgatccactgtttcatccat

SEQ ID NO: 37786 - DNA, 601 bp, Human
tgcagatcttggattgtgggaagtaatattaaattacatatggtacttcatctttcttttcaaaaattaacccactatctctctactcatagtgaagaattaggctgttttcttgtcaactctttgtaattgttcctaattagtaatgcatgaattggaaatatactaattaaaatttagaaagttttatttcaatcttccaaatataggtggtttcaagtagctcatctgatctattacttttcttttatgacactaatgcctttagttctttcaaaatgtggcgaatttaaaaaaaaaaggcaaacaaaattacccctaaattatggctttcttggtgttttggatgatgaaactaatgtattactgtctgaatttcttattagatttttacatatataggttcatcttaagctttgaaacttaagaatttgaaggtattttcaataactggctgtgtcatgccatttcattgccctggccatctgactgtccctttgacataatttctaaatttggtttacagaataactggaaagatattaagacaagcacactcataaagacatgaatgatccaataaacaggcaacaaaaaagtc

SEQ ID NO: 37787 - DNA, 601 bp, Human
ggctggtctcaaactcttgggctcaagcagtcttcctgccttggtctttcaaagtgctgggattacaggcgtgagctgctgcgcctggctcatattcccttttctgtcttccttctttttcttttgtgcctcatcatcgcttttcccccaaaaagctttccccccaaagtgctagttttttttcctccatattgaaatgtttgatactagacttcctggtttagaatgagttgttttcctatactcccctattttttttgttccctcgtgccaaaattttgactgagatcctacacttttycccccccgatccagggctaatagagcatgccaaatttccagtggagaagaattggagatgggctaggggtagggatgaggttcagctaccttattgttcagggaggtggggatggagccagggaggaaacacaagtggagctcaaccatagagctgcagatcttggattgtgggaagtaatattaaattacatatggtacttcatctttcttttcaaaaattaacccactatctctctactcatagtgaagaattaggctgttttcttgtcaactctttgtaattgttcctaattagtaa

SEQ ID NO: 37788 - DNA, 601 bp, Human
gtctcactatgttgtgcaggctggtctcaaactcttgggctcaagcagtcttcctgccttggtctttcaaagtgctgggattacaggcgtgagctgctgcgcctggctcatattcccttttctgtcttccttctttttcttttgtgcctcatcatcgcttttcccccaaaaagctttccccccaaagtgctagttttttttcctccatattgaaatgtttgatactagacttcctggtttagaatgagttgttttcctatactcccctattttttttgttccctcgtgccaaaattttgaytgagatcctacactttttcccccccgatccagggctaatagagcatgccaaatttccagtggagaagaattggagatgggctaggggtagggatgaggttcagctaccttattgttcagggaggtggggatggagccagggaggaaacacaagtggagctcaaccatagagctgcagatcttggattgtgggaagtaatattaaattacatatggtacttcatctttcttttcaaaaattaacccactatctctctactcatagtgaagaattaggctgttttcttgtcaactctttgta

SEQ ID NO: 37789 - DNA, 601 bp, Human
actaaaataaaagttgtacactcaccgtgtagtaaatgatagagtttgcatatggtcatataataaaaccaatcagagagggaaagatgccttcagtgatgtgcctattgtagctgaataatggaatacaaaatatatttaaggttgattaaaatattaaaattaaagtaaaatttaggtatgaaaatatctttactttgtaaatgcttaagtagcacttagtactaaagaaaatatctacactaaaagaaaattttgatgtttcaaacattgaattatataacacaagtataaaagctgyttggatttagattgggttgtctttaaggtatcattaaacttttaaaataataacaatgaatatcagacagctaaagaaaaagaaaactgtattggttggagtaagaaccctgttatttatcaaccttgttgcttcacaaaaaccctccccacactatcaggctgatgctggtcacttgagctgcctccagcatgtgcccagtgaggaataatagccgatgatgagtacgagtacttcccaaggacagttttcagtgacagaaaagagtgccttgtatctaggtagtcaaaatatgacagg

SEQ ID NO: 37790 - DNA, 601 bp, Human
gcgggcacctttttaaaatgtattaatataaattagacatagttttttaaagtttgtagtgatacataagtagagtgcaattcttacaattttctagttgtgcttaaagtataaatgctattaaacacaggaattagtctctgaaccacacagtttttaggccttaacactgtacaaaatttttgcataatgcagtttttaacaatacccagctccaactctgtctacatctgtcttggctgaaccgccccttctgtccctctctacagcttcctggaagcgtcaggcacgtgcatgaacmgcttaacacagcagtgttttcaagcaggtaacaatactactggaaaaaaaaataggaagcttaaaatgcagtagtttattacatgccatcttccatattgtcttcctcgtggtctgatttggtttccattttcccatcctccgaactatcgtccatggagtgatctccagtctcttcttcatctcgtatcgtttcgggatccgtatccatacttttattttcactttcttcctcttcctcctcgaactcctcgtcgccatcctgtctgcccagcttcccgtagccatcctcgccttcttt

SEQ ID NO: 37791 - DNA, 601 bp, Human
tgtatggtagtgcgggcacctttttaaaatgtattaatataaattagacatagttttttaaagtttgtagtgatacataagtagagtgcaattcttacaattttctagttgtgcttaaagtataaatgctattaaacacaggaattagtctctgaaccacacagtttttaggccttaacactgtacaaaatttttgcataatgcagtttttaacaatacccagctccaactctgtctacatctgtcttggctgaaccgccccttctgtccctctctacagcttcctggaagcgtcaggcaygtgcatgaacagcttaacacagcagtgttttcaagcaggtaacaatactactggaaaaaaaaataggaagcttaaaatgcagtagtttattacatgccatcttccatattgtcttcctcgtggtctgatttggtttccattttcccatcctccgaactatcgtccatggagtgatctccagtctcttcttcatctcgtatcgtttcgggatccgtatccatacttttattttcactttcttcctcttcctcctcgaactcctcgtcgccatcctgtctgcccagcttcccgtagccatcc

SEQ ID NO: 37792 - DNA, 601 bp, Human
acaataataataataaaaatactgatgtatggtagtgcgggcacctttttaaaatgtattaatataaattagacatagttttttaaagtttgtagtgatacataagtagagtgcaattcttacaattttctagttgtgcttaaagtataaatgctattaaacacaggaattagtctctgaaccacacagtttttaggccttaacactgtacaaaatttttgcataatgcagtttttaacaatacccagctccaactctgtctacatctgtcttggctgaaccgccccttctgtccctctcyacagcttcctggaagcgtcaggcacgtgcatgaacagcttaacacagcagtgttttcaagcaggtaacaatactactggaaaaaaaaataggaagcttaaaatgcagtagtttattacatgccatcttccatattgtcttcctcgtggtctgatttggtttccattttcccatcctccgaactatcgtccatggagtgatctccagtctcttcttcatctcgtatcgtttcgggatccgtatccatacttttattttcactttcttcctcttcctcctcgaactcctcgtcgccatcctg

SEQ ID NO: 37793 - DNA, 601 bp, Human
ttaaattaaaaaggaataacaataataataataaaaatactgatgtatggtagtgcgggcacctttttaaaatgtattaatataaattagacatagttttttaaagtttgtagtgatacataagtagagtgcaattcttacaattttctagttgtgcttaaagtataaatgctattaaacacaggaattagtctctgaaccacacagtttttaggccttaacactgtacaaaatttttgcataatgcagtttttaacaatacccagctccaactctgtctacatctgtcttggctgaaccrccccttctgtccctctctacagcttcctggaagcgtcaggcacgtgcatgaacagcttaacacagcagtgttttcaagcaggtaacaatactactggaaaaaaaaataggaagcttaaaatgcagtagtttattacatgccatcttccatattgtcttcctcgtggtctgatttggtttccattttcccatcctccgaactatcgtccatggagtgatctccagtctcttcttcatctcgtatcgtttcgggatccgtatccatacttttattttcactttcttcctcttcctcctcgaa

SEQ ID NO: 37794 - DNA, 601 bp, Human
taaattcacacatgcatcacttcaagttccttcacagaaaaaaaaaaaaattgaggcctaaaattgtgtggttacttaagctgaaaaaaaaaatgggaaattgatgaatagcgaaaggaaagtacagaggaatcataatactgatgcattgtagtgcgagcacattaaattaaaaaggaataacaataataataataaaaatactgatgtatggtagtgcgggcacctttttaaaatgtattaatataaattagacatagttttttaaagtttgtagtgatacataagtagagtgcaattyttacaattttctagttgtgcttaaagtataaatgctattaaacacaggaattagtctctgaaccacacagtttttaggccttaacactgtacaaaatttttgcataatgcagtttttaacaatacccagctccaactctgtctacatctgtcttggctgaaccgccccttctgtccctctctacagcttcctggaagcgtcaggcacgtgcatgaacagcttaacacagcagtgttttcaagcaggtaacaatactactggaaaaaaaaataggaagcttaaaatgcagtagtttattac

SEQ ID NO: 37795 - DNA, 601 bp, Human
agacaggatggaggaggccggtgcagcatggactgggtgcaggctcccagctcaggactcagctccgcacagggagacccgagtggggtctgcactccctcctgagatccgggtgggcctgacagctgatgcagagacaggactctgggtagagggaccactggaggtcggaacagatggagcacctcatctcaggctcacggggtttgcagctcctccttctgtctctggccacagcctcacgtgggggatcgtgttacgagtggggtgctgaggagtccagagggccttctgccccctmtgcccctctgatctctcttgcactcctgtgagttagaaccagaaaagcaacattatcaaagtgactcaagtccttaccatagcaaaatgactctaagtggtgttagcatctgtgtgtgtgtatttttattgaacacttacatgtgcttacgctgtgccaggcatcattctaagtgctttacaacgattagcttctttaatcctcataactccaggaggtgcgttgctatccccattttgcagatagaaaaccaaggcacagagaggctaagtaatttgctcaagggttatataaagatca

SEQ ID NO: 37796 - DNA, 601 bp, Human
ctctcttgcactcctgtgagttagaaccagaaaagcaacattatcaaagtgactcaagtccttaccatagcaaaatgactctaagtggtgttagcatctgtgtgtgtgtatttttattgaacacttacatgtgcttacgctgtgccaggcatcattctaagtgctttacaacgattagcttctttaatcctcataactccaggaggtgcgttgctatccccattttgcagatagaaaaccaaggcacagagaggctaagtaatttgctcaagggttatataaagatcacacgtacatacasgtataatgtctgcttggaaaagacgttctgttctaggcgaaagtaacagaggagaaggaacatttcttctactagacatgataaataattggctttccttaatacttacaataaccgtgtgatgtaagtattttcctgatcttatagagggggagactgaaacttagcgaggttcaatagcttgcgcacggaccccatggctagatggagtgaccccaaagcatgaacatgtcctacgtgccatacaactttcatctgggcctgtgattgagaatcgtggccttagcacatctcttgcca

SEQ ID NO: 37797 - DNA, 601 bp, Human
aagcaacattatcaaagtgactcaagtccttaccatagcaaaatgactctaagtggtgttagcatctgtgtgtgtgtatttttattgaacacttacatgtgcttacgctgtgccaggcatcattctaagtgctttacaacgattagcttctttaatcctcataactccaggaggtgcgttgctatccccattttgcagatagaaaaccaaggcacagagaggctaagtaatttgctcaagggttatataaagatcacacgtacatacacgtataatgtctgcttggaaaagacgttctgtkctaggcgaaagtaacagaggagaaggaacatttcttctactagacatgataaataattggctttccttaatacttacaataaccgtgtgatgtaagtattttcctgatcttatagagggggagactgaaacttagcgaggttcaatagcttgcgcacggaccccatggctagatggagtgaccccaaagcatgaacatgtcctacgtgccatacaactttcatctgggcctgtgattgagaatcgtggccttagcacatctcttgccaccccagggaaggatctgcctagccacctggcc

SEQ ID NO: 37798 - DNA, 601 bp, Human
accttctttggatggacatcccaagaactttgcttgcttcgacttgagtcacagagaaaagatgccagatttgggaagcgggtgccagacttttccagggaaggctgacagctgatcacattatagatacggacatagattgcagaggagagagacttgttttttcacttttgtttgaatttattaagggtggctcctaaaaatcaatattagagaaaatattttatctttaaagtcaatgttagtctcatcgattgcattttctgtttggcttatttagtatccagaacacttaattacmaaaaatagcatttgataaaatgaggcatccattccttaaataaactttttaaagtagacataggagcagattccttgacaacagaaacagtgtctgtcttaaaccagcagctcattccagttaaatgcaaggctcaagcaagattgcttaccatcagcataatcatgatcattttaattattgttgcttgagtgtttttttttcccaagcactatgttaggctcatcacataccttgtccttaatttttaaaatgccccttcaaggtacatattatgaacatttcacagctgacactttg

SEQ ID NO: 37799 - DNA, 601 bp, Human
tccttaaataaactttttaaagtagacataggagcagattccttgacaacagaaacagtgtctgtcttaaaccagcagctcattccagttaaatgcaaggctcaagcaagattgcttaccatcagcataatcatgatcattttaattattgttgcttgagtgtttttttttcccaagcactatgttaggctcatcacataccttgtccttaatttttaaaatgccccttcaaggtacatattatgaacatttcacagctgacactttgacctagagtagccccgtcactcatagctgggargtgtttgagttgtgatttgaaaccagatatatctgactgcaaggtagtgactttcttttacctcatgataggtcatttttactcaatattgctctgaaagttctggccaatgaaataggacgtgaaaataagaaactagacatgaaatcagacaagaaaaagaaagatcacttgtgggcacccacgcaggtcatctaatctctctttgccttgctcccttcatctgttggaggaaagaaaggacttggttttcagtgttcctcatcctttgccccaccagccaaggttttggggagcttt

SEQ ID NO: 37800 - DNA, 601 bp, Human
tgacaacagaaacagtgtctgtcttaaaccagcagctcattccagttaaatgcaaggctcaagcaagattgcttaccatcagcataatcatgatcattttaattattgttgcttgagtgtttttttttcccaagcactatgttaggctcatcacataccttgtccttaatttttaaaatgccccttcaaggtacatattatgaacatttcacagctgacactttgacctagagtagccccgtcactcatagctgggaggtgtttgagttgtgatttgaaaccagatatatctgactgcaargtagtgactttcttttacctcatgataggtcatttttactcaatattgctctgaaagttctggccaatgaaataggacgtgaaaataagaaactagacatgaaatcagacaagaaaaagaaagatcacttgtgggcacccacgcaggtcatctaatctctctttgccttgctcccttcatctgttggaggaaagaaaggacttggttttcagtgttcctcatcctttgccccaccagccaaggttttggggagctttacttttttcaacttatattgccaaaactatcggcatttttgtt

SEQ ID NO: 37801 - DNA, 601 bp, Human
gctctgaaagttctggccaatgaaataggacgtgaaaataagaaactagacatgaaatcagacaagaaaaagaaagatcacttgtgggcacccacgcaggtcatctaatctctctttgccttgctcccttcatctgttggaggaaagaaaggacttggttttcagtgttcctcatcctttgccccaccagccaaggttttggggagctttacttttttcaacttatattgccaaaactatcggcatttttgttttacccaaattaaattcaggtgattggaacggggaagggatgacaacmtttctaggattaccaacaatggctaagatctcttccagcctgaaatttcctcaactcgaaggcaggaatgaggtaatggctttaaaataccaaaacttgggcctggcgcggtggctaacgcctgtaatcccagcactttgggaggccgaggtgggcagatcatgaggtcaggagatggagaccatcctggctaacacggtgaaaccccatctctactaaaaatacaaaaaaaattagccgggcatggtggcgggcgcctgtagtcccagctactcgggaggctgaggcaggagaatggcg

SEQ ID NO: 37802 - DNA, 601 bp, Human
cttccagcctgaaatttcctcaactcgaaggcaggaatgaggtaatggctttaaaataccaaaacttgggcctggcgcggtggctaacgcctgtaatcccagcactttgggaggccgaggtgggcagatcatgaggtcaggagatggagaccatcctggctaacacggtgaaaccccatctctactaaaaatacaaaaaaaattagccgggcatggtggcgggcgcctgtagtcccagctactcgggaggctgaggcaggagaatggcgtgaacccgggaggtggagcttgcagtgagccragatcacgccactgctctccagcctgggtgacagagtgagactccgtctcaaaaaaaacaaaacaaaacaaaacaaaacaaaaaaccaaaacttgtgctgcttagaacattagctgagcaggtgatccatttttaaagtttccacaattagagatatttatgatatactgggataaccgaagttaagcaatcctctttatataggtaggacttgtcaatatgtttttagtggatgttggaatctccaagaaagggggtaagtgcacagcttttttcttaacttatttgaccatggaactc

SEQ ID NO: 37803 - DNA, 601 bp, Human
aacgcctgtaatcccagcactttgggaggccgaggtgggcagatcatgaggtcaggagatggagaccatcctggctaacacggtgaaaccccatctctactaaaaatacaaaaaaaattagccgggcatggtggcgggcgcctgtagtcccagctactcgggaggctgaggcaggagaatggcgtgaacccgggaggtggagcttgcagtgagccaagatcacgccactgctctccagcctgggtgacagagtgagactccgtctcaaaaaaaacaaaacaaaacaaaacaaaacaaaaarccaaaacttgtgctgcttagaacattagctgagcaggtgatccatttttaaagtttccacaattagagatatttatgatatactgggataaccgaagttaagcaatcctctttatataggtaggacttgtcaatatgtttttagtggatgttggaatctccaagaaagggggtaagtgcacagcttttttcttaacttatttgaccatggaactctgtttcttggagaatcttaaggggctgctgttctgtggaacttattttagaaagtagtgactttcattgtcatctgtctttgctg

SEQ ID NO: 37804 - DNA, 601 bp, Human
agatcatgaggtcaggagatggagaccatcctggctaacacggtgaaaccccatctctactaaaaatacaaaaaaaattagccgggcatggtggcgggcgcctgtagtcccagctactcgggaggctgaggcaggagaatggcgtgaacccgggaggtggagcttgcagtgagccaagatcacgccactgctctccagcctgggtgacagagtgagactccgtctcaaaaaaaacaaaacaaaacaaaacaaaacaaaaaaccaaaacttgtgctgcttagaacattagctgagcaggtgrtccatttttaaagtttccacaattagagatatttatgatatactgggataaccgaagttaagcaatcctctttatataggtaggacttgtcaatatgtttttagtggatgttggaatctccaagaaagggggtaagtgcacagcttttttcttaacttatttgaccatggaactctgtttcttggagaatcttaaggggctgctgttctgtggaacttattttagaaagtagtgactttcattgtcatctgtctttgctgtaacagtgattctgcccttcagtttggggacataatggac

SEQ ID NO: 37805 - DNA, 601 bp, Human
gtgtgcccgtttttaggtggtccaatatgattcttaaagggggcataagtggaggcaatgggaagtatcaggatctgggatggagtgtggctagaatgcaaaagcatattcagccttgtaattttaggttggaaaaaagactgttatgtgtgttgtatagtctctaaaggagggcctgagatttttatgatgagggagagggttaaaaagcccagcagcagagctcagtggttatgccagctttccctgtattcagcacgctcacttgcactcgctgggtgctgatacagccacttctctytctgcagctgccaccatctttacagcagaaccagcagagctataatgagcagtgttggtgcctggggcaaagctccacagatcaactctgtaataaatgatgtggctcaccgctggggcttcctgcaaacccagccatccgatttcaaccagccattcttgctaactaggtgctaaactcagcagttgctaaaagaagacaagaggtgtcaacttaattgattttttttacaattccaggccttttaaaattattttaaatgtctatgtgcactctaactcgcattccctgaggacagag

SEQ ID NO: 37806 - DNA, 601 bp, Human
ttgctgcagtctgggctggccagtccaggctctgaaggaggagcattttccagcagcccttgacacttcacttgttgcagaagctttgggttggcccaggatcactcctttactgtcactgtgggaccagcccttttatctcactagagcataagtgacttctgtttagaggctcgtatttgatgaagcattattatgattacagtcaccgtcagggagcttcacttcactcacaactaactgcaagttcagaaatgcttatcatggctttctgtcgaggcaggcattcaggctcatcgayggaaaagtacagtaaaatgcattttcagccccctttttgaagactcttctatcatccattcactgtgttgaattaaagtgagtacaataggacttaaaagtcatattttgatttctctcctttattatccagatgctgctgtgtaatagagacacatacaagatataaaacaaaggatgatttacttagacttatagaaaagaaataggcacagcttatggtagtcctatgtaaagtagagaatccaagatggtgatagcagtccaaagcagcagcatcttggcaggtgtggctctaaaa

SEQ ID NO: 37807 - DNA, 601 bp, Human
ttcagaaatgcttatcatggctttctgtcgaggcaggcattcaggctcatcgacggaaaagtacagtaaaatgcattttcagccccctttttgaagactcttctatcatccattcactgtgttgaattaaagtgagtacaataggacttaaaagtcatattttgatttctctcctttattatccagatgctgctgtgtaatagagacacatacaagatataaaacaaaggatgatttacttagacttatagaaaagaaataggcacagcttatggtagtcctatgtaaagtagagaatccragatggtgatagcagtccaaagcagcagcatcttggcaggtgtggctctaaaagatcctttgtgtcctccagggttgcattgttttccatgttgctgatgagccagtgagactgttttcgggtggattgagtcatcctgagtatttaaacatttgtgtcctgatttacctcctggttcgcctccgaattcctagagctgatggctgtacacatgcacaggtgtgaggcacaggatctgggtccctaattttcccagacaaatgctggttcccaagttcccggcggacttcagaagactct

SEQ ID NO: 37808 - DNA, 601 bp, Human
gatgctgctgtgtaatagagacacatacaagatataaaacaaaggatgatttacttagacttatagaaaagaaataggcacagcttatggtagtcctatgtaaagtagagaatccaagatggtgatagcagtccaaagcagcagcatcttggcaggtgtggctctaaaagatcctttgtgtcctccagggttgcattgttttccatgttgctgatgagccagtgagactgttttcgggtggattgagtcatcctgagtatttaaacatttgtgtcctgatttacctcctggttcgcctccraattcctagagctgatggctgtacacatgcacaggtgtgaggcacaggatctgggtccctaattttcccagacaaatgctggttcccaagttcccggcggacttcagaagactctggctctggagcaaggccatctctttctcataccctctgcttgattgagccacagctgacctggccagcgtggtattatttaccatggggctcacttccttatctgtctggtcccacaaagggctgggtaaagaacagaactctttgcaaaaacaaaagtgaccaaccatcctggtgtgtccagga

SEQ ID NO: 37809 - DNA, 601 bp, Human
tggtgaacactaggtggcagcgtggttctgcggctctgcagaacaccgggtgaatttggttacagcatttttggtgcttaccttcgcgatgtaattttccgagaaaggtggggtgatggcttagtaattatgcagaatattgatagctttgattcgtttagaaagtcttgcattcagctcccacttgtccacaacatcggcaactctaaagctgctgcccggtgcctggtttcccaaactaccttgcagaggtgtgtgtctgtctctcttagtggtgtctgtaaggccctttaactgtactttttttttttcttatcactgttctaccccatctcctcttctttttgtgcgtaggtatttctgttatcattactgtcatcttttccagttatgtaactccttttgttcttatactgttagtataacccttgtgtccgagaaccagagattccaaattagcaggggatcccgtcaggtcattccaaacaaaataaggccaagattaggactttggctacgcagtacataaaacaaaacaaaaacaaaagatactaattttaagaagaaaatacttctttgccttacctaattccagtcccta

SEQ ID NO: 37810 - DNA, 601 bp, Human
attgtgtgaattaccattacagagacatgattttttgagaagagtttgaggtattagttcaacaaatatctatcaagtctttttgtcttatgtttacactgagaggcccagtaaagggtgaatctgaataactacttggtgagtttccacaagcacagctgatttgagtagcttgagccccaaacagccattttcccctcaacagccatgtttgtggtcctggatttaatagggcaaagtcttaaatgtccttttcactttgactcatcaagaccagccacatttttaagcagtacaaccrgtagtatttctctttcccttgtgatcccttcaccctgaaaacttctgttttcaaaatcccgtgagcctttttaggctcttaatataccacaagataaactaagaaaaaagtcttaatgtggaataggtgatgcagaggggtgcaggtattcccaaagatggtgagagaaaaggaagagacacctttccatcatagccagagcaatccattgtctgctaagagttctaagaagggaatggcatatagagttctggaggggactagttgatacttaaatattcccagccatagaattagtgg

SEQ ID NO: 37811 - DNA, 601 bp, Human
cagccatgtttgtggtcctggatttaatagggcaaagtcttaaatgtccttttcactttgactcatcaagaccagccacatttttaagcagtacaaccggtagtatttctctttcccttgtgatcccttcaccctgaaaacttctgttttcaaaatcccgtgagcctttttaggctcttaatataccacaagataaactaagaaaaaagtcttaatgtggaataggtgatgcagaggggtgcaggtattcccaaagatggtgagagaaaaggaagagacacctttccatcatagccagagyaatccattgtctgctaagagttctaagaagggaatggcatatagagttctggaggggactagttgatacttaaatattcccagccatagaattagtggtgcttagactgaagacctttcattttgcctcttcttgtcttgaacccgtttgatgactgtgtagagatattgcttgtagcactgccaaaggttgggatcaatggatagcagtcctagtgaataaagctccttttgttccagcagctcctgttaccagttaaaatgttctcctaataatcagtgctcacttgtgatcttgact

SEQ ID NO: 37812 - DNA, 601 bp, Human
agtggaggagccaagattgggtccagtgaagacaggctggtaggaccccaaagccatatttttaacacctacactagtctttgactagttggcaagaagaaacgcacaaaatggctagtgaggtcgtattttataagtggctttacatgagccagaggcctgtgttcagggtctttgtatttccatgtgctggtcatagggcaagttggcaaatactctaagcttcagtgtgctcatctgtgaaatgaacataaagctttttgctttcctgtctccaagagcttttgcaggataaatgagrtgatggatttgaaagcacttcattgtgtatagccggtgggggggcattgggtggggaggtgaaataatacagttgtcagggcatgcagttaggaaatgcaaaagtatgtagggtatagggtcctaaaagtaatggaggatttaacaagacacagcgtgtggccaagctgaaatagagtggaagtgtcctggtattatcaagagggacttctcaggacagagacagtattggcatagaaaggagccacaaaaaatacctagaaagaggggagcagaagggatttcacaaaaagggaagagt

SEQ ID NO: 37813 - DNA, 601 bp, Human
caagattgggtccagtgaagacaggctggtaggaccccaaagccatatttttaacacctacactagtctttgactagttggcaagaagaaacgcacaaaatggctagtgaggtcgtattttataagtggctttacatgagccagaggcctgtgttcagggtctttgtatttccatgtgctggtcatagggcaagttggcaaatactctaagcttcagtgtgctcatctgtgaaatgaacataaagctttttgctttcctgtctccaagagcttttgcaggataaatgagatgatggatttraaagcacttcattgtgtatagccggtgggggggcattgggtggggaggtgaaataatacagttgtcagggcatgcagttaggaaatgcaaaagtatgtagggtatagggtcctaaaagtaatggaggatttaacaagacacagcgtgtggccaagctgaaatagagtggaagtgtcctggtattatcaagagggacttctcaggacagagacagtattggcatagaaaggagccacaaaaaatacctagaaagaggggagcagaagggatttcacaaaaagggaagagtgtgtacagaac

SEQ ID NO: 37814 - DNA, 601 bp, Human
aaaaggaacaagagggtactttcagtacggcaagctgtgggtggggagacacgtggtctctttcgttctcccttctcaccttccccttccccttcccttccttctatctagcaccttttgtgccaagcactatgtgttgggcccttctgctccaatgacatgactacagtttcaatatgtggcaaagctgttcacgcctctggcaacccagtaccttctggtgatcactcattgctctcccatccccctaggctggaaattttctctccccaacaaaggactaatgaagatgggctaaccrtgtttacagtagctgtatcgtagggatggtgcaagctttgtgcatttttctagcttattttccagaaacaaagttctcatttcccaaactatttgtgtaccagaataaatatgcagataaaggaaattgaaggctgctttcccaataagaaagttgaatcatcctgggtctgtcagtgtattgtgccaatcataatcttttctttataggaactgaagcatctcatccttgaagcagctgatggatttctgtttgtggtggctgctgagacagggcgagtgatttatgtgtctgactccg

SEQ ID NO: 37815 - DNA, 601 bp, Human
ttgtcttccccatttttttcacagtagacactgggaggtgcagttgcctgccccaggttacagagcccaggcctgtctccctccaatgcattcaatcacaacaccacaccccacacatgggcctctccatccaacagcacatccaaggcttcagactgctgacgctgtcagaaccggttggttttgaaaagacaaagaaggaatttaacatctgatcccaccctgatatccaggttaagtaactctcactctgtgagcagccaccacatttctccagtgggatgggaggccgagacagcartgccggcagtcccagccccagacccagccccagccccagccccggccacagggcactgtgggcagcggccaagcagccacagggacatcctggagcacaccgcacctcggccccgtgcttgtgttctttggtctccggccactgacagccaaggtgggggtcaaatgttgataaagggaagtggcttcttcttgcagaagcagggaggtggctacgtcagctaagagccagctcttgaactctggatttaaacaaaagcacttgaatagcccagacaggaggcccttagaacttgtttgt

SEQ ID NO: 37816 - DNA, 601 bp, Human
agtagacactgggaggtgcagttgcctgccccaggttacagagcccaggcctgtctccctccaatgcattcaatcacaacaccacaccccacacatgggcctctccatccaacagcacatccaaggcttcagactgctgacgctgtcagaaccggttggttttgaaaagacaaagaaggaatttaacatctgatcccaccctgatatccaggttaagtaactctcactctgtgagcagccaccacatttctccagtgggatgggaggccgagacagcagtgccggcagtcccagccccagmcccagccccagccccagccccggccacagggcactgtgggcagcggccaagcagccacagggacatcctggagcacaccgcacctcggccccgtgcttgtgttctttggtctccggccactgacagccaaggtgggggtcaaatgttgataaagggaagtggcttcttcttgcagaagcagggaggtggctacgtcagctaagagccagctcttgaactctggatttaaacaaaagcacttgaatagcccagacaggaggcccttagaacttgtttgtgaggaatttgagtttgaggggg

SEQ ID NO: 37817 - DNA, 601 bp, Human
cactgggaggtgcagttgcctgccccaggttacagagcccaggcctgtctccctccaatgcattcaatcacaacaccacaccccacacatgggcctctccatccaacagcacatccaaggcttcagactgctgacgctgtcagaaccggttggttttgaaaagacaaagaaggaatttaacatctgatcccaccctgatatccaggttaagtaactctcactctgtgagcagccaccacatttctccagtgggatgggaggccgagacagcagtgccggcagtcccagccccagacccagmcccagccccagccccggccacagggcactgtgggcagcggccaagcagccacagggacatcctggagcacaccgcacctcggccccgtgcttgtgttctttggtctccggccactgacagccaaggtgggggtcaaatgttgataaagggaagtggcttcttcttgcagaagcagggaggtggctacgtcagctaagagccagctcttgaactctggatttaaacaaaagcacttgaatagcccagacaggaggcccttagaacttgtttgtgaggaatttgagtttgagggggtgagag

SEQ ID NO: 37818 - DNA, 601 bp, Human
cccacacatgggcctctccatccaacagcacatccaaggcttcagactgctgacgctgtcagaaccggttggttttgaaaagacaaagaaggaatttaacatctgatcccaccctgatatccaggttaagtaactctcactctgtgagcagccaccacatttctccagtgggatgggaggccgagacagcagtgccggcagtcccagccccagacccagccccagccccagccccggccacagggcactgtgggcagcggccaagcagccacagggacatcctggagcacaccgcacctcrgccccgtgcttgtgttctttggtctccggccactgacagccaaggtgggggtcaaatgttgataaagggaagtggcttcttcttgcagaagcagggaggtggctacgtcagctaagagccagctcttgaactctggatttaaacaaaagcacttgaatagcccagacaggaggcccttagaacttgtttgtgaggaatttgagtttgagggggtgagagggagccagccaggaaccgggaaacttgcctctgctcttggattccctctccaggcacagtttacctataagtcaaaaagag

SEQ ID NO: 37819 - DNA, 601 bp, Human
ggatttatgcaaagggctttggggccaggtagatctaggcttaggatcataaggctttaggcaacatattcaactcctttgaggctcagtttccaggttcacaaaatgctgttatggggactgcttgagctaacatgtctaaggtgcttagcctataacttggacccaggagggtgcagaactgcccgctcccttgttctgttctctttccacagctcctaaggctgagcttccctttccccagctcctaaggtcgtgccttctgtgtgctagttgcatggagctaacaaatttcacactrtctcgggcgttctagttagaagaaacaaacaaaaaagaaggaccgcccttcctgtgcttcctcagagtgcagaagatgtgggtttcaaaacgtggacagtgactccctatgtcccctgtttttggtgcagacacagagaagtccctcttggttgctgacctgagaggcacatggccttgacctccagccccaaggggaaacagccaggttgctgttggggccgcagatgtgcctggccttacttactctgcagctcagcctcctcccctgtggtgtcagggacagcctcccaccctccca

SEQ ID NO: 37820 - DNA, 601 bp, Human
cctgagaggcacatggccttgacctccagccccaaggggaaacagccaggttgctgttggggccgcagatgtgcctggccttacttactctgcagctcagcctcctcccctgtggtgtcagggacagcctcccaccctcccagagctcttggtttggtttatttatcactcagggatttcccaccagggagccttatctgacatccgcaggctcagatcttgtctggcttcccctagggacagtgtggagggaggatggccagccccagccgtggggccagcacaccattgagtccctgcrggaagtgtgctctgagagcctgctccttgcagggcttgaggatagagatggggtattcacaggtgaccaagatgtccctgtccccatgctgcatgcagtctggccaagacgacagacaccaccgaagaatagaccacaagtgtggcgggtgtgaggaatgggtgagtcagaccttccctgatcacagggaccaagtccccattctaatctatggtcacattgtgatctctcagttggcaaacccgactgccatggcccagagatttaccagccctgatctggggtctgcacatgcctgtg

SEQ ID NO: 37821 - DNA, 601 bp, Human
aggggaaacagccaggttgctgttggggccgcagatgtgcctggccttacttactctgcagctcagcctcctcccctgtggtgtcagggacagcctcccaccctcccagagctcttggtttggtttatttatcactcagggatttcccaccagggagccttatctgacatccgcaggctcagatcttgtctggcttcccctagggacagtgtggagggaggatggccagccccagccgtggggccagcacaccattgagtccctgcaggaagtgtgctctgagagcctgctccttgcaggkcttgaggatagagatggggtattcacaggtgaccaagatgtccctgtccccatgctgcatgcagtctggccaagacgacagacaccaccgaagaatagaccacaagtgtggcgggtgtgaggaatgggtgagtcagaccttccctgatcacagggaccaagtccccattctaatctatggtcacattgtgatctctcagttggcaaacccgactgccatggcccagagatttaccagccctgatctggggtctgcacatgcctgtggaggggagaactcctgctcactgtattttgtgcc

SEQ ID NO: 37822 - DNA, 601 bp, Human
tccctgcaggaagtgtgctctgagagcctgctccttgcagggcttgaggatagagatggggtattcacaggtgaccaagatgtccctgtccccatgctgcatgcagtctggccaagacgacagacaccaccgaagaatagaccacaagtgtggcgggtgtgaggaatgggtgagtcagaccttccctgatcacagggaccaagtccccattctaatctatggtcacattgtgatctctcagttggcaaacccgactgccatggcccagagatttaccagccctgatctggggtctgcacaygcctgtggaggggagaactcctgctcactgtattttgtgccaggggtgtaatcacacccaggcctagccccaccagtcatttatatcccttcttccatttgtgccttgaccatgagaaccacacccgaatgctaccttctgcacatatgcgtgcgtatttccgtgtctggtttgctgtgtgtgcatacaatgtatacagcagtcccccttatctgccgtgttgctttggacaatttcagttaccagcagtcaaccacagtccaaaaatattaaatggaaaattccagaaagaactcatca

SEQ ID NO: 37823 - DNA, 601 bp, Human
ttaagacttgcattcaagtagcccttatttacttaataatagccccaaagtgcaagaatagtgatgctggcatattggtacaattgttctattttattatgagttgctgttaatctcttactgtttctaatttataaactttatcataggtgtgtatatataggaaacagcatagcatctatagggtttggtactattcacaattccaagcatccactgggggttttggattgtagcccccttggataagggggcactgctatatattttatttattcttcttccttctttttttttttttgagactgagtctcactccatcacccaggctggagtgcagtgacgcaatgtctgctcactgtaacctctgcctcctggattcaagcgattctcatgcctcagcctcccaagtagctgggattacaggcatggggcctggctggttttcgtatttttagtagagacggggttttgccatgttggccaggctggagcatattttcaatagaacaaaggggagatctgtatagccagagggacaatcttgtgatttggaaatgagatcttgcttcctgtcccagcttttccaccaaagttgtct

SEQ ID NO: 37824 - DNA, 601 bp, Human
tccaagcatccactgggggttttggattgtagcccccttggataagggggcactgctatatattttatttattcttcttccttctttttttttttttgagactgagtctcactccatcacccaggctggagtgcagtgacgcaatgtctgctcactgtaacctctgcctcctggattcaagcgattctcatgcctcagcctcccaagtagctgggattacaggcatggggcctggctggttttcgtatttttagtagagacggggttttgccatgttggccaggctggagcatattttcartagaacaaaggggagatctgtatagccagagggacaatcttgtgatttggaaatgagatcttgcttcctgtcccagcttttccaccaaagttgtctgatcttggatgacttatttaatttctctgagtctcagtattatcagctgtaaataataaaactcatcttaccaaactcttatgaggctctttctgaagcaatacatttgaaatcatattacaacatcaaagtgtcatacatagaaacttataaataaataaataatccatagaaagtgatcatttcattacgtctcctaccaga

SEQ ID NO: 37825 - DNA, 601 bp, Human
tacaggcatggggcctggctggttttcgtatttttagtagagacggggttttgccatgttggccaggctggagcatattttcaatagaacaaaggggagatctgtatagccagagggacaatcttgtgatttggaaatgagatcttgcttcctgtcccagcttttccaccaaagttgtctgatcttggatgacttatttaatttctctgagtctcagtattatcagctgtaaataataaaactcatcttaccaaactcttatgaggctctttctgaagcaatacatttgaaatcatattayaacatcaaagtgtcatacatagaaacttataaataaataaataatccatagaaagtgatcatttcattacgtctcctaccagagtctactgactccattttacaacgttaagcagggttaagcatcttgtatgttgcagtaccaagaaataaatcaatgaatacaatgtagctacatacctgagtgagataacttgggggtgagtggagagcaccaaacccagagtaccctagcaaccgaggcaaaaagaaaaacgctctggcttgcagagttttcatgatctcatttgtaaaagctaaa

SEQ ID NO: 37826 - DNA, 601 bp, Human
gagatcttgcttcctgtcccagcttttccaccaaagttgtctgatcttggatgacttatttaatttctctgagtctcagtattatcagctgtaaataataaaactcatcttaccaaactcttatgaggctctttctgaagcaatacatttgaaatcatattacaacatcaaagtgtcatacatagaaacttataaataaataaataatccatagaaagtgatcatttcattacgtctcctaccagagtctactgactccattttacaacgttaagcagggttaagcatcttgtatgttgcmgtaccaagaaataaatcaatgaatacaatgtagctacatacctgagtgagataacttgggggtgagtggagagcaccaaacccagagtaccctagcaaccgaggcaaaaagaaaaacgctctggcttgcagagttttcatgatctcatttgtaaaagctaaattaaaagttctgctataaagcaggcattgagtggttgctttctcataccgtggttacagaatgacccagatgcagcaccccatttcaccagaaggtagacggaggagttcccattgcaaaactgctctccctctctta

SEQ ID NO: 37827 - DNA, 601 bp, Human
gccagtgagaaagacgaggatagcaaacacattccgccagctctggatggaacgtgcctttcagaagcgggaggccctccagccgcagtggttcttaggtctcacagaaccacgggatggcttttaaaggaagtgtcctgtgtgtcgaatctttcagctgaaagtggacaaagtagcgggcagttccaagggcggccctcggaagtctggtcgcagtggcaaagccagcaccatggccagcagagcggtgagcagcactcccaccagcagcccggtcagactgaagtgttccaggtaaatygagcgagcaccgccttctcgtaggtaccggcgccttctctctgcttcctttccccctcggtctctgccgcaccaccgcctgcccgatagccgtcgtgagttctggcccagcctgggctcgagggagtccaggagtagaaagccccatcctacccagccagaaacgtcaggtgcatgtgggaaggagaaggggctgatgtagccttcgagctaagccacacaatagaggaggctgcagttggagatgcttcccagactccagagctatccagggtagaggcacaaaaccaaggccaaaggg

SEQ ID NO: 37828 - DNA, 601 bp, Human
gcttttaaaggaagtgtcctgtgtgtcgaatctttcagctgaaagtggacaaagtagcgggcagttccaagggcggccctcggaagtctggtcgcagtggcaaagccagcaccatggccagcagagcggtgagcagcactcccaccagcagcccggtcagactgaagtgttccaggtaaatcgagcgagcaccgccttctcgtaggtaccggcgccttctctctgcttcctttccccctcggtctctgccgcaccaccgcctgcccgatagccgtcgtgagttctggcccagcctgggctmgagggagtccaggagtagaaagccccatcctacccagccagaaacgtcaggtgcatgtgggaaggagaaggggctgatgtagccttcgagctaagccacacaatagaggaggctgcagttggagatgcttcccagactccagagctatccagggtagaggcacaaaaccaaggccaaagggggtctctcctaagagctgcaggcacccccaggcttggctgtctgtcactggctgaccctctttcttcccaccgtagcccccaggatgtggaggacatccccacccaggcccttgctcag

SEQ ID NO: 37829 - DNA, 601 bp, Human
cctgcgctaagataaacatggaagacaggccagccaggtctccacatacatcttccttccactccactctgcgttgcatttctcttatattttggccatctgctatctgttaggtgcaccttgcttggggccagcctggggtctccccgccagtggggttctcgtctaccctgggtccctgactcaaccttagatagacaaagggcatgtcctaatgccgtttacctgctgtcacaacagctccctggggagaacagtttccccgggtctcagacatttgaggacccttgcagagcatccygcagaaggctggggaggacctctgggctgcccctttagggatggccatgagggtgagtgcagactgggctcctgggacatgcccagtgcacggacagaggagctgactcccctgtggctctcttttcctctcctctgcaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccat

SEQ ID NO: 37830 - DNA, 601 bp, Human
ttttcctctcctctgcaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcrgccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccag

SEQ ID NO: 37831 - DNA, 601 bp, Human
aggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacrtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaac

SEQ ID NO: 37832 - DNA, 601 bp, Human
tcatcttataatttggttttattagaaaattacgccaaagagaaaaatcaatattcttttttcactcatttttaaagacttagctcagagatatattcctttgttttttgtttttttattaaagtatttctgttttatcaaaatagaacttacataagatgtacaacttgtaagtgaacacagcttgaaaagtttatatcagagttgtaattttacctaaatttcgttaaaactactaaaagccgtttaacctagtaattttagattttacttttcaagataatgttgcaattaaaaaccytttttccttttatgaaaatttgatcttttatgttgcccaggttagttttgaactcttggcctcaagtgatcttcctgccttggcatcccaaagtgctgggattataggcatgagcccctgccccccagccaaaaatctgtgactcgtaaggaccttcattttaggtgattttaatttttttttactaattatcctcaagtacttacagtaaaaaatatatgggttagcccattcattttgaaagtaaggaatctgaggaccatagttgacatgatattggcaaaggtgaaatgaacacct

SEQ ID NO: 37833 - DNA, 601 bp, Human
gccctggttgagatagtgaggattattatttttcagtgagtgtttttactttttatccttataacattaaaaaatttgaaagaaatgctttgtgtttaatgcttggttaacaaatctttttacaggaattcaaaagaaaaggggaggacaaaagtagttagtttgatctgatagagattttaagtctaaacatcatttagctgagtgcaaactaagttaaactagtcccatggtttggtttctgttttttaatcttctaagcatatgctgtgtttctgattgatgagttaagatatagaaktgaagaaagtgagagcgaagtttgtagtaatggctgtgagagatacacttttgtactttttttttctgctgtataaaaaatgaaatgtgccttatactcattattttattagtttgtaagatgaagtcataagactggtattttcttatgcttctcatcctatttattttgagagcagttacattttctttcccattttaccgtaacctttttattctgatgctacgtttggttttatggacattactgtaaattaacaacttcaataaggacatcatatgcagaagcactttatttact

SEQ ID NO: 37834 - DNA, 601 bp, Human
gatgagttaagatatagaattgaagaaagtgagagcgaagtttgtagtaatggctgtgagagatacacttttgtactttttttttctgctgtataaaaaatgaaatgtgccttatactcattattttattagtttgtaagatgaagtcataagactggtattttcttatgcttctcatcctatttattttgagagcagttacattttctttcccattttaccgtaacctttttattctgatgctacgtttggttttatggacattactgtaaattaacaacttcaataaggacatcatatrcagaagcactttatttactaagctcattgacatctagatttaatattgaaagaattaatactgttattctaaaaataccaaatattttaaaagaaaaatttaatacttttccatgaacagcaaaggagaatagacatgtctagtgaattgatggatttcgagggagatatttaagaaaaaacaaatatagtaatttgaatgtttagaggatttcagaaacaaaaaaacaaaatgggcttggagcaaatgaaattaacagtataagtaatgaatttttttgccatatatatttatggtttt

SEQ ID NO: 37835 - DNA, 601 bp, Human
gctctggagggtacatgggccttgcttcttggaataacttttctgactacaggatacagaaggcaattacatatttctaatacataatgggagaagacatacttaagcattgaatactgttagttgtattatcttacaagtatgtaattgacaggtgccaaaatgtatgtgctgattatatgtgtggaggattgagaaaaaagaggagttgagttaatttacatgaggatgacaggactgaattgataggatgaattgtggatggttgggaagaatgtgagagggcactgcacattttttycaaccatcctcaatgggcactgcacattcttcgtaaccatatatatcccaaccagatggagaatattttctctatatctagagaatatattgtaaatgtgtgtaatgtcagataattgagtttccttaactccagtttttatttggcactgtaaaattccaatataataccgaaaatataaatatccaaattaaattggaaatcctttttaatatttttcgttctttagtatatgtattagcaaactttgcctcagcctcacctgtgaacaaaacccttgtaaggttcatatgcttagca

SEQ ID NO: 37836 - DNA, 601 bp, Human
atgtaaatgtccccatctcttccccaaatgtcttttacaacttttattattattttttagattcaggaacaaatcaaggttcttacattgtatttattacgatgtctgttttgtctctttacttagaacagtccccgtgcccttgctttcacaaattttattaaatggcttttatttttaaagagtgcaggctgcttgttttatagaccaggggttgctgactttttctttgaaggaccagacagtaaatattttaagcttgtgtaccatacggtctgtgttgtaacttctcagttctgcygtttagtagaaaacagccatagacaatatgagggtgtgttataaaaaactttataaaaacaggcagcaggccgtatagtggatgtttcccattttgtatttgtctggttccttgtcattagaaacactataatgttaaacgttatcgtaatattattatgttaaacagttttagcatgtatactactattttattcttattttgcacttcctgcttcgcatttcaggggtaaacattttcaggttgcatggcttcccaacattaattcatcagcttaagtatcttttccaggaagtattc

SEQ ID NO: 37837 - DNA, 601 bp, Human
aaatgttaaaatgtgcaattagaaggggctgtccacctcagtgatataaagaacattaaccacagttcctctaatatcagcagcccttttagacttgtagggcaattctcaaatataccgcaaattaaatctgtctaaatcaaaactcattctctttctttccaaactgctctttgctctagagatagatccctgtatcagttaatattattatcctctcaggctatgttagaaattcaggctttgtatcagtctttactctgcctctcctttttctcatcaggttggaagattatccaaytacttgcatatttgatcatacctctccttccattcctatcacagctgcctaaattcaggcttttgtagctctcattacagtattctcttaatagatcagtcatcacttctttttcccctttttcaaactgatgtcagagttatctttccaaaatgcagatctgattaggtaacttctttgtaagccctcaggcttttgttttgtgggtagtcaggagctattaattatttggcatctattggttttgataatttggtcccagtctcctttgtttgtttgatgttttcccactcctctcca

SEQ ID NO: 37838 - DNA, 601 bp, Human
caattagaaggggctgtccacctcagtgatataaagaacattaaccacagttcctctaatatcagcagcccttttagacttgtagggcaattctcaaatataccgcaaattaaatctgtctaaatcaaaactcattctctttctttccaaactgctctttgctctagagatagatccctgtatcagttaatattattatcctctcaggctatgttagaaattcaggctttgtatcagtctttactctgcctctcctttttctcatcaggttggaagattatccaactacttgcatatttgwtcatacctctccttccattcctatcacagctgcctaaattcaggcttttgtagctctcattacagtattctcttaatagatcagtcatcacttctttttcccctttttcaaactgatgtcagagttatctttccaaaatgcagatctgattaggtaacttctttgtaagccctcaggcttttgttttgtgggtagtcaggagctattaattatttggcatctattggttttgataatttggtcccagtctcctttgtttgtttgatgttttcccactcctctccatgtgccattccccag

SEQ ID NO: 37839 - DNA, 601 bp, Human
gtctatatacttttctaacccgttcatgatgcatggaatttgccagtgcctaggcctcaccctgaaatctattagtccattgagtcctgcaagatccattttgtgtttcccactctcagtgaaagttccatgattatgtcaagttccctgattatgtcaattaaaatggactcttattgtacttttgggtagccagaggattctgcagtttttcagtgtattttaatggtagaagatttgagaattttaaaattagcatttttgtttacaaaatatgaagactagaaaggacctgaattcrtttcagtcattttatagccaagaaaatgaagattgaaagaattaccacttaaatgacttgtccaaagtcacacaaatagcctattgacagaattgattggaactctgtagtcctgaatcttagttcagtgttctttatgctgtacattgctatgcaaatgaaattatgaacaatcacacttttaaagaaagtacatagagcaaatgtttttttttcttcttccaggtttcagtctgaaagagaaagtggagatcgaaattttgcaataggatattacttaaaagaaaagaaggtttttaa

SEQ ID NO: 37840 - DNA, 601 bp, Human
agatgtgacgtttcacatctttggttacggccatagctgttttaaggactaaaagtgtattaaagttaaaacttaacaaaaatgtactgctttaagctctgttgtgcatttgccacttgtaaagtatatagactttttttatttcattctgctcatgtcaagtcataatgcccttctaaaagctttttttattttggaaattttcaaacatgtaaaacgagagagagagagagatacatttaatgttatccatcactcagcttcattaattatgaatacattactaatcttgtttcatctrtatgtgcatctgtttcccctatccttgtcatatttcagtatgtaattctaaataaggatccttaacaaaacataacaataatacagtttttacatataaaaattaaatattacatatcaaaactttaatatcattattaatatcaatattaaattgaatatcaaaatatttagttagtgtttagatttcctggattatcttgtaaattattatttctttttttttttttttgagacggagtttcactttgttgcccagactggagtgcagtggcacgatcttggctcactgcaacctctg

SEQ ID NO: 37841 - DNA, 601 bp, Human
ataaatttgtagatccaattcaggtgtgttttttttttttttttttttttttttggtctgcttgttttgtttagttttgtgtaaaagtactttattggtatacttcttttatttttgtttgtttatttatttatttattttgagacagagtctcactgtgtcgcccaggctggagtgcagtggcgtgatctcggctcactgcaacctccatcgcctgggttctagcaattctcctatccagaggtactgactgactgaatgttagtaagcaattaatgaacactgctctaatgacattaayttttttttttatcatttgtcaagttttgctaatgtaacttaaattttttgaggaggagtaatttaaattaccattttagaaaatcttttaagaatatataactttttattgttttctagttgtaaaatatttttaaaaaataatttgttatatttaaaaacaatacgtttatcttagaacaattagaaaatatagtcaggaagaataaaagcatccatagcctcacaatttagatgtaactgctataattccttagaatgtatctttaaacaatttttctatattcatatctatcccaaa

SEQ ID NO: 37842 - DNA, 601 bp, Human
tcatttgtcaagttttgctaatgtaacttaaattttttgaggaggagtaatttaaattaccattttagaaaatcttttaagaatatataactttttattgttttctagttgtaaaatatttttaaaaaataatttgttatatttaaaaacaatacgtttatcttagaacaattagaaaatatagtcaggaagaataaaagcatccatagcctcacaatttagatgtaactgctataattccttagaatgtatctttaaacaatttttctatattcatatctatcccaaactgtttcataatttttttttttttgagatggagtcttgcttcgtcacccaggctggagtgcagtggtgcgatcttggctcactgcaacctctgcctcccaggttcaagcgattctcctgccgcagcctcccgagtagctgggattacaggtgcctgccaccacacgcggctaagttttgtattttttgtggagacggagttttgccatgttgcccagggtggtcttgaactcctgacctcaggtgatctgcccacctcggcctcccagagtgctgggattacaggcatgagccaccgcacccggccttataa

SEQ ID NO: 37843 - DNA, 601 bp, Human
tcctggtcgacatagcaaactgctattcatcctgcaacaaatgatgtcaacaaagtggtcagggaagggataagaatgcagcttacacatatacatgtacagtaaactctagattcatatccttggacattatgtactggagtagagtatatgagtcaatgagtaatgagaataaaagtttagaatgggaaaaaaacgcatacttgatggtggtttgatatgtattaggagtttggattcatttgagaactgggagctgtattaagtttggagcaagttgattactctttagctgtattgygtttctgtttattaagcttcaattttttttttttttttttttttgagactgggtcttgccttgccactcaggctgaagtgcaagtggcatgatcatagttcactgcagccttaacttcccaggctcaagcgatcctcccacctcaacctcctgagtagctgcaatcacaggcaaacaccaccatgcctggctaatttatttatttattttttattttttattttttgtagaggcagaatcttactatgttgcccaagctggtctccaactcctgggctcaagcggtcctcccatctcagc

SEQ ID NO: 37844 - DNA, 601 bp, Human
aaagttatgtcagtgtctgacaaatgttagcaattttgtaagtttgctaacactttggttatctaactttattcctatagttgtaaaaaagcactatgattaaaaactcctttattggcagtattctaaaacctcatgttaggttgacagtcttcttccctttccccaaattttaatacccaccccaggtttctaaagcaaaaaattgaagagcattttcctcctgtgtttataatcccaactaaaacactatgtaatacatgttggaaatattactgtgctttgtatatgtattaatttyttttgccctaaattggcctctaggaatgtgaaagtagatgtacccacctgataagaaaaagtgagctaagtaactaacttgataactaggcattcaacaagtctttttctctatttcatagaatcagtgtcaccttaaattataataggtttgcacagaattcgtgaattcttgagatagagtcttgctctgttgcccaggctggagtgcagtggcgtgatctcgttcactgcaacctctgcctcccaggttcaggcaattctcctgcctcagccacctgagtagctgggattacaggtg

SEQ ID NO: 37845 - DNA, 601 bp, Human
cccagctaatttttgtatttttagtagagaggggtttcgccatgttggtcattctggtcttgaactcctggcctcaagtggtgcacccaccttggcctcccaaagtgataggattacaggcatcactgtatctggctgaaattagtgtattctttaaagttcatatttttcattaattcacagaagaattgtaaaaaaggtaacacgcagttgacattccatttttccagaaagacagataattacatactgtagaggatgactcaaaagtctgtttcaagccactgacttcctaaactartgaaggcctattcaaagtcacttaattcagctgtttttttttttttttttttgataaatacaaagatacatgtaaagttttacttacctgattttaaaaacaggctaccaaaatttatccaaatatattaaaaaatgagactgttttaaaaacctttcgtttccatattgtgactccactaagcgggtaaaaagttcaggacagagatggaaaggaaagaaggaaacaggaagaagtgaaactaggaaggtggtgccagtggcacatggatgaagaaagagagatcatcagccatggaga

SEQ ID NO: 37846 - DNA, 601 bp, Human
agcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggccsgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatt

SEQ ID NO: 37847 - DNA, 601 bp, Human
tcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctacsccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgt

SEQ ID NO: 37848 - DNA, 601 bp, Human
tccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctygggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcaggg

SEQ ID NO: 37849 - DNA, 601 bp, Human
ggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaactgtgtggaaaaaatgaattttcttaaaacaattaagagccaggaactccactgagcatacagaccatctctggttaggttccaatccatttctaatgcctgctataaagctaggtactacacaaggtgtcagatggggttgccacaatgactaggacaagaatcctgtgtagagttcacctttgaaggtgagggatgtgcaggcatgtctctagtcctctagatgcaaacactatccttttacagttaggaagtgctcagtaaatatttgttgaatggaaccagtaaaca

SEQ ID NO: 37850 - DNA, 601 bp, Human
attaatgtatttctgtagattgtaaaacatctagttatcacactgtctatgttagcttgttccagctcatgatttattttcattttttctaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaarctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataaga

SEQ ID NO: 37851 - DNA, 601 bp, Human
tgatgctctgtatatttctctgttcaaactgagtgttaggttgaactcaatagtttaaagctttgtttcttcagtttttctgtgcatgtttaaattttcgtcaaactcttttctttgtctcctgtggagcttggtaaggatgccctttcaagcacacttcagaatagttagcattacagttactcttctttcctttaaagggtgatttgaagaaaaaatcagacaaagacgttctacagttttgtcatctttgtttattcagtgatcaaaatcaaagatgagactttttacatgcagggaytgtatataatctattttcaagacaatagacattttaaaccctttattagtatgaagctaacgaagcggtcataagctagtttgtctgaaaacatgtgatttcacttgttgtctgagtacagaatggattgttgattatttcgcatgcatgatccaaaattgtcaaagcatcaaggtcactggtagagcttttgattaaaaagaaaaatacatttgattcagtgttttttctatttttaactccaaaagcattatttttccccctaaacttggcaaggcagcatggagtattgaggctgct

SEQ ID NO: 37852 - DNA, 601 bp, Human
ctaacgaagcggtcataagctagtttgtctgaaaacatgtgatttcacttgttgtctgagtacagaatggattgttgattatttcgcatgcatgatccaaaattgtcaaagcatcaaggtcactggtagagcttttgattaaaaagaaaaatacatttgattcagtgttttttctatttttaactccaaaagcattatttttccccctaaacttggcaaggcagcatggagtattgaggctgctgaaatccatgaaatatttttctcgtttccattttctggctttgacatattttttccmaagtgcctgtctgtccaaggcttaccatgttgttctttatgaactccatctccattttaccatgcatagaatcacccattccaactgcattattaatttgaaatttcacaagaacagaagagtattgttggagaaatttgcaaagcaaatactttttctgcattatttatgtatgataggaagacagataatatataaaaacgtacaccatctttcttttaatttctgatcttttattgtcattttatatccaagaaaaaagtatacactgtcaagtataattcatgaagtgttttaatt

SEQ ID NO: 37853 - DNA, 601 bp, Human
tgatttcacttgttgtctgagtacagaatggattgttgattatttcgcatgcatgatccaaaattgtcaaagcatcaaggtcactggtagagcttttgattaaaaagaaaaatacatttgattcagtgttttttctatttttaactccaaaagcattatttttccccctaaacttggcaaggcagcatggagtattgaggctgctgaaatccatgaaatatttttctcgtttccattttctggctttgacatattttttccaaagtgcctgtctgtccaaggcttaccatgttgttctttwtgaactccatctccattttaccatgcatagaatcacccattccaactgcattattaatttgaaatttcacaagaacagaagagtattgttggagaaatttgcaaagcaaatactttttctgcattatttatgtatgataggaagacagataatatataaaaacgtacaccatctttcttttaatttctgatcttttattgtcattttatatccaagaaaaaagtatacactgtcaagtataattcatgaagtgttttaatttgtaaggttgagttttgtgataggagcaccaaacatatg

SEQ ID NO: 37854 - DNA, 601 bp, Human
ttaatacatatgaataattaagcatgtttttaaataactgaagcacaaagctgtatttggaaattgataaaattgataataaatttaaatatgtaaaagaaaataaactatatttttaaaacaggaattttatccgaaaaataccttaatgagaagataaagtgtgtttgtaaatttgaatgacatgcagcacttaactgcatatggaaccatcatttacaattcttaaatgcaattaaaaagcagtggaccatgtgcttttcatcttttatgataaaaacagtagtgtacattcaacagyggcaaaagttaaatcaccccacactaaatctttctgctgatggttttttctttaacctagtgaaaacacttcaaaggttatgtcttcttctgaaagatgaatattcagaatactatgtctgacatgaagatctggaaagagtatgtctaaagtgatattctgttttgtgtgaattcagggccaaccccagggtataaacaaacagccagccccagtcattgtatgagccttcaagaattctttttcaaataacatctgtttaaaacaaatatagagaaccattttgaaggaagatggaca

SEQ ID NO: 37855 - DNA, 601 bp, Human
cttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactgggtatgtacctaaggaatgaagtttatttttaataaaaatgttattttaaccattttaaaataatagatatttatgcccagataatgtcatattggattaatamctgcaagatattacattcctttattcaaaattaattctatattatggtgtttttaaaagtcattgctttattatttctggtgttttagaagcttgttaagaaagcacatatctcaattgcattacttaattacatctgcttttggtttttgaattatacaagacttgttattgttcagcagtaataaatattattttatagtgctttgtcattcacaacactctttaatccttccaactacctttctgaatctcgcagatcaggtactattaatcccactttacaagaaggagacctgag

SEQ ID NO: 37856 - DNA, 601 bp, Human
aaaccttcatctgctaatttaaaatcaaaaatcctttccactattccatgtcatctctgctagcttgcctatgagacaactcatacgtatgtgagtatttaaataattctttaaaatctttgggtagatagcagcccatctcaggataagcagagagaacaagaatgtgagacttacttgccttccattatcacccatctaacaatatgcctgctaggagatttatatttctaaattgacccaaattaatgttaaaacacaatctaaagcattgctgagtcatctatttaattattagatrttaaagtagtgtgattttaagtaaaaaataaaatagctttattctcataatttatcttttccttcttagtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaac

SEQ ID NO: 37857 - DNA, 601 bp, Human
ataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccrtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtat

SEQ ID NO: 37858 - DNA, 601 bp, Human
acaaccctgttttttatgtattacctctcaaaagcatgatttgcaatatttagtgtactcttcatacgatctatacaaataattttttattttaaagcaggacagaaggagcaagctgtggaatggtataagaaaggtattgaagaactggaaaaaggaatagctgttatagttacaggacaaggtaagattgtatttgtttatagccatcccaaattatgatatattcacatgattgtccagatttcagatctatttatttatttatttatttttctttctttcttttcttttcttttcttttttttttttttttttgagacagggtctttcctctgttacccaggctggagtgcagtgatgtgatcatagctcactgcaacctcaaacttctgggctcaagtgatcctcctgcctctgcttcccatgtagctgggaccacaggcgcacactaccatacttagctaattattattattattattattattattactagtttttgagacagagtctcgctcttttgcccaggctgtagtgcaatggtgcaatctcggctcactgcaatctccgcctcccggattcaggctatttattctcc

SEQ ID NO: 37859 - DNA, 601 bp, Human
agaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataaggtattctgggacagtaactttaattgctgtctttttgcaaatagaaaaatttttaagatactattcctgcttaagttgatcataagtactttataatactttagagaatggataagtttccataaagttaaatttttttttttttttttttgagactcttgttttccaggctggagtgcaatggcgcgatctcggctcattgcaacctccgcctcccaggttcaagcgattctcctgcctcagcctcccaagtagctgggattacaggcatgcaccaccacgtcgagctaattttgtatttttagtagagacggggtttctccatgttggtcaggctggtctcaaactcccgacctcaggtgatccgcctgcctcagcctcccaaagtactgggattacaggcgtgagccaccgtgcccaaagttaatttttt

SEQ ID NO: 37860 - DNA, 601 bp, Human
ctcctaccactcataaggtattctgggacagtaactttaattgctgtctttttgcaaatagaaaaatttttaagatactattcctgcttaagttgatcataagtactttataatactttagagaatggataagtttccataaagttaaatttttttttttttttttttgagactcttgttttccaggctggagtgcaatggcgcgatctcggctcattgcaacctccgcctcccaggttcaagcgattctcctgcctcagcctcccaagtagctgggattacaggcatgcaccaccacgtygagctaattttgtatttttagtagagacggggtttctccatgttggtcaggctggtctcaaactcccgacctcaggtgatccgcctgcctcagcctcccaaagtactgggattacaggcgtgagccaccgtgcccaaagttaatttttttttaaatccacagggcaacttgctataaaactttttttggacctcattagacatttaataccaagttttgcttacccagtctgttttatataatgctgtatatttcattttaaatttatttttaaaattatttcaatctttgtaaatgttt

SEQ ID NO: 37861 - DNA, 601 bp, Human
attgccatgtattggggattgtattataccttacatttttatttttattttttattaatttttttttttagacagtcttactctatcacccaagctggagtgcagtgatgtgatctcggctcactaccatctcttccttctgggttcaagcaattctgccacgtcagcttcccgagtagctgggattacaggcatgcgccaccacgcctgactaatttttgtatttttattagagatgggatttcaccatgttggccaggctggtctcaaactcttggcctcaagtgatgcgcctgcctcrgcctccgaaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaa

SEQ ID NO: 37862 - DNA, 601 bp, Human
gtattggggattgtattataccttacatttttatttttattttttattaatttttttttttagacagtcttactctatcacccaagctggagtgcagtgatgtgatctcggctcactaccatctcttccttctgggttcaagcaattctgccacgtcagcttcccgagtagctgggattacaggcatgcgccaccacgcctgactaatttttgtatttttattagagatgggatttcaccatgttggccaggctggtctcaaactcttggcctcaagtgatgcgcctgcctcggcctccgmaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaat

SEQ ID NO: 37863 - DNA, 601 bp, Human
aagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatccctcctatctctgtctttatctttatgtggcattctccctgtrtctgtcaccatgtccaaatttcccctgtggattaggacccaccctaatgatctcaatttaagtttgtcatcagcaacaattctatgtccaaataatgtcacattcataggtactagggataggacttcaacacgtttttggagaacacagttcaacccattaacaaatactatcactttccacttaagcttcaagtaaagtggattttatctcaaggagccaccagataggaacacagatctgatggcataaactgagtatttctggccttctgattctgatctaaaatatgacagaaga

SEQ ID NO: 37864 - DNA, 601 bp, Human
actgagtatttctggccttctgattctgatctaaaatatgacagaagattttccctgttttaattttttttttttttttataatagagacacagtctcgctatgttgccaggctactttcaaattcctgggcttaagcaatcctcctgcctcggactctcaaagtgctggaattacaagtgtgagccaccacacctggccagtagattttccctgctttcttttgattgtttataattttgttttctttttccattcaccctctgctgaccctatagtattattcaaagaagtgttcagtytagttttggggtagggcaagcataactacagtgcttaaagagagtaatttgtctggtgtgcagaactagtgtgtaaatataactggtgcattgcaaaactgtgaagtagtttctgtcaaaccttacactgctttgtctttctccctctctccctttctcttggttgccccctccccctcccaatgataccttagtctctgcttgcctttatcaaaacctttatgattggccgggcacagtggcccatgcctataatcctagcattttgggaggctgaggcaggaagatcacctgagccca

SEQ ID NO: 37865 - DNA, 601 bp, Human
ataatgaggtatagatattattctcatagctctattttattaattagggaattacagaattcagtgatctgctcaggatctcataaccaggaagtgggaaactaggatttgagctccagtgagtgtggcctttcattaaaaatattacagcaaccattctctttttttttttttttttttttgagatggagtcttgctctggagtgcagtggcgtgatctcggctcactgcagcctctgcctcccgggttcaagtgatccccctgccttagcctgctgagtagctgggactacaggcaccygccacgacacttggctaatttttgtattttagtagagacggggtttcaccatgttggccaggatggtctcgatctcctgaccttgtgatccgcccgcatctacctcccaaagtgctggattataggcgtaagccaccacacccggcctacagcaaccattctcttttatccatacttttttcaagagtactgtttcatcttcatgttttcagaaacaacatagcattcatgatcttaacccccaattctgatactgcctgaatatcttgaagtaagtttacttttaagaaagttgaggct

SEQ ID NO: 37866 - DNA, 601 bp, Human
gtctctaccagaaatacaaaaaattagtcgggcgtggtggcgtgtgcctgtggtcccagccacttgggagactgaagtgggaggatttcttgagcttgggaggtggagtttgctgtgagccgagagatcatgccactgtactccagcctgggtggcagagtgagatcccatctcaaaaaaagaaaagaaaaagaaaattgaaatgtctagtctatcattttgtcagttctatctaatacaattttttccttatgtctaactgaaatctgctttttctaatttttacatacttgatttaacraaactcaatctttttttttttttatgagacagcctttcaaatatataggaacttaatgttatatctgcttccctccagtccccagaatagttactattttagttgtctttctatggtctcatgccagtttgtcagtatgcctagataagaactgaatattttacctcagatgtgacctgactttgaagacttaaaaaggaagcattgtgccaggcgcagtggctcacacctgtgatcccagcactttgggaggccgaggtgggcaggtcaggagtttgagaccagcctgattaacatgga

SEQ ID NO: 37867 - DNA, 601 bp, Human
tgactatttgtgaaatttccctctccaaataggaaagataggattggaaacattattcagaaggaagaagttttaaagaagggcaggcttaaagactatctaatgaatttaccaatatggtaaaaccccatctttactaaaaatacaaaaattagccaggcgtggtggtgggcgcctgtaatcccagctacctgggatgttgagggatgagaatcacttgaacccaggaggcaaaagtcacagtgagccgagattgcaccactgcactccagactgggctatagagcaaaactctgtctcaaaaaaaaaaaggaaaaaaaaaaaagaaattttgatatttatgtgagaatgacttttcacggtgttcttaatagcgcaagttttgtttaggagagcacattccaacttacttgcttctataaatataccgtgtaatctagggcttaaagaatatgtacaatgtctttttctctcccctagtcttccccttttctcactagttatatccttgactgaagagctatttcattctcaagtcttaggaatgcagggtgaagcaaaacagatgaatttttaaagcacttaaccaggctgtatgaaa

SEQ ID NO: 37868 - DNA, 601 bp, Human
atttatgtgagaatgacttttcacggtgttcttaatagcgcaagttttgtttaggagagcacattccaacttacttgcttctataaatataccgtgtaatctagggcttaaagaatatgtacaatgtctttttctctcccctagtcttccccttttctcactagttatatccttgactgaagagctatttcattctcaagtcttaggaatgcagggtgaagcaaaacagatgaatttttaaagcacttaaccaggctgtatgaaatcacagtctgttgtctaaaattgtaagggacggttcgtagtactctcccctttctcaaaccaaatctttggttgttttaaggaagggaaattaaattcctgtgtgctagattttcaacataaaatttaaaaaactggaataatgttgcattttatgtgtataacagtataatgctttgttttaggtgggagaaggagagaaattggtgagggctctttttgctgtggctcgagaacttcaaccttctataatttttataggtaagaacatattttccaactaagttattgactatttgtgaaatttccctctccaaataggaaagatacgattgga

SEQ ID NO: 37869 - DNA, 601 bp, Human
tggaaacattattcagaaggaagaagttttaaagaagggcaagcttaaagactatctaatgaatttagtaggacccactatattaataagtagtaaactagattaatctcagatgactcacatagcttggtctttaattaaagtcttatacttgtatttcctctagatgaagttgatagccttttgtgtgaaagaagagaaggggagcacgatgctagtagacgcctaaaaactgaatttctaatagaatttgatggtgtaagtgttgattatgatatttttaatgtggcagcattttagaatattttcctattaaatggccaaggttaaaaatacaaatatctttatatttgttattacttttctaaatgaattgaaaaaagattttttgcttgtaggtacagtctgctggagatgacagagtacttgtaatgggtgcaactaataggccacaagagcttgatgaggctgttctcaggtagggagatttatatggaaatacatgcatttattacagacaatatttactcatgtgtccatcttacatattatttccttactctcagttttaagactaaattcactattttcttccagtact

SEQ ID NO: 37870 - DNA, 601 bp, Human
ccagtactatctctagcctcttgttaccaactacataaggattttgaggtcaacagcttgatatcaggagaattagtctagtaaaggtttagttacggttttaggcaaattggtcagttcttctgggttgcattaaattatctttaaacttgaaaattgattcttaccgtcttttattgggcttcatgagaaaataatcaaatcagggttcatggaaaatgtgttttctgttcttgtgtgtttgagcagtttattcccttcatactggaaggacggtttgggtcagcataaaattcttggkcatcctttcccaaggaatttacaatattgctccattgtttctagattggctgtagtagtgtaaaagtctgaatccaaattgattttttcaaatttgtaaaataacttgatttttttctctctttactggatgggttacgtgggtatattgcacccaggtagtgagcatagggtgcagtaggtagtttttcaacccacacctcactgctttcttcccccatgtagtagtccgcagtgtgtattgttcccatgtttatgtccatgtgtactcaatttttagctccccacttatgagaacatg

SEQ ID NO: 37871 - DNA, 601 bp, Human
acatatggctagccagtaatccccatgccatttattgaatagggagtccttttcctcattgcttgtttttgtcagtcttatcaaagatcagatggttataggtgtgtggctttatttctcaattttctgtcctgttcctttggtttgtgtgtctgtttttataccagaattatgctgtttgggctgctgtgtagttcggtttaaagtcaggtaacgtgatacttacagctttgttctttttgcttaggattgctttgtctatttggactctttttttgcttccatatgaattttagaatawttttttctaattttgtgaaaaacaacattgatagtttgatagaaataccattgaatctgtaaattgctttgggcagtatagtcattttacgaccagataaatcaggcaagagaaggaaacaaaaggcatccaaataggaaaagaagtcatcatactctcactcttcactggcaatatgattctatactttgaaaaccctaaaaattccgtcaaaaggctactagaactgataaatgattttaccccaagattcaggatacaaaatcagtgtacaaaaaattagtaccatttctatacgct

SEQ ID NO: 37872 - DNA, 601 bp, Human
caagagaaggaaacaaaaggcatccaaataggaaaagaagtcatcatactctcactcttcactggcaatatgattctatactttgaaaaccctaaaaattccgtcaaaaggctactagaactgataaatgattttaccccaagattcaggatacaaaatcagtgtacaaaaaattagtaccatttctatacgctaataatgtccaggctaagagtcaaatcaagaacacagtcccatttacaatagccacaaagaaaatgaaataatggctgggcacagtggctcatgcctgtaatcccakcactttgggaggctgaggcaggtggatcacctgaggtcaggagttcgagaccagcctgaccaacatggtgaaaccccgtctctactaaaaatacaaaaaattagccaggcgtggtggtgggcgcctgtaatcccatctgctcgggaggctgaggcaggagaattgcttgaacccaggaggcataggttgcagtgagccgagatcgtgccactgcactgcagcctgggtgtgaaagagcaagaatccgtttccaaaattaaaaaaaaaaaaagaaaaaaaaaaagacaatggagtacctag

SEQ ID NO: 37873 - DNA, 601 bp, Human
gcactgcagcctgggtgtgaaagagcaagaatccgtttccaaaattaaaaaaaaaaaaagaaaaaaaaaaagacaatggagtacctaggaatacggctgatgaaggaggtgaaagaatctgtatgaggagaagtgtaaagcactgctaaaataaatcagagatgacacaaataaatggaaaaacactccatgctcatggattggaagaatcaatatcgttaaaatgggaaatttatcttaatttttttccctagttcatttttctgttttcttttgcacataaattatgtgttatgttgcrtccttttgttttccctatctgtaattttcttcttcatccttttaaactcttaggtctttttgttttgttctgttttcccaagcctgttgcctttatttcttactgggttagtatctaatctcctttctgctatatcttttgtaactcttctttccttggtggttttttattcattactttcctgacatctgttattctacttttcatcttctgttttatttctttgagcatctgtatgttatttccataagctcttacatttcactgggctcttgtttcatagaaaacaattttttggca

SEQ ID NO: 37874 - DNA, 601 bp, Human
caggcgtcatggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgtttttttttttttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgtta

SEQ ID NO: 37875 - DNA, 601 bp, Human
gcgtcatggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgtttktttttttttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgttagat

SEQ ID NO: 37876 - DNA, 601 bp, Human
tcatggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgttttttkttttttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgttagatgcc

SEQ ID NO: 37877 - DNA, 601 bp, Human
tggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgtttttttttktttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgttagatgccttc

SEQ ID NO: 37878 - DNA, 601 bp, Human
tggcaaaagatgcagcactgggtcctatccgaggtaggtatacaagagcttaaaacatttagaactatttattataccaccttagaagtttaagaagtccaaaaaaatctaccaagagattttttttttcttttggagacagggtctcactctgttgcccaggctgtagtgcagtggcacaatcatagttcactgcagcctcgaaccccccaggctcaggtgattctcccacccagccttcccagtagctgggactacaggcatgcaccatcatgcccagataattattttattttatttyttgtagagacagggtttcaccatgttgcccaagctggtcttgaactcccgggctcaagtgagcagcctgccttggcctcccaaagtgctgggattacaggcatgagccaccatgcccagccttaaaaccattcttagctcacagatcatacaaaaacagtctatgagccagtagactgtgacccctgttctaggcaagaggtttcatttcttgatagtaagtaagcagcagaaaactcaaaaagaaaactttaaacaaaaaagaataatgtaaggaaaatgttcttatctgttttctggc

SEQ ID NO: 37879 - DNA, 601 bp, Human
caaagtgctgggattacaggcatgagccaccatgcccagccttaaaaccattcttagctcacagatcatacaaaaacagtctatgagccagtagactgtgacccctgttctaggcaagaggtttcatttcttgatagtaagtaagcagcagaaaactcaaaaagaaaactttaaacaaaaaagaataatgtaaggaaaatgttcttatctgttttctggctcttttcagtattctgacatcatttgaaattaatgtgtctaaaggaaattctataagagaagttttcacttttttaattatatcttttgagggattgcagcaaaatatttattgctatgtttttattcaggttacttggttgattctgaaataccacgaccaattctttttaggttaggttaggataaactcacacagatattttcagctacatttccacagccagcatcggtagtggatggttgatgctctcaggtatgcactcagattattagctatgatgataaagtaatcataatagctccatccctttctctcattcaagaaagtacaattgaatgtagttgtacgagaaagatgttatcatagtgtctactgtaa

SEQ ID NO: 37880 - DNA, 601 bp, Human
attttcttagaacgttttggctattctaaggtagacaaaatttgggtttaaaaaaagattcgcatccattaaagtacagaaaatggccgggtgcagtggctcacacctataatcccagcactttgggaggccaaggtgggaggatcgtgtgggcctaatagtttgagactagactgggcaacatagggagatcctgtctctacaaaaaaatataataaattaaccaggcccgttggcatgagcctgtaatcccagctactcgggagtctgaagtaggaggatcacttgagcctggaaggtscaggcagcagtgagccatggtcatgccactcactgcactccagcctgggtgggtgacatagtgaggtgctgtcttaaaaagtaaataaataggccaggcacggtggctcacgcctgtaatcccagcactttgggaggccaagatgggtggatcatgaggtcaggagttcgagaccagcttggccaatatggtgaaaccgcatctctactgaaaatacaaaaattagccaggcgtggttgtgcgcacctgtaatcccagctactcaggaggctgaggcaggagtatcgcttgaacctggga

SEQ ID NO: 37881 - DNA, 601 bp, Human
tggttgtgcgcacctgtaatcccagctactcaggaggctgaggcaggagtatcgcttgaacctgggaggtgaggttgcagtaagccgagcactgcagcctgggcaacagagcaagactctgtctcaaaaaaaaaaaaaaaaaaaaaaaaaaaaagtaaatacataaagtgcagagtaaaaacaaaaaaagactaatgcattttgtaaagaacaagttgcattcttttaagttccctttcaaatttgtgaactattgtttttgggcagtatgcaagaaattgaacactttccagttattccwaagaaggaatattctcttctcagcatttataaattgtatttgctctcaaagttaacatgtgtctcttttttttaatataatgatttgtactgaatagatacatgtagatcattgtacttggttttgcccttcaacaatttcaactgcaaaatgtatgtatttttaagtgcctgacttttatgttttacagaactaaaaccagaacaggtgaagaatatgtctgccagtgaggtatagtattttacaatgatattttctttgtcttctatattgtaagacatatataagacatacatatat

SEQ ID NO: 37882 - DNA, 601 bp, Human
aaccctgtctccactaaaaaatacaaaaaaattaccggggcgtggtggcgggcacctgtagtcccagctacttgggaggctgaggcaggagaatggcgtgaacctgggaagtggagcttgcagtgagccgagatcgtgccactgcactccagcctgggcgacagagcaagactccatctcaaaaaaaaaaaaaaatagctgggcatggtggcacgtgcctgtggtcctggctacttgggaagctgaggcaggagaatcacttgaacttgggaggcagaggttgcagtgagccaagattgcmccattgcactctagcctgggcgacagagtgagacccagtctcaaaaaaaaaaaaattacatgaaacttgtgggggtttatacaataaaaataacctataactatacgttaatcctttaataatgttctattttgtttttcaataacctttatttttttaattaatttcttttttttgagaaggactctggctctgtcacccaggctgcagtgcagtggcaccatcttggctcactgcagcctccacctcccaggttcaagcgattctcctgcctcagcctcctgcgtagctgagattaca

SEQ ID NO: 37883 - DNA, 601 bp, Human
acagataacaagtgtattcaagtacattttggagtttgtttgtttttttttttcaggcttttattcgcctgtcggatgaggcaccatacttgaatttttttttttaagaaagcttttagttttctttctttctttttttttttttgtgagatggagtcttgctctgtttctaggctggagtggagtgcagtggtgtgatctcagctcactgcaacctccgcctactgggttcaagtgattctcctgcctcagcctcccgagtagctgggactacaggtgcacgccaccacgcccagctaattttttttttttttttttttttttgtatttgtagtagagacagagtttcaccatgttggccaggatggtctcgatctcctgaccttgggatccgcccaccttggcctcccaaagtgctagggattacaggcatgagccaccacgcccggctgaaagcttttagttttctaacttatttaatttaatttaatttaatttatttttattttattttttgggacagtgtctcacttggttgcccaggctggagtgcagtggtacaatcatggctcactgcaccctctagctcctgggctcaggc

SEQ ID NO: 37884 - DNA, 601 bp, Human
attttggagtttgtttgtttttttttttcaggcttttattcgcctgtcggatgaggcaccatacttgaatttttttttttaagaaagcttttagttttctttctttctttttttttttttgtgagatggagtcttgctctgtttctaggctggagtggagtgcagtggtgtgatctcagctcactgcaacctccgcctactgggttcaagtgattctcctgcctcagcctcccgagtagctgggactacaggtgcacgccaccacgcccagctaattttttttttttttttttttttttgkatttgtagtagagacagagtttcaccatgttggccaggatggtctcgatctcctgaccttgggatccgcccaccttggcctcccaaagtgctagggattacaggcatgagccaccacgcccggctgaaagcttttagttttctaacttatttaatttaatttaatttaatttatttttattttattttttgggacagtgtctcacttggttgcccaggctggagtgcagtggtacaatcatggctcactgcaccctctagctcctgggctcaggcaatcctcctgcctcagccttttgag

SEQ ID NO: 37885 - DNA, 601 bp, Human
tattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggkttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaag

SEQ ID NO: 37886 - DNA, 601 bp, Human
aaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatgrttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagt

SEQ ID NO: 37887 - DNA, 601 bp, Human
acctcccgggttcacaccattctcctgcctcagcctgctgagcagctgggaccacaggcgcccgcgaccacgcccggctaatttttttgtattttcagtagagacggggcttcaccgttgttagccaggatggtcttgatctcctgacctcgtgatccgcccgcctcaggctcccaaagtgctgggattacaggcgtgagccaccgcgccccgccagttttttttttttttttttttttgagacagtctcactctgtcgcccaggctggagtgcagtggtgctatcttggctcactgtggyctccgactcgcaggttcaagtgattctcctgcctcagcctccctagtagctgggattacaggtgtctgccaccatgccccactaagttttgtatttttagtagagatggggtttcaccatgttggccaggatggtatcaaactcctggcttagatggaggcttagatgatccgcccacctcagcctcccaaagtgctgggattacaggcatgagccaccatgcctagccaccaagtttcaacttttacacacattgacaggtactggcaccatccatgcctggcccttggtatttcccta

SEQ ID NO: 37888 - DNA, 601 bp, Human
cccaggtaccactttgaagccccatggtacaattaaaggaaccaaagccagggaagaagagaaaagaacagaagctcagagactgcaggtctggcaaggatctcagctgaaatctagcagataatggcttcccctgcccctcctctctttcctctccctaggtttcttacctcatcttgctcggcatagtcagcacaaaggaatttgggattggactggggccatttgaccccgtgcagagctgtgcgggtggcaacagcttcctctactgttgagtactggtggaggaagggagaagatrgagggtcacagtgtgtctgcaacccttcccacgtgctgcaacacccttaaacctgcccacactggtcacaaaaggaaatatatgccatgacctatagaatcagcttcttcccctcaccgttacaaagcaatgagatttgatcttgtcaatccagaaggcctcttccaccaaggttcctgtgcgccccaacaactcctttagctggcctaaagtgaaaggacggacctgccaatgaaaatagactttcagggtctagcagaaggcaagaccaccacccaatctttagatttcccgagctgc

SEQ ID NO: 37889 - DNA, 601 bp, Human
agaggcaggacactctcctctggcactttctctgctggagattctgctttggtgtctgaaggacttgacaaaggagacaggcctcctaccaactggacagtatgctgagatactaatagctccctggtgtcagcatctgtattaggaggagataactgaatgaggacagggggggctgggccttccatgggctctatttcttcttcgctatggagctgtggatgaggtggtggagaagatgcttcctttgttagtaaaggtggaggagtctcctcctcgctggcagtttgctctggcagcrctacaagtgaggccttctttcgatcttcagtcagtcgaggaggggaaggagacttcgatttttcctttaagccttgtgaagattttatttctctttcttcctcctcaaggggagatgttgttttcatttccttctcctgctgctgtctggccagatgactttttctagcctcttcctgggatcttgtaaatctccctcctctctctaacacctcctgttcctgggatcttgttttgggtctctcatccatcatctcctctggttttactctaggtatctcttccccttcttccttaaact

SEQ ID NO: 37890 - DNA, 601 bp, Human
tacctgtctgaccctagatgatcgtctttctcctttccttggtttctcatcatcagagtcacctttctcttcagaaattgaggagctttttcctattgaatgaaaaagaatcaagtcagattcatgaagtgaagactcattcatggctttttaaaaatcaggctttctaatatccaaccaattatagcatatgagcctatcaagacatatctgtatcggtttctttgacttctacactaaagaaaagactacaaaaagccctaactaggtcagggtcttattggtaattcttggtgtgcamgtctagaatattttcaacacctcgaagccaattcacatgttataaataactcaaataaatgtaaaataatttccaggggcttcaaactgtctagcagggatgtacaaatatgaagtgtacttatttctacaaagtgttcttactctgaataaagtttaagacttcattatgttctgtatccatttttttggattgcctattactactactttctaatttcaaccaaaatattatgatgaaatatatgaatttgcacaataacaaactcaagaaataaatacttagaggaatgtttttcag

SEQ ID NO: 37891 - DNA, 601 bp, Human
caagtcagattcatgaagtgaagactcattcatggctttttaaaaatcaggctttctaatatccaaccaattatagcatatgagcctatcaagacatatctgtatcggtttctttgacttctacactaaagaaaagactacaaaaagccctaactaggtcagggtcttattggtaattcttggtgtgcaagtctagaatattttcaacacctcgaagccaattcacatgttataaataactcaaataaatgtaaaataatttccaggggcttcaaactgtctagcagggatgtacaaataygaagtgtacttatttctacaaagtgttcttactctgaataaagtttaagacttcattatgttctgtatccatttttttggattgcctattactactactttctaatttcaaccaaaatattatgatgaaatatatgaatttgcacaataacaaactcaagaaataaatacttagaggaatgtttttcagcgccctaaagttcctgaaattacttcaagccaactggatggggtttcagaattgggtcctgtctattaggttttatgtattagagctcaatattttttttttttttttttt

SEQ ID NO: 37892 - DNA, 601 bp, Human
gtacttatttctacaaagtgttcttactctgaataaagtttaagacttcattatgttctgtatccatttttttggattgcctattactactactttctaatttcaaccaaaatattatgatgaaatatatgaatttgcacaataacaaactcaagaaataaatacttagaggaatgtttttcagcgccctaaagttcctgaaattacttcaagccaactggatggggtttcagaattgggtcctgtctattaggttttatgtattagagctcaatattttttttttttttttttttttttttgagatggagtctcactctgtcacccaggctggatgcagtggtgcaatctcgcctcactgcgacctctgccccctggcttcaaaccagtctcatgcctcagcctcctgagtagctgggattacaggtgcccaccaccatgcctggctaatttttgtatttttagtagatatggggtttcatcctgttggacaggctggtctcaaactcctgacctcaagtgatctgcccgccttggcctcccaaagtgctgggattacaggcatgagctcacatgtttttctttttttttttttgagaca

SEQ ID NO: 37893 - DNA, 601 bp, Human
aaacatttgaagacatctgtaagacagtagtgcagtgaaatgaaatactcatttcataattcagtgatctgaaataggctaagttataaaataagtaaaaccaaaataaaaagttttcataaatgttaggcaaagttccttcacaagtatcagtgaaagaagctgatttatctcacacacaccaaaaaaaaaaggcaagtgcaaggttggtcagagataaatgtgttaaagtcaacgctgggcgcagtggctcacgcctgtaatcccagcactttgggaggccgaggtgggcgatcacgakgtcaggagattaagaccatggtgaaaccccgtctctactaaaaatacaaaaaaaaaaattagtcgggtgtgggggcgggtgcctgcagtcccagctacttgggatgctgaggcaggagaacggcgtgaacctggaaggcagagcttgcagtgagcagagatcgcgccactgcactccagcctgggcgacagagcgagactccatctcaaaaaacaacaacaacaagaacaacaacaacaaagtcaaataactgagttgcaattttaaaattagtatgtacaagcaaaacagcctctttat

SEQ ID NO: 37894 - DNA, 601 bp, Human
cagaggtagaaaagtttatggcataaaggacactgaagagcatttacggcaattatgagcagtactctacaatttaccacattcatattttccaatttatttttcacctttttttttttttaacgtctggggttttttttttcctccatcaatcattagccatgggcagggtcttactgatgacataaagcactgaaaagattggctacccttactctaaatctttgcttttgaaatctatttcagaaatcatttctcattttcatttcgaattatattaagaactgacagcctctctttytaaagagaggtccttatcaaatcatggtcctattaagaattttcaatggttcccccattacctatagaactaaaaaaaaaaccctcatacttactggcctggcatttaaagccctctgtgtatcaccctcatctaccttttaaattgttttgctgactattcttgaatgtgaaatactctactctggctagattagtctactacctctcctttaaaaataccattttcattcctatctctctgactttgttccttcctaaaaatatcttcttgtatcctctctgccaaaccatttctaag

SEQ ID NO: 37895 - DNA, 601 bp, Human
aatcatttctcattttcatttcgaattatattaagaactgacagcctctctttttaaagagaggtccttatcaaatcatggtcctattaagaattttcaatggttcccccattacctatagaactaaaaaaaaaaccctcatacttactggcctggcatttaaagccctctgtgtatcaccctcatctaccttttaaattgttttgctgactattcttgaatgtgaaatactctactctggctagattagtctactacctctcctttaaaaataccattttcattcctatctctctgactctgttccttcctaaaaatatcttcttgtatcctctctgccaaaccatttctaaggctcagctcaaatcctgtatctccttatgaggctttctctaatcactgtagtcctcagagctcttccactcttttggttccctatgtctgtatcattgtcacatactatcttctgttgttcgatttatgtgtaattgttctctcttcctaacagactttatgctgtgctaactcccaatatactctcacagagatatgtatgcagtaggaattcaataaatttttttttgttttatgtgagaagaaa

SEQ ID NO: 37896 - DNA, 601 bp, Human
ggtggattccgcatccccctcaacactaattattcaaaatacttgttaagttacacattggtttaacatatgtactaacaatccacatgtcttatatacatattaagtatcccttttccaaaatgcttgggatcacaagtgttttagattttggatttttgaatatttgcattatactttctgattcagcatccctaatctgaaaacccaaaatctgaaatgctctgatgagcatttcctttgagtgtcatgtgaatactcaaaaagttttgggtctttggattaggcatgctcaacctgyacatattttcctcaaagtatactgacttagacaggtagttcccaaaagacaaaggctatatttatagacttttgcttgagatattatgcaaaattgggtgcctattatgattttatgtattttttgagacacagtctcgctctattgtccaggctgaagtgcaatggtgcaatcttggctcactgcaacctctgcctcccgggttcaagcgattctcctgccttagcctcccgagtcactgggattacaggtgcctgccaccatacccagctaatttttatatttttagtagagacaggg

SEQ ID NO: 37897 - DNA, 601 bp, Human
ccaaaatgcttgggatcacaagtgttttagattttggatttttgaatatttgcattatactttctgattcagcatccctaatctgaaaacccaaaatctgaaatgctctgatgagcatttcctttgagtgtcatgtgaatactcaaaaagttttgggtctttggattaggcatgctcaacctgcacatattttcctcaaagtatactgacttagacaggtagttcccaaaagacaaaggctatatttatagacttttgcttgagatattatgcaaaattgggtgcctattatgattttatrtattttttgagacacagtctcgctctattgtccaggctgaagtgcaatggtgcaatcttggctcactgcaacctctgcctcccgggttcaagcgattctcctgccttagcctcccgagtcactgggattacaggtgcctgccaccatacccagctaatttttatatttttagtagagacagggttttgccatggctttttcacggtttttccaggctggtctggaactcctgacctcaggtgatcctcctgcctcagcctcccaaagtgctgggattagaggcgtgagcgaccacaccca

SEQ ID NO: 37898 - DNA, 601 bp, Human
gtgttttagattttggatttttgaatatttgcattatactttctgattcagcatccctaatctgaaaacccaaaatctgaaatgctctgatgagcatttcctttgagtgtcatgtgaatactcaaaaagttttgggtctttggattaggcatgctcaacctgcacatattttcctcaaagtatactgacttagacaggtagttcccaaaagacaaaggctatatttatagacttttgcttgagatattatgcaaaattgggtgcctattatgattttatgtattttttgagacacagtctygctctattgtccaggctgaagtgcaatggtgcaatcttggctcactgcaacctctgcctcccgggttcaagcgattctcctgccttagcctcccgagtcactgggattacaggtgcctgccaccatacccagctaatttttatatttttagtagagacagggttttgccatggctttttcacggtttttccaggctggtctggaactcctgacctcaggtgatcctcctgcctcagcctcccaaagtgctgggattagaggcgtgagcgaccacacccagtctgggtgcttaatattttc

SEQ ID NO: 37899 - DNA, 601 bp, Human
gagcttatgccttttcctatttttttttttttgtaatacagattcccaagttgcccttctgacctccagctttctcttcacaagttctcctccctagaaccttcttgcttagcaagtcctatttagaactgaaaaagcaaaaaaacctgaatactttctatgttattagtcatgtttcctaaacatagtaaaggtttattttcacctaaagtagaaatgagtctcttggcactcaatggacattgttgaagggtgggttgcatgtgtattacagaataggcatgtttgctgcacaaacccgtgttaataaaagcaaagcttcaaagactaacatgcaatgggcaaaaggaatacaattaagctgattaacttatgcagtttcttatgcttgttaaagtacttaattgaacctctgaatgctggctagattatgatacttacagcttaatgaggtgataacaaaggaggaggagggctctcttgttttccacagtatcctgagacttcatctagtactgaggctgcacactattgctttaacaaagacttggatttttcctttaagtatatgacacattataatgaggggatttttaaaagc

SEQ ID NO: 37900 - DNA, 601 bp, Human
ttgttgaagggtgggttgcatgtgtattacagaataggcatgtttgctgcacaaacccgtgttaataaaagcaaagcttcaaagactaacatgcaatgggcaaaaggaatacaattaagctgattaacttatgcagtttcttatgcttgttaaagtacttaattgaacctctgaatgctggctagattatgatacttacagcttaatgaggtgataacaaaggaggaggagggctctcttgttttccacagtatcctgagacttcatctagtactgaggctgcacactattgctttaacamagacttggatttttcctttaagtatatgacacattataatgaggggatttttaaaagctgaaagaaactttaagagactgtgcagcctaataatttttggattttaactgtggaataatttaaaaattttatgcagaaactcaatagttaaaaagtagatctaatctagtttaagagaggagtatgagccttgcttacttgggaaaaaggtatttcccctaggaagctccccaaagcagctccacaaaaccctaagagaacagttataaacccatgggtttagtctgtttctcatattac

SEQ ID NO: 37901 - DNA, 601 bp, Human
tctttcttccccagttgtgaccaccacccctaccacatccatcttaggtcagattctcaccagagaaagcagaaccattataaatgataaacacaggtgtttacccagacagaagttaagcaaagtgttcattacactttgttaatctacttggaatgactgttgtgtaaaaattttaaatgatagttttaatagaactttttgtttgtcatgagatttgtttttaaagttcaacatctagttttttggccgggcacagtggctcatgcctgtaatcccaacactttggaaggccgaggcrggtggttcatttgaggtcaggagttcaagatcagcttggccaacatggtgagacctcatctctactaaaaatacaaaagattagctggatgtggtggcacacacctgtaatcccagctactcaggaggctgaggcaggagaatcacttgaacccgggaggtagaggttgcagtgaacccagatcatgccattgcactccagcctgggcgacagagtaagactccgtctcaacaaaacaaaaacaaacaaaaaaacattgtttttagttttttgatttattgatctggttttctgctggcc

SEQ ID NO: 37902 - DNA, 601 bp, Human
tttttctgattactttaaaatataaaacaattattcagtatgcatatagttttgaaaaattagaattaaatctgaaattaagctgcatagaaaatataccactttttaaacatgtttataaaatgtttacgagagactttttaatcattaaaaaaaagtttggatgtatataaacagtaatacaacattttacatttttgtgtaaatatctaggactttacaataaatagctgagttgtcttcgaaaacgttgtatttgactttctttgatggcagatttactgtagttatacattttttraaaactgtctttacggtgctagctgtcctgtacatttcatttctgaattgtactatttggttcatcatgagtctcaggcacatcagctttttgaacatgtatctattaacatgaacctgttaatagatacattagtttaatcttctagaatttcaggccggtgatttctcaatgaagggttgatattttcaagagtggtagaagtataactattttaccatggtaataccactggaattactttcttttcattagctaaggctttctttcctttcagttcatttctttgtttctctatct

SEQ ID NO: 37903 - DNA, 601 bp, Human
agatgaggattctgaaacctcaaaaggaaaaaaggcaagtgttgcttaaaatattttcttcttttacattatatacaaaaaaattgttacctcaaaagatttaatatttttaaattataaaccccagttacccactttctccactccagaggcaaatggtgttcccagtttgttatttatcactttgggaatgtttcatgcattataaagaagagaaatatttccacctcccatgttacacaattggtaatatactgtgcatggtttttctgatcttcctttaacttaatatattatcttrgagaccatctgtaagagttcataaaaagcacctcattgttttcagtgagtgcatagtattccattgtattatataccattaaccaattccacctattgatggatatttacagagttgtcaactttttaatttttttctaaaataatctgtaaattagccttctatatgggttattttgcacacatacaagcgtatctgtagaatgaattcctagaggttgcactgctttatcaggacaggtccatttctaattttggcataccagatttacacttgttccatcgatatctgaacgtatct

SEQ ID NO: 37904 - DNA, 601 bp, Human
aaaaaaaatgtttttggccaagtgtagtggctcacgcctataatcctagcactttgggaaatcaaggtgggagaattgctttaggccaggagtttgagactacctggacaacatagtgagactccatctctaaaaaataaaaaattttgcactgtagtacatacaataatggtgtattgtataataatgttataggtttgatgaaataaggtattttggagaaattggccctttgctgtgatactagttgctaatatatatacgtgtgtgtgtgtcctttttttttttttttttttcagayggagtctggctcttgcccagaatagagtgcagtggcgcaatctcagcttactgccacctctgtctcccgggttcaaacaattctcatgcctcagccacacgagtagttgggattacaggcatacaccaccatgcctggctaattttttttttatttttattagagaccgggtttcaccattttggctagactggtcatgaactcctggcctcaagtgattctcccatctctgcctccgaaagtgttgggattacagacgtgagccaccgtgcctggccattactaaaattttaactcagt

SEQ ID NO: 37905 - DNA, 601 bp, Human
acgtgagccaccgtgcctggccattactaaaattttaactcagttttttcactagtcttttgtctttgcttatggtggctattgccatggggaaaatatatttccttatgtcatcagatgtatcatttttcttttaaaggcttttgagtctactgtctttgttcctaatgatgttaatttaataacttatttggggctgggcacagtggcttatgccagtaatcccaacactttgggaggccaaagcaggcagatcacttgaggtcagtagttcgagaccagcctggccaacatgttgaarcctcgtctctactaaaaatagaaaaattagccaggcatggtagtgggctcctgtagtcccagctacgtgggaggctgaggaaggagaattgcttgagctcaggaggcagaggttgcagtgagctgagattgcgccactgcactccagcctgggtgacagagcgagactcagtctccaaacaaaaaacaaaacaaaaaaacccacttttatttgctttgtcttattagatatataaaatagtttcacaatagtaataccaacataattactaataaaatgattttcaaattattttgtttc

SEQ ID NO: 37906 - DNA, 601 bp, Human
tttgagatcagcctgggcaacaaaatgagactctaccagaaataaaaataaaaaataaaagatgttttctgtcactaacttatatagggcattggtcttcatgtacacatatgtagctttcagattgctttttttttgagacagtcttgctctgtcacccaggccagagggcagtggtgtgatctcagctcactgcaacctccacctcctgggttcaagggattctcctgcctcagtctcctgagtgactgggattacaggcatggtgccaccacgcccggctaattttttatatttttaktaagagacggggtttcaccatgtgaggctggtctcgaactctgacctcgtgatctgcccgccttggcctcccgaagtgctgagattacaggcgtgagccaccacgcctggcctgctttcagatttcttatgattttttgtaaaagtatgtgctttattacatattttttaaatgtaaatatttatgttttaaagtaaaacctacaggacacattgatttatttagtgaactgtaaagattattctgatatgatagtatcatctattttaagtatacatggaccatctcttaacagttaga

SEQ ID NO: 37907 - DNA, 601 bp, Human
ctctgtcacccaggccagagggcagtggtgtgatctcagctcactgcaacctccacctcctgggttcaagggattctcctgcctcagtctcctgagtgactgggattacaggcatggtgccaccacgcccggctaattttttatatttttagtaagagacggggtttcaccatgtgaggctggtctcgaactctgacctcgtgatctgcccgccttggcctcccgaagtgctgagattacaggcgtgagccaccacgcctggcctgctttcagatttcttatgattttttgtaaaagtatgtgctttattacatattttttaaatgtaaatatttatgttttaaagtaaaacctacaggacacattgatttatttagtgaactgtaaagattattctgatatgatagtatcatctattttaagtatacatggaccatctcttaacagttagaaattttatattgtgccttttccgtcttaaattcatatttcttctgttcagttttcccatagaatcttaatatgatatacttttatgtaattgaaaatctttttattatcctatcacactttaatagagatatccttcactgaagataaa

SEQ ID NO: 37908 - DNA, 601 bp, Human
taatatagttaataagttaatagagtaaaaattaatatagtgagtttatgtgagccacatttgaggactgcaacctgggagcatagatttaggttctcccacatgtatgctttgattagcagcagttatgagtgagttttttaaggaaaaaagaagagactattcctaagttgtttaccaagaatttacattaaaatagctaacaatagatatggattggccatactttgttctttgtatcacaaattcctggaacatgaagataatgaatgagggccacaatgtgcaacttgtgataacttttttttttttttttttgagatggagtctcgctcttgccacccaggctggagtgcagtggcatgatctcagctcactgcaacttctgcctcctgggttcaagccattctcctgcctcagcctcctgagtagctgagattacaggcatgcatcaccacacccggcaaatttttgtatttttagtagagacggggtttcaccatgttggtcaggctggtctcaaactcctaacctgaggtgatccatcagcctcgacctcccaaagtgctgggattacaggtgtgagctgctcggccaacat

SEQ ID NO: 37909 - DNA, 601 bp, Human
agtttatgtgagccacatttgaggactgcaacctgggagcatagatttaggttctcccacatgtatgctttgattagcagcagttatgagtgagttttttaaggaaaaaagaagagactattcctaagttgtttaccaagaatttacattaaaatagctaacaatagatatggattggccatactttgttctttgtatcacaaattcctggaacatgaagataatgaatgagggccacaatgtgcaacttgtgataacttttttttttttttttttgagatggagtctcgctcttgccacscaggctggagtgcagtggcatgatctcagctcactgcaacttctgcctcctgggttcaagccattctcctgcctcagcctcctgagtagctgagattacaggcatgcatcaccacacccggcaaatttttgtatttttagtagagacggggtttcaccatgttggtcaggctggtctcaaactcctaacctgaggtgatccatcagcctcgacctcccaaagtgctgggattacaggtgtgagctgctcggccaacattttaggtaatttatctgctagtcaggaaactaccggcaagaa

SEQ ID NO: 37910 - DNA, 601 bp, Human
tttctcaggtccatatggatcattggtttaaactattatagactggtttctccatttgaaaatgagtgtggaattaagagaaatcctttattaaatttagttcacagtgtcttcatatctttccccttctctttcacagaatcttctctttgtctttgggcttctgcagtttcactgtgcttcttttaagggatttatatcttttgttagttaagaaaacattttagtcattatctctgtggattttacctttctacattattatttctagacctcctaatagacataaaaccatcatttaaaaaaaaaaatccgtaacctatattttatgtttaaaagcaaaaaaggaaaaaaaatggctaatggaatgaagaagtatatctctgtaccgtattctgaataatttctttagctctatcttccaatttacttttatctttagctctaagctgctatttaatccatacattggattttttttttttacttttaaaagatttcaatgacatttatcatttatagaactgctgttggttctctttcaaagttgtattttcgatagtgtgtctaattttttactgtttcaattctttgtttttca

SEQ ID NO: 37911 - DNA, 601 bp, Human
ggaagagtttgacaccaaaaacttagaagctaataggcccaacctgtaccttttcttctgaatttgtctatagggccaagaggtagcatggtcccagtatgtggattctttgctttgaatcttaggagtaggattgattgcagtgtctcttgtttctgaataaaacattgcaagaaatactttgttagggtgggatatcatgattttgctttcatacatttagtagaatctcagtcataatatttgaagaagcacaatagagtggtgtggtcatgtctcctttaggaaatactaatcaggrttgtctcaataggggacttaaaaatttcttattcctcctttttacaatagtgaaccaccattattggtaggattgggtatcagtagcaactcagaaatagggttgaaagtcacttttatttctgctgtctcaatttatacatagacaaatgaagtacataaaagctcagtaactttcaagtcagtggcaaaatcagaaatagtatttaggactcctgatttttattttagtattctgctttattttttaaattttctcaacctccgcctcccgggttcaagtgattctcctgcttcatcc

SEQ ID NO: 37912 - DNA, 601 bp, Human
ttttttgggcacagcagtatagaattggaagtggctacattaggtattaatgcctaactgttggttttcattttgctttttctggaaatgcagctatataagaaataaatacataggataggacagactagatttaaacttttatgtttatattttgcttcgcttctttaatagggatgtgattatattcccttgtttttctgtcatttatctaacctatgtgttttttagtagcaaagataaaatttcagatatattaatgtacatttataatattcttttccttttgaaaatttttttwcaatttgtatatttttaatgtgttcatgtaaaaacaagttactatattttttttcttcatttgctaggattaaattggtattttagttgcatactccacatgataggagtataagaattgatataggaatttggggattttgtaaattatgctttgcttacagttagttccaaatatttcattccttttataataaggataaataatattagacatgaatctcattttattctaaattgagggcttatataatttcattctcgagtaattgatgttaatagctttttggagttttcatga

SEQ ID NO: 37913 - DNA, 601 bp, Human
tttttgggcacagcagtatagaattggaagtggctacattaggtattaatgcctaactgttggttttcattttgctttttctggaaatgcagctatataagaaataaatacataggataggacagactagatttaaacttttatgtttatattttgcttcgcttctttaatagggatgtgattatattcccttgtttttctgtcatttatctaacctatgtgttttttagtagcaaagataaaatttcagatatattaatgtacatttataatattcttttccttttgaaaattttttttmaatttgtatatttttaatgtgttcatgtaaaaacaagttactatattttttttcttcatttgctaggattaaattggtattttagttgcatactccacatgataggagtataagaattgatataggaatttggggattttgtaaattatgctttgcttacagttagttccaaatatttcattccttttataataaggataaataatattagacatgaatctcattttattctaaattgagggcttatataatttcattctcgagtaattgatgttaatagctttttggagttttcatgaa

SEQ ID NO: 37914 - DNA, 601 bp, Human
tttgctatgataacattattgaatttttcagatattgagaattatgtccaggtgagggaagtacatactatttataaaagtacaaaggaggtaccatggcattaaacatgaaaggacaagctaactcttctgctatgtagcaacactctcgggcatataataaaaccaggtgtagtatacagagcaaaaaacccatgtgctcacaaaaacatttgctcgtcttctggcaatgtaatcagaaagtgtggttgacacccattttatttatgaaatgtttttaccaatgcttcattttggtatrttggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagtatattatatatatataatgtatttaaaacaagttgatcacagtataattttgccttaatgactatagttactgcaacta

SEQ ID NO: 37915 - DNA, 601 bp, Human
ttctggcaatgtaatcagaaagtgtggttgacacccattttatttatgaaatgtttttaccaatgcttcattttggtatattggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagaatattatatatatataatgtatttaaaacaagttgatcacagtataattttgccttaatgactatagttactgcaactacagtgatatatcaacaatgaggtcttgcctcttatattttttttctttttcatgttttaagcagtctggaccgaaaagaaaggtaagcttaatattgaagaaattagagcatggatatagtggtaaaatataaaattatttatatgttttgaaaaatattggttgaattagagtttataattaaagctttttttaattttaaagttttagttgacatgtaa

SEQ ID NO: 37916 - DNA, 601 bp, Human
ctggcaatgtaatcagaaagtgtggttgacacccattttatttatgaaatgtttttaccaatgcttcattttggtatattggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagtatattatatatatataatgtatttaaaacaagttgatcacagtataattttgccttaatgactatagttactgcaactacagtgatatatcaacaatgaggtcttgcctcttatattttttttctttttcatgttttaagcagtctggaccgaaaagaaaggtaagcttaatattgaagaaattagagcatggatatagtggtaaaatataaaattatttatatgttttgaaaaatattggttgaattagagtttataattaaagctttttttaattttaaagttttagttgacatgtaata

SEQ ID NO: 37917 - DNA, 601 bp, Human
gcaatgtaatcagaaagtgtggttgacacccattttatttatgaaatgtttttaccaatgcttcattttggtatattggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagtatataatatatatataatgtatttaaaacaagttgatcacagtataattttgccttaatgactatagttactgcaactacagtgatatatcaacaatgaggtcttgcctcttatattttttttctttttcatgttttaagcagtctggaccgaaaagaaaggtaagcttaatattgaagaaattagagcatggatatagtggtaaaatataaaattatttatatgttttgaaaaatattggttgaattagagtttataattaaagctttttttaattttaaagttttagttgacatgtaataatt

SEQ ID NO: 37918 - DNA, 601 bp, Human
taatattttgaattgctatgtgatggctctgcatgggcatggtggccagtgcttcagttttgacagcattaccatccttggtgatgacatggacagcaatgtttctacaattgtttgaaatggtaaatatatttttgattacatgctgccttttaggcatacgcttttattcattccaagtatttatcgaacctgctgttacaggatacagtgcatcctgcataaggatacagtgatgaacaaagcagacaagatccccgcagtcctgtagtttacattcttatgggacaaagactaatastgaacaagtaaaacatgaaataataatttccatgtagagaagtgtaatgggttgatgtgatagactgacagtatgatttctttaaatcgcatattcagggaaactctttactatgaagctaacatttaactaaagactaaatggggaattggcagtgccacgatcataagaatggcttttccagatagggaagaggttgtgctaagttactaatccaggaatgagtttggcatgtcaaagaacagaaaaaaggggccactaaggctggagcttagagaggaaaggagacaatgttatgag

SEQ ID NO: 37919 - DNA, 601 bp, Human
ttgtaaactgtgtatgttttatcacagtaaaaaagaaaaaaaaaacaccaaaaggatgtagttacatcaaagggaaacgggagccaactaaaagggctcccaaatgcccaaactgataacaattggattataacttagaccgagggacactctatgaaatacctgacgagttctctctaaatactgaaaaacacaagagaggagactaaggagacatgatgacttaatgcattgtatcctagattggatcctggaacaaaaatggggtattagtaaatagctggtaaatttctttctttcttttttttttttttgttttctttttctttgagacagtctggctctgtcgcctaggctagagggcaatggtgcaaccttggctcactgcaacctctgcctctcaggttcaagcaattcttgtgcctcagcctcctgagtagctgggattacaggcatgtaccaccatgcctggctgatttttgtatttttagtagagacggtgtttcgccatgttggccagtctggccgcgaactcctggcctcaagtgatctgacggccttggcctcccaaagtgttgggattacaggcatgagccacctt

SEQ ID NO: 37920 - DNA, 601 bp, Human
tttgaaatttatacctgcaagagtaatggaatcctcaaattaagaaattaatgtaaatgctggccaggtgtggtggtttatgcctgtaatctcagcactttgggaggccgaggcaggcagatcacttgaggccaggagttcgaggccagcctggctgacatggtgaaacaccatctctactaaaaataacaaaaattagcacagcatggtggcgcacacgtgtaatcccagctactcaggaggctgaggcatgggaatcacttgaacccgggaggcagaggttgcagtgagccaagattgygcacgctactgttctccagcctggtgacagagccagactctgtctcaaagaaagaaagaaattaatgtaaattttcattttagatcatctagcaaaaaggttttaaaactgaattttggagaaaataatatatggctaggtagtttatcaaacatttttatcttgaaatgtttatattcttgtatttaagatactctgtttctttattataatttttaaaaaacagaactttaatttgccctgcttttataggaaaaaatatagcaaatattgaaaacagtggccataaattctggaaat

SEQ ID NO: 37921 - DNA, 601 bp, Human
tttttcatgtataaagtattaatatgttatataagtttattgtgaggattaaaggaattaataaatacaaagcacacatggcacatgatgctattttctgactgctattataagtacactactgtcagccgggcgcggtggctcacgcctgtaatcccagcactttgggaggctgagacaggcagatcacgaggtcaggagatcaagaccatcctggctaacacagtgaaagcccatctctactaaaaatacaaaaaattagctgggcgtggtggtgggcgcctgtagtcctagctactckggaggctgaggcaggagaatggcatgaacctgggaggcggagcttgcagtgagccgaggtcatgccactgcactccagcctgggcgacagagcgagactccgtctcaaaaaaaaaaaaaaaagtaagtacactactatctccacccatattactttttcttttgttattttcatattttgttttcagttcaagtgccttgactttttgtaatataagaatttgaaattcttgcaagaaaatttctttggaacttttgtttgagtaaaatgattttaatgaaatgaaagctatgatttaca

SEQ ID NO: 37922 - DNA, 601 bp, Human
gtctgtaactttcatgatgtttcatgacttaccttgatgcttcaattgtcccagattccatgtgagtcccttcaagctggcctctgttttttctgacatgtccctatcattctttgaagacattcatgacattcacttctctgctttttagtataacaagatggtcttaacttatcttgtatttctttttttttttccccgagatggagtcttgctctgtcacccaggctggagttgagtggagcgatctcggctcactgtagcctccacctcccggttcaagcagttcttctgtctcagyctcctgagtatctgggactacaggcatctgccaccatacccggcttatttttgtattttagtagagatggcgtttcaccatgttggccaggctggtcttgaactcctgacctcacgtggtccacccacctcagccttccaaagtgctgggattacaggcgtgagccaccgcgcctggccattattttgtatttctgtctcagccctagagtcattcatttctctgaggagccatgcatacaaggagaaggaaatatcttctcctttaagtggagggaacatatttgggcactagttatgt

SEQ ID NO: 37923 - DNA, 601 bp, Human
acattcatgacattcacttctctgctttttagtataacaagatggtcttaacttatcttgtatttctttttttttttccccgagatggagtcttgctctgtcacccaggctggagttgagtggagcgatctcggctcactgtagcctccacctcccggttcaagcagttcttctgtctcagcctcctgagtatctgggactacaggcatctgccaccatacccggcttatttttgtattttagtagagatggcgtttcaccatgttggccaggctggtcttgaactcctgacctcacgtgrtccacccacctcagccttccaaagtgctgggattacaggcgtgagccaccgcgcctggccattattttgtatttctgtctcagccctagagtcattcatttctctgaggagccatgcatacaaggagaaggaaatatcttctcctttaagtggagggaacatatttgggcactagttatgttcattcacatgggtattattgtttctcggccttctcagtggacaaagctaagaaatacatgtgtgtgtattaatatttaatctatattagaatccataagttcacactgataactctaa

SEQ ID NO: 37924 - DNA, 601 bp, Human
ttatcttgtatttctttttttttttccccgagatggagtcttgctctgtcacccaggctggagttgagtggagcgatctcggctcactgtagcctccacctcccggttcaagcagttcttctgtctcagcctcctgagtatctgggactacaggcatctgccaccatacccggcttatttttgtattttagtagagatggcgtttcaccatgttggccaggctggtcttgaactcctgacctcacgtggtccacccacctcagccttccaaagtgctgggattacaggcgtgagccaccgygcctggccattattttgtatttctgtctcagccctagagtcattcatttctctgaggagccatgcatacaaggagaaggaaatatcttctcctttaagtggagggaacatatttgggcactagttatgttcattcacatgggtattattgtttctcggccttctcagtggacaaagctaagaaatacatgtgtgtgtattaatatttaatctatattagaatccataagttcacactgataactctaattccagtccaacactgagtttatttaatttttcccacgttgcatgtttgtaa

SEQ ID NO: 37925 - DNA, 601 bp, Human
atgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaagtaagtattttactccctttaatattgcttatatcaatcyagtatttttcagatatatttttacaaccactctccccaaccccatatatatttttaatataaatgtgagcttaaaactaatcttgttctcatcctgtccatcttaaatagttaaaaaaaacaaaaaaaagaaccacagaacttgaccctagtcttagatgaagtgctagttataaccagcattctgacttcggccaggttaatttaatctttctgatctgtaaatgggtagatttcctgctgatagtggtttttttttttgtgggggggggggtgcctaaaataacataaaatatgcata

SEQ ID NO: 37926 - DNA, 601 bp, Human
aaatgatccaagtaagtattttactccctttaatattgcttatatcaatccagtatttttcagatatatttttacaaccactctccccaaccccatatatatttttaatataaatgtgagcttaaaactaatcttgttctcatcctgtccatcttaaatagttaaaaaaaacaaaaaaaagaaccacagaacttgaccctagtcttagatgaagtgctagttataaccagcattctgacttcggccaggttaatttaatctttctgatctgtaaatgggtagatttcctgctgatagtggtttttttttttgtgggggggggggtgcctaaaataacataaaatatgcatagcccaataaaatatttgacatacaatatccttaccacatttgttcctaactctatatcctgtctttttactcttatgtgtatgtgtatggcatgcagtccttgtttataataaatagcaaaagattagaaattattggggactggttgactagagtatacagcgtgtatactctaaaggagtgaaagatctgataaactgtgtaatttccaagatccttaattaagtgaataatgcaagctacagataag

SEQ ID NO: 37927 - DNA, 601 bp, Human
taagtattttactccctttaatattgcttatatcaatccagtatttttcagatatatttttacaaccactctccccaaccccatatatatttttaatataaatgtgagcttaaaactaatcttgttctcatcctgtccatcttaaatagttaaaaaaaacaaaaaaaagaaccacagaacttgaccctagtcttagatgaagtgctagttataaccagcattctgacttcggccaggttaatttaatctttctgatctgtaaatgggtagatttcctgctgatagtggtttttttttttgkgggggggggggtgcctaaaataacataaaatatgcatagcccaataaaatatttgacatacaatatccttaccacatttgttcctaactctatatcctgtctttttactcttatgtgtatgtgtatggcatgcagtccttgtttataataaatagcaaaagattagaaattattggggactggttgactagagtatacagcgtgtatactctaaaggagtgaaagatctgataaactgtgtaatttccaagatccttaattaagtgaataatgcaagctacagataagagtgtatactgt

SEQ ID NO: 37928 - DNA, 601 bp, Human
tttttgtgggggggggggtgcctaaaataacataaaatatgcatagcccaataaaatatttgacatacaatatccttaccacatttgttcctaactctatatcctgtctttttactcttatgtgtatgtgtatggcatgcagtccttgtttataataaatagcaaaagattagaaattattggggactggttgactagagtatacagcgtgtatactctaaaggagtgaaagatctgataaactgtgtaatttccaagatccttaattaagtgaataatgcaagctacagataagagtgtrtactgtggagaatgaacataatttcttctaaaaaatagaaattgggcacagtggtgtcccaactactcaggagactgagatgagagaattgcttgagtccaggagttgaagtgtagccagggcaatatagtaggaccctgttgctaaaaaaaaaaaacaataataataattataaacagaacactaggctttccttttaatatatacttgtgtagtttttcattaaaaatatagttcatgggcctttttaaaaaatctatatacatgtacacacatacgtctgtatgtatatatatatac

SEQ ID NO: 37929 - DNA, 601 bp, Human
atatttaaactaatacttggtggccaaaatgcataatattgagggaagtagaattcaggcaggagcaagcttgtggtgtttcagggacagaaatactggctagtgtgcctggaggataaagagacaaaaacagaatattatgagaaaattggataaataggcaggggccagattatgtaaatttacaaaccatagcaaggagtttgtatttgactcaaatacaatgtgagtggctttgtggaattaagatatagagatagatttgctacgattcagtaatgagtacaaggtataagagcarattaccatcatagtgtcttttcttgctcacgtccatttactcaacaagacttattgaacataaggcactggtccagatttttccaaggaccagttaagattttagtagcttcctgtgtgagataaaattacttggctacagccaggtgcggtggctcacgcctgtaatcccaacattttgggaggctgaggcaggcggatcacctgaggtcgggagttcgagaccagcctggccaacatggagaaaccccatctctactaaaaatacaaaaattagctgggtgtagtggtgcacacatgt

SEQ ID NO: 37930 - DNA, 601 bp, Human
tacaatgtgagtggctttgtggaattaagatatagagatagatttgctacgattcagtaatgagtacaaggtataagagcaaattaccatcatagtgtcttttcttgctcacgtccatttactcaacaagacttattgaacataaggcactggtccagatttttccaaggaccagttaagattttagtagcttcctgtgtgagataaaattacttggctacagccaggtgcggtggctcacgcctgtaatcccaacattttgggaggctgaggcaggcggatcacctgaggtcgggagttygagaccagcctggccaacatggagaaaccccatctctactaaaaatacaaaaattagctgggtgtagtggtgcacacatgtaatcccaggtgctggggaggctgaggcaggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatata

SEQ ID NO: 37931 - DNA, 601 bp, Human
cccatctctactaaaaatacaaaaattagctgggtgtagtggtgcacacatgtaatcccaggtgctggggaggctgaggcaggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatatataaaacgtatatatgatatatataaaacttatgatatatatataaaacgtatatatgatatatataaaacgtatatatgatatatataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaa

SEQ ID NO: 37932 - DNA, 601 bp, Human
gtgcacacatgtaatcccaggtgctggggaggctgaggcaggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatatataaaacgtatatatgatatatataaaacatatgatatatatataaaacgtatatatgatatatataaaaygtatatatgatatatataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagatacc

SEQ ID NO: 37933 - DNA, 601 bp, Human
tgaggcaggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatatataaaacgtatatatgatatatataaaacatatgatatatatataaaacgtatatatgatatatataaaacgtatatatgatatatataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagataccaagtcttaatgctttcttcagatttaacttttt

SEQ ID NO: 37934 - DNA, 601 bp, Human
gcaggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatatataaaacgtatatatgatatatataaaacatatgatatatatataaaacgtatatatgatatatataaaacgtatatatgatatatataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagataccaagtcttaatgctttcttcagatttaactttttatca

SEQ ID NO: 37935 - DNA, 601 bp, Human
ggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatatataaaacgtatatatgatatatataaaacatatgatatatatataaaacgtatatatgatatatataaaacgtatatatgatatatataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagataccaagtcttaatgctttcttcagatttaactttttatcagat

SEQ ID NO: 37936 - DNA, 601 bp, Human
taaactaccacatgaaaagtgcaaattaaggaaaatgaaatataactgtattcaatggactttaaaaattgttaaaaaatcaattaatatgtgctgttgtcaagaatccaagggaaaggacactttcccaatttgctgatggaaaagaaagttactatgatcttttgggaaagaaatgtaaaaatgaccattaaaaaatttttaatgtgtactatttgaccaaataattaattccttagactccatcttccccagtacgtaaggctttatatgcaaacatgattattggcaaacaaaatcrttgcctgttaatatggatatggctgaaaaagttaaggtatatccatatgatgcagccattgaaaataaaaattagaacttatatcagtgacttttaggagttctgcatggtactgttatgtgagagtaccaaaataaggaaatatgtgtatattactttagtatgaatgtttttataaaataataaacttgtatgttaaattctatatgtatgtgtttatacatgtcagtgttcataggagtacagatacaaatatgggaacatatatacttggttattaagatgggaaccttaaaaaat

SEQ ID NO: 37937 - DNA, 601 bp, Human
taatttttaaaaaataaagaaatagaggcaaaccatagggaaataaggaaaggaaatgaatagaattcaaaaaaaatagtaatccaagtagtgaaaatgaaattaaaataccttttgtgaacttcagattgctgaaaaatttaaaactatgatattgtctcaatcttgatcagtgtttggagaagtggaatgttgaatgtataagttggtgtaactgttgagggcagtttggcagtaattctaaatgtgtaccacaactggctggactgcaaaaatgctctttgaagaatagtttgctatygcaagagattggaaagaacttagatgtccagcatatgagttcagttaaattaatgatgaatttccatgtaatggaattttcagatgagcggttttcagactggcacactgaatcataagggtacctcagtgtgtactgtctttgatgatgctccatggagggtgtggaccattcatattctagactaaatcctttattgtagattcagctggagcagctctttcctgttttattagtgagctaaataacctctcatttgaagatataactctacagctaaaaacaaaacaaaacactttt

SEQ ID NO: 37938 - DNA, 601 bp, Human
ctatcgcaagagattggaaagaacttagatgtccagcatatgagttcagttaaattaatgatgaatttccatgtaatggaattttcagatgagcggttttcagactggcacactgaatcataagggtacctcagtgtgtactgtctttgatgatgctccatggagggtgtggaccattcatattctagactaaatcctttattgtagattcagctggagcagctctttcctgttttattagtgagctaaataacctctcatttgaagatataactctacagctaaaaacaaaacaaaacayttttaaacctctctaacaggtttctttaataataagggaaaataggccggatgcggtggctcacacctgtaatcccagcactttcggagactgaggtgggcagattgcctgaggtcaggagttcgagaccagtctggccaacatggtgaaactctgtctctactaaaaatacaaaaaaattagccaggcgtggtggtgtgtgcctataatcccagctacttgggaggctgacgcaggagaattgcttgaaccccctagggaggtggaggttgcggtgagctgagatcatgccactgcact

SEQ ID NO: 37939 - DNA, 601 bp, Human
taatattgtaacatatgtcagtgtttttagggatttatgaaatttgtgttttgttacagccctcatactgcagactgtctttcctggtttctgtcaattaacaaaaatgtcactgtgtgtcacttagcacctcaaaaatgttcaggagtgccctgtaacttttacggctttctcccacattaatgctgttatttataactcttcagtgtgatgagtaaggttttgctggtgatttagacatttaattagaaagttgcatatttagtcttaaagctgtttatgaagaactacattaaaattyggatgaattttttctaataggttatatttgctacagtgaagaaaaactttgtaaatttagttaaaaaaataaaaggcagtatatgtaacataaaatgtgtcagtttaaaaaattataatgctaaatgaaatattccagccaaaaaatataatgtagaaatttgcagtgtggtattaaccttacttgtagcatgagatttttagcaaagggcattcttcattgaagaataattagtggatctgtatcttcttcagatggcgtaaataaaaagatgatttgatattttcttcttgaacataa

SEQ ID NO: 37940 - DNA, 601 bp, Human
aaaattagtggggtgtggtggcgtgcacccgtaaccccagctactagggaggctgaggcagaagaatcacttgaacccgggaggtggaggttgcagtgagccaagattgtgccactgccttccagctcgggtgacagagtgagactcattctcaaataaataaatgaatgagtgaatgctttatgtcatcattattgacactttttgcatcagctaacatttttccaaaacatataatgtcaacatccacgtatgctagaatgtttcgcaagctactcctttttttttttttttttttttwaaaaaaacgataaggtctctcttcgttgctcaggctggagttcagtgctgcagtcatagctaactgtaaccttgaactcctaggcacaagcaatccttccacctcaggccccagagtagttgggactataggtacatgccatctatacctaggtaagtttttctttttttgagatgatgtctcactatttttgcccaggctggagtgcagtggcacaatcttggctcattgcaacttctgcctcctgggttcaagcgattctcctgcctcagcctcctgagtagctgggattacaggcat

SEQ ID NO: 37941 - DNA, 601 bp, Human
aaattagtggggtgtggtggcgtgcacccgtaaccccagctactagggaggctgaggcagaagaatcacttgaacccgggaggtggaggttgcagtgagccaagattgtgccactgccttccagctcgggtgacagagtgagactcattctcaaataaataaatgaatgagtgaatgctttatgtcatcattattgacactttttgcatcagctaacatttttccaaaacatataatgtcaacatccacgtatgctagaatgtttcgcaagctactccttttttttttttttttttttttwaaaaaacgataaggtctctcttcgttgctcaggctggagttcagtgctgcagtcatagctaactgtaaccttgaactcctaggcacaagcaatccttccacctcaggccccagagtagttgggactataggtacatgccatctatacctaggtaagtttttctttttttgagatgatgtctcactatttttgcccaggctggagtgcagtggcacaatcttggctcattgcaacttctgcctcctgggttcaagcgattctcctgcctcagcctcctgagtagctgggattacaggcatg

SEQ ID NO: 37942 - DNA, 601 bp, Human
aattagtggggtgtggtggcgtgcacccgtaaccccagctactagggaggctgaggcagaagaatcacttgaacccgggaggtggaggttgcagtgagccaagattgtgccactgccttccagctcgggtgacagagtgagactcattctcaaataaataaatgaatgagtgaatgctttatgtcatcattattgacactttttgcatcagctaacatttttccaaaacatataatgtcaacatccacgtatgctagaatgtttcgcaagctactccttttttttttttttttttttttawaaaaacgataaggtctctcttcgttgctcaggctggagttcagtgctgcagtcatagctaactgtaaccttgaactcctaggcacaagcaatccttccacctcaggccccagagtagttgggactataggtacatgccatctatacctaggtaagtttttctttttttgagatgatgtctcactatttttgcccaggctggagtgcagtggcacaatcttggctcattgcaacttctgcctcctgggttcaagcgattctcctgcctcagcctcctgagtagctgggattacaggcatgc

SEQ ID NO: 37943 - DNA, 601 bp, Human
ctactagggaggctgaggcagaagaatcacttgaacccgggaggtggaggttgcagtgagccaagattgtgccactgccttccagctcgggtgacagagtgagactcattctcaaataaataaatgaatgagtgaatgctttatgtcatcattattgacactttttgcatcagctaacatttttccaaaacatataatgtcaacatccacgtatgctagaatgtttcgcaagctactccttttttttttttttttttttttaaaaaaacgataaggtctctcttcgttgctcaggctggasttcagtgctgcagtcatagctaactgtaaccttgaactcctaggcacaagcaatccttccacctcaggccccagagtagttgggactataggtacatgccatctatacctaggtaagtttttctttttttgagatgatgtctcactatttttgcccaggctggagtgcagtggcacaatcttggctcattgcaacttctgcctcctgggttcaagcgattctcctgcctcagcctcctgagtagctgggattacaggcatgcattaccacgcctggctaattttttatacttttagtaga

SEQ ID NO: 37944 - DNA, 601 bp, Human
accaaagctttctttacaccaaagcactttacaggaataaaagattaaataatattcatagaatttattaagatggttagttgttacatatatcttcttatcaaagggcatatatcttggtgtaatttcattcagaaatatcacagaacctaactttttagaaaccccttttcatttggaaaaaataaaaaagtttctttaaggcagttataaagattttttttattacccacaagagtaatgatttatagagcataataaatatgtgcttacatttacttaaacttgtatttcctcacartttcccccattcatgatattaccctcttaagaattatttttccatttcatttgttttcctccagaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaagtaagttgtgtaaaacagattataatagataataatagata

SEQ ID NO: 37945 - DNA, 601 bp, Human
ttgacaaaaatgttaactattatatctttaagactatagatttagatttattagatgaagtaaattagttacatacgtgaatagatttgttcttgaactgttgttagagtaatgtattctggttccttccaataacttaggtgacattggcatgtaacacatactggtctttccagtgattgttgtgtatccactgtatgtcagacattgttgtggacctttatactgggatttctgattatcctcctggaaagaattaataattactccttttaaaagtatctatttacttcttttgtgtttttttttggacttatatttatttcttttcagatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtaattatgttttttaatttaaaaatattcttaaattgtgg

SEQ ID NO: 37946 - DNA, 601 bp, Human
aatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtaattatgttttttaatttaaaaatattcttaaattgtgggtagttttaaagggaaatatgttttattttaatactgttcatttcagtgttaaatctttttaattttatttcagaattacttacttttwtgtgtgatttgtaaactaccttgtgtcaaaacagtggtgggtaggtgccaaataccacttgatacaggtctcagaagcatttttggttcctccacattctatccttatctttacttttcatcatcattttctctgtcatccttttttctttataccctacttccaacatatatatgcacacactgctacattcaaatggattggttaccctgtgtcttacgtttgaagaaattgtggtccgtggtgtacatttgtatgtaatataggcatatatggttgaaaacttgagagatgaagaat

SEQ ID NO: 37947 - DNA, 601 bp, Human
ccctgtgtcttacgtttgaagaaattgtggtccgtggtgtacatttgtatgtaatataggcatatatggttgaaaacttgagagatgaagaatacatgctatttgatctttattgtcaaaacatgtatctagtactaaaataactattcatataggtaggtaactctgaagccacctgaagcaaaggccacaatactactaaacacatagtataatggtaaataatacaaacataattttaaaactctaagtttatttcctattacagcaacttagctttgctgacctaatttattgggarcagatctctcacactgcctacaaacttggaaatatggctatccacagcgcaatcttggtgatagttgagcaaggactccccagagaagagctgtaaatatagttaagtgggttgagaaaagaacaaaagaagaaagggaaatggttctttttcttttgcatagtttgcatgggagacagtgccagaggaagaaaagagcagcataatgccactgggatggactcaaacttcagaggaaggttctttcctccaaggaacccctgtttcacttagctttatggagggctgaaactcattaga

SEQ ID NO: 37948 - DNA, 601 bp, Human
tggaaatatggctatccacagcgcaatcttggtgatagttgagcaaggactccccagagaagagctgtaaatatagttaagtgggttgagaaaagaacaaaagaagaaagggaaatggttctttttcttttgcatagtttgcatgggagacagtgccagaggaagaaaagagcagcataatgccactgggatggactcaaacttcagaggaaggttctttcctccaaggaacccctgtttcacttagctttatggagggctgaaactcattagactgtgttccctgagcctctgcccctayatcttatagattgcctagccattgaactaagaggcaaaaaccactttggtttttttgaaaggttatttgaattttaccagcattatttaatttcatgtagatagtagagagagaagtaagatactggaaaattactgttacataagttgggagagtatcactatctagaagctacagataataagaaagtggcccctagttttgcctgtttcttgtttttaattgttaagtatcatgcatactttttagttccacatttttaatccttttgcattgaaaagcattcttgccttgtgctta

SEQ ID NO: 37949 - DNA, 601 bp, Human
taaatcagttccattttcattcttcatgggttcatattcaccttccttaaactaactttgtgctagttttggaattttttttaacaacttatttatattgaggcaatatcatttagttctcttatcagtttacaaaattaatataattcataatattctaatactttcagaatacctggaatttataaatgttctgggtcaaatatctagaatagtgtttcccaaatgtgactagtaggtttttttaaaattacttagatacttactaactacagattactctgttttatcctagatgttyatccataatatctaagaaaggaacctgtgaatctatactcttaataagctctttgggtgattcttctcagacaaattaaggaaatactattgtacatagtaggcctgatttgttttctttttttcaagacagggtctcactctgtcacccaggctggagggcattggtgtgatcttgtctcaccacaacctctacctcccactctcaagtgatccttccacctcagcctcccaagtagctgggactaaggcacacgccactccacccagctaatttttgtattttttgtggagacagggt

SEQ ID NO: 37950 - DNA, 601 bp, Human
attttaaaacatctttctgaaatctcttgtgtatattcatatttgtactgcctgttttacaagaattaatgcagtttcacagtgaagcatgtaagatattgaattttagagacaatagaccagatacctttctaatctcattttattcattaatgtcaaataataccatttttaaaaatatggtgcttattgtctagcaagtaacctatagaaaagtattattttatacaaaaagatgattaggtcacataaaggaattggaatcttaagtttaaaatacacttctgtttttagccagaarggagaaacgatggttggatttatgccatttttcaattaaaaaccatgtggactacttgaagcagtttctgagtaaatggaggtgtttaaagatttgtattattctctcccaatgactagatagtagtattttacaatggagacttaaaagttttttgtgttttattctttcgcttttctatgccctcaatccaaagaacaccagaaatacacttgtagtcggaaaacttgggtttatcacttgcatcaaggaatgacacacaccatgggccactctggagcctctcaataaaaggatgtt

SEQ ID NO: 37951 - DNA, 601 bp, Human
cctctcaataaaaggatgtttcaaagaacctgtgacagaatctgggctttccttgagtgatatgggggagggtctaaagtagtggtttgcctaggtaaagaagtagcattcactcattaataaagaagaagaatgttggctattttgtggtttccaactgtgaccttatgtttttctctgcttagacaaattatgatatggccctactttgtctcattctatcatggttgcagaatatgctttcctggagttggtattctatgagattgtttatgtctaataagcctagctgtgccaagcyagcttctgaattttttttttttaacttttgtagaggtgagggtctcactgtgttgctcaggctggtcttgaactcttggcctcaagccatcccccaacctcagcctcccaagtagctgggattatagacatgagccactgctcctagcaaagctatatatttttaaattcatattatcatagtaaaatttaaaataacatttaaaactagttaatttcttcattctcttcaaaataaggttttggctgggcgtggtggctcacgcctgtaatcccaacactttgagaggctgaggtgggc

SEQ ID NO: 37952 - DNA, 601 bp, Human
aaggatgtttcaaagaacctgtgacagaatctgggctttccttgagtgatatgggggagggtctaaagtagtggtttgcctaggtaaagaagtagcattcactcattaataaagaagaagaatgttggctattttgtggtttccaactgtgaccttatgtttttctctgcttagacaaattatgatatggccctactttgtctcattctatcatggttgcagaatatgctttcctggagttggtattctatgagattgtttatgtctaataagcctagctgtgccaagctagcttctgaattttttttttttaacttttgtagaggtgagggtctcactgtgttgctcaggctggtcttgaactcttggcctcaagccatcccccaacctcagcctcccaagtagctgggattatagacatgagccactgctcctagcaaagctatatatttttaaattcatattatcatagtaaaatttaaaataacatttaaaactagttaatttcttcattctcttcaaaataaggttttggctgggcgtggtggctcacgcctgtaatcccaacactttgagaggctgaggtgggcggattacttga

SEQ ID NO: 37953 - DNA, 601 bp, Human
aaagaagtagcattcactcattaataaagaagaagaatgttggctattttgtggtttccaactgtgaccttatgtttttctctgcttagacaaattatgatatggccctactttgtctcattctatcatggttgcagaatatgctttcctggagttggtattctatgagattgtttatgtctaataagcctagctgtgccaagctagcttctgaattttttttttttaacttttgtagaggtgagggtctcactgtgttgctcaggctggtcttgaactcttggcctcaagccatcccccmacctcagcctcccaagtagctgggattatagacatgagccactgctcctagcaaagctatatatttttaaattcatattatcatagtaaaatttaaaataacatttaaaactagttaatttcttcattctcttcaaaataaggttttggctgggcgtggtggctcacgcctgtaatcccaacactttgagaggctgaggtgggcggattacttgaggtcaggggttcaagaccaacctggcgaacatggcgaaacctcgtctctactgaaaatacaaaaattagctgggcgtggtggtgc

SEQ ID NO: 37954 - DNA, 601 bp, Human
gaggtcaggggttcaagaccaacctggcgaacatggcgaaacctcgtctctactgaaaatacaaaaattagctgggcgtggtggtgcgtgcctgtaatcccagctactcaggaggctgaggcaggaggatcgcctgaacccgggaggcagaggttgcagtgagccaagatcatgcccctgcactccagcctgggcagcagagtgagactccatctcaaaaaaaaaaaaaggaaaagaaaaaaaaagacagaaaagaaggtttcttgactgggtactaatttgtcttgtaaagtaacatgtraacagcttactaggtgaaagggaggaaagcgatttgtcagaaatgagttataaaaattttaaatagaaatattatttgattatacacgatttaggaatagaggcgcatccctcttagtcactatacctctgcatggaagttattatcagtgcttccagtcatcttagtgagaggtagaaaatgaactctgtaagagagctctaccatttgtagattaaaaaatagcctataaatcaagagagcttgtttttgtttttgcttttttttttttttttttttgaagagacaaagctacaaata

SEQ ID NO: 37955 - DNA, 601 bp, Human
gatcgcctgaacccgggaggcagaggttgcagtgagccaagatcatgcccctgcactccagcctgggcagcagagtgagactccatctcaaaaaaaaaaaaaggaaaagaaaaaaaaagacagaaaagaaggtttcttgactgggtactaatttgtcttgtaaagtaacatgtgaacagcttactaggtgaaagggaggaaagcgatttgtcagaaatgagttataaaaattttaaatagaaatattatttgattatacacgatttaggaatagaggcgcatccctcttagtcactatacytctgcatggaagttattatcagtgcttccagtcatcttagtgagaggtagaaaatgaactctgtaagagagctctaccatttgtagattaaaaaatagcctataaatcaagagagcttgtttttgtttttgcttttttttttttttttttttgaagagacaaagctacaaatacttatacactaattatgttagattggctgccatatatttgtcatctgttttgtttttattttttctggtagtaccagttttgtttttcttttctttctttcttttttctcgagatagggtctctgtc

SEQ ID NO: 37956 - DNA, 601 bp, Human
taatctatcttaagtgaaattgcctaggtattttcttttgttttgttttgttttttagagacagagtctcattctgttgcccaagctggagtacagtggtgcaatcatagctcactgaagcttcaaactcctaggcttaagcaatcctcctgcctcagcctcctgagtagctagaactacaggcgcatgccacaggcccagctaattttttaaaatttttttggagatggggtctagctgtgttgcccagactggtctcaaacttctggcctcaagcagttcccccacctcagcctcccatagcaccaggattacaggcatgagccactgcgcctggccaaaagtctgtgtaaccctctctcttgctgttaaagttaacgtagctgttattaaaaggaatcataaaagcaaaaccctggcttaatggaagtaattgttggaagtaattgtctgattcagctttctcttcttaggccaaaaaggatttttcctagtttttaggtgaggatatttgtagcttagccacattggcatagctaagaaatattaagaactgtgataggctttattacagctgtaggttgagagtcactgtattata

SEQ ID NO: 37957 - DNA, 601 bp, Human
ccctctctcttgctgttaaagttaacgtagctgttattaaaaggaatcataaaagcaaaaccctggcttaatggaagtaattgttggaagtaattgtctgattcagctttctcttcttaggccaaaaaggatttttcctagtttttaggtgaggatatttgtagcttagccacattggcatagctaagaaatattaagaactgtgataggctttattacagctgtaggttgagagtcactgtattatactatatttcatcaattttattttatttattttgagatggggtctcactctgtygcccagactggagtgcagtggcaccatctcggctcactgcaatctccgcctcccaggctcaagctatcctcccacctcagcctccaaccccagtagcttggaccacaggcacgtgccatcacacccagctaatattttgtgtttttggtagagacggggttttgccacgttgcccaggccagtctccaactcctgagctcaagcgatatgcctgcctcaacctcccaaagtgttgggattacaggtgtgagccaccgtgcccggcatcatcaatttttaaaacacatttttttcacattg

SEQ ID NO: 37958 - DNA, 601 bp, Human
attagccaggactgtacagcttcttgcttgtgtcctatactctactgttgggaacagtgatacctgaattcagctgtatcataagcacctacttgatagctggaactctctactaatacttaaatttttgtgcaaggactaggttagatatgttatttctttttaatgtattaaatttcaatatagcatgagataaaacattacttatatacatatttttgatattaagcctttcctatcttaataacacacagtaacagtaaaaagaacaaaactatatatgcaattcttagaatgttgaaaaatcatatgacctaattagactgctgaagacagtttaatccttttttttttttttttttttttttggagacggagtctcgctctgtcgcccagggtggagtgcagtggcacaatctcagctcactgcaacctccgcctcccgggttcaagcaattctcctgcctcagcctcccaagtagctgggactacaggcgcacactaccacgcccagctaattttctgtattttagtagagacggggtttcactgtgttgcccaggctgttctcgaactcctgaactcaggcaatccacccgcc

SEQ ID NO: 37959 - DNA, 601 bp, Human
taagcacctacttgatagctggaactctctactaatacttaaatttttgtgcaaggactaggttagatatgttatttctttttaatgtattaaatttcaatatagcatgagataaaacattacttatatacatatttttgatattaagcctttcctatcttaataacacacagtaacagtaaaaagaacaaaactatatatgcaattcttagaatgttgaaaaatcatatgacctaattagactgctgaagacagtttaatccttttttttttttttttttttttttggagacggagtctygctctgtcgcccagggtggagtgcagtggcacaatctcagctcactgcaacctccgcctcccgggttcaagcaattctcctgcctcagcctcccaagtagctgggactacaggcgcacactaccacgcccagctaattttctgtattttagtagagacggggtttcactgtgttgcccaggctgttctcgaactcctgaactcaggcaatccacccgcctcggcctcccaaagtgctaggattacaggcgtgagccaccgcacctggccgacagtttaatctttaagatggatagctttc

SEQ ID NO: 37960 - DNA, 601 bp, Human
tacttgatagctggaactctctactaatacttaaatttttgtgcaaggactaggttagatatgttatttctttttaatgtattaaatttcaatatagcatgagataaaacattacttatatacatatttttgatattaagcctttcctatcttaataacacacagtaacagtaaaaagaacaaaactatatatgcaattcttagaatgttgaaaaatcatatgacctaattagactgctgaagacagtttaatccttttttttttttttttttttttttggagacggagtctcgctctgtygcccagggtggagtgcagtggcacaatctcagctcactgcaacctccgcctcccgggttcaagcaattctcctgcctcagcctcccaagtagctgggactacaggcgcacactaccacgcccagctaattttctgtattttagtagagacggggtttcactgtgttgcccaggctgttctcgaactcctgaactcaggcaatccacccgcctcggcctcccaaagtgctaggattacaggcgtgagccaccgcacctggccgacagtttaatctttaagatggatagctttccatctttt

SEQ ID NO: 37961 - DNA, 601 bp, Human
ttcaatatagcatgagataaaacattacttatatacatatttttgatattaagcctttcctatcttaataacacacagtaacagtaaaaagaacaaaactatatatgcaattcttagaatgttgaaaaatcatatgacctaattagactgctgaagacagtttaatccttttttttttttttttttttttttggagacggagtctcgctctgtcgcccagggtggagtgcagtggcacaatctcagctcactgcaacctccgcctcccgggttcaagcaattctcctgcctcagcctcccragtagctgggactacaggcgcacactaccacgcccagctaattttctgtattttagtagagacggggtttcactgtgttgcccaggctgttctcgaactcctgaactcaggcaatccacccgcctcggcctcccaaagtgctaggattacaggcgtgagccaccgcacctggccgacagtttaatctttaagatggatagctttccatctttttacataaagagaaggcaaaggggaatgacgagttgcaaagtgacattacttgccagaaaaagcaatgaatttttcattccaaaaaca

SEQ ID NO: 37962 - DNA, 601 bp, Human
atccttttttttttttttttttttttttggagacggagtctcgctctgtcgcccagggtggagtgcagtggcacaatctcagctcactgcaacctccgcctcccgggttcaagcaattctcctgcctcagcctcccaagtagctgggactacaggcgcacactaccacgcccagctaattttctgtattttagtagagacggggtttcactgtgttgcccaggctgttctcgaactcctgaactcaggcaatccacccgcctcggcctcccaaagtgctaggattacaggcgtgagccacygcacctggccgacagtttaatctttaagatggatagctttccatctttttacataaagagaaggcaaaggggaatgacgagttgcaaagtgacattacttgccagaaaaagcaatgaatttttcattccaaaaacaagaaagcgttcagggattgtttgcaaaagtaaatacaggctacataattttaatacaaactgtgttatttttgaatagacattgtgttctgttactgaatcagtgattacataaaacaagcagattaatttgagaactaaaaaaaaaataggcttttttttttt

SEQ ID NO: 37963 - DNA, 601 bp, Human
ttcaataaaggagaatctacatcccagaaagttgctgataggactaaaagtgagaatggcctacagaatgaaagtttaagttccacacatcatacaggtatgtatctaaatgttttgaaagaatgaaaaaattcagaataatctggattttttaataaacaggattaagatcctgttttaaaaaaaaatcaggttaatgactgggtgtggtggctcacgcttataatcccagcactttgggaggccaaggcaggaggatcacttgaggccaggagtttgagaccagcgtgggcaacatagsgagacccaatctccaacaaaaaaaaataaatagaaaatttttaaagaatttacttataacaatatagtaacacaacttacttttaatttatactgaggtataattataatagcattcactcatttaatgagtgtagcttgaactttgataaatgtatacatagagtcatgtaatcactactgcaatcaaaattgagaacctgatcagggcacagtggctcacgactgtaatcctagcactttgagaggccaagatgggcagatcacttgagctcagaagtttgaaaccagcctgggcaac

SEQ ID NO: 37964 - DNA, 601 bp, Human
atatagtaacacaacttacttttaatttatactgaggtataattataatagcattcactcatttaatgagtgtagcttgaactttgataaatgtatacatagagtcatgtaatcactactgcaatcaaaattgagaacctgatcagggcacagtggctcacgactgtaatcctagcactttgagaggccaagatgggcagatcacttgagctcagaagtttgaaaccagcctgggcaacatggtaaagccctgtctctaccaaaaatacaaaaacttagccagatatggtggtgcccatckgtggtcccagctacttaggaggttgaggagggaggatcgcttgagctcagggtgctgaagttgcagtgagtggagatcgcaccactgcagtccagcctgggtgacagagtgaaactccatctcaaaattaaaaaacaaaaaaattgagaactttccatcactcaaaaaaaaatcccattgtgccctttttgtagtctgtcacttctgtcacccctagggtgcaattttgaaattgcagtacaaagtttatattttccatttattggaacttggatctatttttatttcataggaaattta

SEQ ID NO: 37965 - DNA, 601 bp, Human
gagactgagaaagaaataagacacagagacaaagtatagagaaagaacagtgggcccaggagaacggcactcagcatatcaaggacctgccccgtcaccggtctttgagttctctctgttttggttgattactattttcactatctcagcaagaggaatgccgtaggagagcaaggtgataatagggagaagatcagcaagaaaacatgtgagcaaaggaatctgtgtcacaattaagttcaagtggaggtactatgcctggatgtgcacgtaggccagatttatgtttctctccacccaracatctcagtggagtaaagaataacaaaggagcattgctgccaacatgtctcgcctcctgccatagggcggtttttctcctatctcagaattgaacaaatgtacaatcgggttttatactgagacattcagttcccaggagcaggcaggagacagtggccttcctctatctcaactgcaagaggctttcctctttcactaatccttctcagcacagacccttcacgggtgttgggctgggggacggtcaggtccttcccgtcccacgaggccatatttcagactatcacatggggagaaa

SEQ ID NO: 37966 - DNA, 601 bp, Human
tcttcagctctaataacttgatttttgtccttgagtcagtcctgtagttgtagaacctgttaaatctagttttggccaggtgtggtggctcacgcctgtaatcccagcactttgggaggctgaggcgggtggatcagtaggtcaggagtttgagaccagcctgaccaacgtggtaaaaccccatctctactaaaaatacaaaaattagctgggtgtggtggtgcccgcctgtaatcctagctactcaggaggctgaggcaggagaatcacttgaacctgggggcggaggttgcagtgagcygggatcgcgcaactgcacttcagtctgggcaacagagcgagactccatctcaaaaataaataaattaattaattaattaattaaaaactagtttctgttcaaattcttaaatttgatatcaagtcaattgtataatttcctctccaacctacaagtaaaataatcctctccataaaaacccataacatgctatagtgtgtgccttgcaaacttcttaaactgtgaatagatctaatacatttttcttctttttttttaacaccttgctcatggaactaatgaatcttatttggatgaaaa

SEQ ID NO: 37967 - DNA, 601 bp, Human
tagttttggccaggtgtggtggctcacgcctgtaatcccagcactttgggaggctgaggcgggtggatcagtaggtcaggagtttgagaccagcctgaccaacgtggtaaaaccccatctctactaaaaatacaaaaattagctgggtgtggtggtgcccgcctgtaatcctagctactcaggaggctgaggcaggagaatcacttgaacctgggggcggaggttgcagtgagccgggatcgcgcaactgcacttcagtctgggcaacagagcgagactccatctcaaaaataaataaatwaattaattaattaattaaaaactagtttctgttcaaattcttaaatttgatatcaagtcaattgtataatttcctctccaacctacaagtaaaataatcctctccataaaaacccataacatgctatagtgtgtgccttgcaaacttcttaaactgtgaatagatctaatacatttttcttctttttttttaacaccttgctcatggaactaatgaatcttatttggatgaaaaatattggtataggacatagaataaattatgtgaattcagaaagaacctatcaaaaattgtgaatat

SEQ ID NO: 37968 - DNA, 601 bp, Human
ataatttcctctccaacctacaagtaaaataatcctctccataaaaacccataacatgctatagtgtgtgccttgcaaacttcttaaactgtgaatagatctaatacatttttcttctttttttttaacaccttgctcatggaactaatgaatcttatttggatgaaaaatattggtataggacatagaataaattatgtgaattcagaaagaacctatcaaaaattgtgaatatggaacatactcctgttacttataccagcttatattattttagtgagttagaaagctatttttgagcttttttttttttttttttttttttttttgagatggagtctctcttaatcacccaggctggagtgcagtggcgtaatcttgtctcactgcaacctccccctcctgggttcaagagattgtcttctcttgcctcagcctccctagtagctgggattacgggtgcgcaccacctcacccgacctgttgagctcttgtaagaaatctcctgagcaggaaaatctggagtagattagtggctgctcggggcttttgggggtgggcaggtgaggtgggtgggaatgtaggaagagagtgatagcta

SEQ ID NO: 37969 - DNA, 601 bp, Human
atcctctccataaaaacccataacatgctatagtgtgtgccttgcaaacttcttaaactgtgaatagatctaatacatttttcttctttttttttaacaccttgctcatggaactaatgaatcttatttggatgaaaaatattggtataggacatagaataaattatgtgaattcagaaagaacctatcaaaaattgtgaatatggaacatactcctgttacttataccagcttatattattttagtgagttagaaagctatttttgagcttttttttttttttttttttttttttttgaratggagtctctcttaatcacccaggctggagtgcagtggcgtaatcttgtctcactgcaacctccccctcctgggttcaagagattgtcttctcttgcctcagcctccctagtagctgggattacgggtgcgcaccacctcacccgacctgttgagctcttgtaagaaatctcctgagcaggaaaatctggagtagattagtggctgctcggggcttttgggggtgggcaggtgaggtgggtgggaatgtaggaagagagtgatagctaagtggtatggggtttctttttgagatgatga

SEQ ID NO: 37970 - DNA, 601 bp, Human
taaaaacccataacatgctatagtgtgtgccttgcaaacttcttaaactgtgaatagatctaatacatttttcttctttttttttaacaccttgctcatggaactaatgaatcttatttggatgaaaaatattggtataggacatagaataaattatgtgaattcagaaagaacctatcaaaaattgtgaatatggaacatactcctgttacttataccagcttatattattttagtgagttagaaagctatttttgagcttttttttttttttttttttttttttttgagatggagtctytcttaatcacccaggctggagtgcagtggcgtaatcttgtctcactgcaacctccccctcctgggttcaagagattgtcttctcttgcctcagcctccctagtagctgggattacgggtgcgcaccacctcacccgacctgttgagctcttgtaagaaatctcctgagcaggaaaatctggagtagattagtggctgctcggggcttttgggggtgggcaggtgaggtgggtgggaatgtaggaagagagtgatagctaagtggtatggggtttctttttgagatgatgaaaaggtttaa

SEQ ID NO: 37971 - DNA, 601 bp, Human
ctcatttttgaattatagtttgtacatttttgttttgtttttagtatgtgtataccatatcaactatctcttcctctgaaacaaatgtttcacaaaaaatcacatacagtgatttcacatagagtcaacaagtgttgactacttatgtcagataacaggctgtagtaaataagtggaaattaggtttttacagaaaactagggaaataacaatgtgtggaatcactactttcacttgctgttttttcacttgacaccttatgaaatagttgacttgccatggtgcatgaaaaatgtgtacrcttaaactctagaatcacactcaacatcttcacatggtctccttatatgagaagttctcaggaactgacactgattgagagaaccactgatcaagtcatcacctctcaatttactccagatcacttgtttatgggggaattgactgcatcatttaggttatttttctcctgtttttgaaaggcatttctggtttagtttgtgtaaggtagatagatatttatatgaccacagtttacatagataatgatttgctgctggaagtaacctgattataactgactaattctgaattacctgaa

SEQ ID NO: 37972 - DNA, 601 bp, Human
tcacaaaaaatcacatacagtgatttcacatagagtcaacaagtgttgactacttatgtcagataacaggctgtagtaaataagtggaaattaggtttttacagaaaactagggaaataacaatgtgtggaatcactactttcacttgctgttttttcacttgacaccttatgaaatagttgacttgccatggtgcatgaaaaatgtgtacgcttaaactctagaatcacactcaacatcttcacatggtctccttatatgagaagttctcaggaactgacactgattgagagaaccactgatcaagtcatcacctctcaatttactccagatcacttgtttatgggggaattgactgcatcatttaggttatttttctcctgtttttgaaaggcatttctggtttagtttgtgtaaggtagatagatatttatatgaccacagtttacatagataatgatttgctgctggaagtaacctgattataactgactaattctgaattacctgaagattttggacaaatgttattcaaatataggtgttttagctttaaacagacttaaaaatacagatttttggaaaagataaattgaagagg

SEQ ID NO: 37973 - DNA, 601 bp, Human
cctcccaggctcaagtgatcctcccacctcagcttcctgagtaactgggaccacaggtgcccaccactacacctggctgattctttattttattttgtttgtagagacagggtctcactatgttgcccaggtgatccttctgaactcaggtgatcctcctgcctcagcctcccaaagtgctagaggattacaggtgctaggccactgtgcccggccccatagtgcttcattggtttatcggttattttaaatagtgtgcttctgaacacaagagttagatttatgtatcttttctcttctmcttttttgagacagagtcttgctctatcacccaggtcggagtacagtggcgcagtcttggcttactgcaacctctgttgcctgggttcaagcaattctcctgtctctcagcctctcaagtagctgggattacaggtgcatgccaccatgcccagctagtttttgtatttttagtagagacagggtttcaccatgttagccagtctggattatatatcttttcagattttttgcttccttttcatcccatcttgtttatattaatatcttaacacctttttattaacttataccaaaattt

SEQ ID NO: 37974 - DNA, 601 bp, Human
agtgacttgggaggctaaggcagaaagatctcttgagcctaggagtttgagttcagcctgggcaacataaggaaactccatctcttaaaaaaaaatgaaaaaaggaaaaagaaaaagactttataaagtcttgtaaagcaatttcttcaactagtaatttatcatggcttctgaatttggatcatatcttaaaaaacaaattcagctttcaagtcagaagttgccaggataaatgtatacatgctgttgttgctgctactgtggtgtggactgaactttaatgtaatattgattaactcaycctaactcagctaccaccaccaatacccaccttcctctttcaaagcatttatgggtcatacttaacctttaacctgacttgacattcaagaagcaaatgtttaaaccttcagttatatggtacatgagtaccaaaaatattatattgttttcccacttttccagttatttttttttctcctgcctgattcgatttatatgtgtcatggcagaagcagataatatttaattaaagttaatatagatgaattctgacttttccttggagtctcatttgccctaacaaacagtatgaacagca

SEQ ID NO: 37975 - DNA, 601 bp, Human
ataaatgctgtcagagtcagtgaggaaacttgaggcatgctatctagggattaaaatgggaagaatgggtaatcatttcagtcctccatttgccagtttccccagcctctgcatgcacatgtccacacacaaatgttttgttttgtttaaattttttatgtgtatattttttgagacagagtcttgctctgtcgcccaggctggagtgcagtggcacgatcccagctcaccacaacctccacctcccaggttcaagcgattctcatgcctcagcctcaggaatagctgggactacaggtgygtgccaccatgcctggctaagttttgaatttttagtagagatggggttttgccatgttggcaagactgatctcaaactcctggcctcaagtgatccgcccctctgagccttccaaattgctgggattacaggcgtgacccatcgcgcccggccacaagttttgatagtgaaccactattcctttttacctacaatgttttggagcagaaatcactatatatcaaaacagtaacatggggttggagtttacactgattccttagctactctttgaaggctgtggagtaacccaaggcagac

SEQ ID NO: 37976 - DNA, 601 bp, Human
actctgatcttggctcctatcttcatccaccatacagtagatgaccactaggttctgtgaattgtgtcatttaatgtcagatagatttacttgtttatcgtcgagtgtcgctattctgaactgctataccaatctctaacagattcctatgcctcctgccttctggttttcatggttgtttcccaaaaacataaatctaatcctgttactttcctgctttaaatcttatagtggcttcctgtggctgttgatttacagaccaaaatctttcacatgattgataagcacctatgtgatctgwccccctatttaagcttctagcctcattttcccaccattttcactctagctttaatacaacagccagccacctgaatgccattgtttcatgttctttcttgcctctaggccttgattcatatttcctaacctggaatacttttttgttgcttctattataccttgtctgtctaacatgtattcattcttcaggtcttagcctaaacatcacttcctcttggaattgcataaaaccccagatatgtattttcacagtactctatacttctgtcataatacttgccatatttcttgttttaat

SEQ ID NO: 37977 - DNA, 601 bp, Human
atagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacmcaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaatttt

SEQ ID NO: 37978 - DNA, 601 bp, Human
tgggcacagtggctcacgcctgtaatcccagcactttgggaggctgaggcgggtgaatcacgaggtcaggagattgagaccatcctggctaacacggtgaaaccccgtctctactaaaaatacaaaaaaattagccgggcgtggtggcaggcgcctgtagtcccagctactcgggaggctgaggcaggagaacggcgtgaacccaggaggcggagcttgcaatgagccgagatagcaccactggactccagcctgggcgacagagtgagactcagtctcaaaaaaaaaaaaagaaagaaagaaaagaaatggcagtcttctaatgactaggttgttctggatggcttccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgaggtatgttctatgggaccaccggcatgctg

SEQ ID NO: 37979 - DNA, 601 bp, Human
aaagtacctggaaggaaaaaacatggcagatgcacctactttgtctctgtgtagtcactagaactccatagttacccccagaattcacatccgtcagattcataggacactcctgcagagagctcattacaacaggtgtcattagctcttttacatcctgtgtacaaataagaagagggattgaaggaaataagaattctttgaaatattaaaggtttaggaacatgggaagatcaaatggcaggcaggaagtggtgaagcacatcatctccctgaagggttctgcagtccccaggccctyggcgcagcctgggccaattttagatttttgaggaattagggaacagtagattcgacctgtgattacatgtcagattttgaatgaatggtaatcaaattattagtaaaatgaaattttatgaaaccccagactttaattctctataccatttatgtgtactaattatctttttgcttaattttcttaatttcatgtgtaattgaacattagttatctcttttttgtaaattgcaactgaaaatgtgtgttttgggtaattttaaaaaatcacaggtctgagaaaaagaagatagatcatgg

SEQ ID NO: 37980 - DNA, 601 bp, Human
tgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatrttttcatggctaggtatttctaatgtttattcttccctgtgtacttctacacatagctatgcactatgaaaattaaatggaatgaatgatatgtatattactcaaaataaagtttctttcactttaataatcattgtatctttttattcatatccttttttgagtgaaaaatgcttctgcaactaagcatgtgttacagcagggggcgatgtctccaaggataaaaattacccaaacgaaaataaaagtctgcctctgacaggacagcacagaatctagatgtttcattatggagaaaag

SEQ ID NO: 37981 - DNA, 601 bp, Human
aattataaactatggggtgaagatacctgacacattaaaattttgccactttttggtcaacaggaactattttgaggggaaaaagaaaaaaggagacaattaacaccaaagaaaccttttgtaaacagccccagtgggtcagaaagtatgatgttcactgacctagagagatactgaaatgctgttttctactgtgcacaatttacttatgctctctcttgctgggacagggtgggcagggtatggggacatgcacgggacatttggacaaccaaaattccagtcacttaattatgatgtragatactttttgaagagctttcgaagtagcatatacatgcgataagtaaattaaccaaccttattttgattgagaggatcgtttcgcagtctctgtttgttcttctgtaatttactaggcatcatctttccagttctgaagtcaaaactgctgagatcaacagtatttcccaggtaccttgccaactgaggcttgcttctgaacttcttaccacttggactagaagaaagtaaggttaattgaacaaaaggcaacaatattctccacataagccttttcttcatgtcttcccctaccctc

SEQ ID NO: 37982 - DNA, 601 bp, Human
atcttcataatgaccaactcaaatccaccccatagttaagcaatacagaggcaatttagccttctctttcattctgcctctctaaacaaaggacctgccaatgtccctatgaaaaccaatgcgaggtatgatatgaagaaacaatgcattttgacctctgtatcaattatcaggaattatattactgtaaactgcacaaattgagtgaagccaggtatgaagcagagaccccatgcccctcagaaaatgtaacatgacaagaggcaagagagctcgggtcagaaagtttccaatgcaggcsaccaggcaacactgttcaccaaggtggcttggtgctcaggaagggggtggcttagggaacgagcagtgtggaaagcaaaggaattaacataggtcaaatttactttgctagatgttctatataaattcccatttactccttacaacaatgctaagggaaaattttcttactttaattttaccaatgagaaactgaaggcccttggagcctaagaaagtttctcatgactgcatcagctaataagtagcagagccagttcaccaagccatgccttcctgggtccaaagcccttcttattcc

SEQ ID NO: 37983 - DNA, 601 bp, Human; identical to SEQ ID NO: 29116

SEQ ID NO: 37984 - DNA, 601 bp, Human; identical to SEQ ID NO: 29117

SEQ ID NO: 37985 - DNA, 601 bp, Human; identical to SEQ ID NO: 29118

SEQ ID NO: 37986 - DNA, 601 bp, Human; identical to SEQ ID NO: 29119

SEQ ID NO: 37987 - DNA, 601 bp, Human; identical to SEQ ID NO: 29120

SEQ ID NO: 37988 - DNA, 601 bp, Human; identical to SEQ ID NO: 29121

SEQ ID NO: 37989 - DNA, 601 bp, Human; identical to SEQ ID NO: 29122

SEQ ID NO: 37990 - DNA, 601 bp, Human; identical to SEQ ID NO: 29123

SEQ ID NO: 37991 - DNA, 601 bp, Human; identical to SEQ ID NO: 29124

SEQ ID NO: 37992 - DNA, 601 bp, Human; identical to SEQ ID NO: 29125

SEQ ID NO: 37993 - DNA, 601 bp, Human; identical to SEQ ID NO: 29126

SEQ ID NO: 37994 - DNA, 601 bp, Human
gaacactttatactcctctttttaaaataaaaaattagggctgggcacggtggctcacacctgtaatcccagcactttgggaggccaaggcaggcggatcacctgaggtcaggagttccagaccagcctgaccaatgtgatgaaaccccgtctctactaaaaatacaaaaattagccgggcatggtagcccacgcctgtagtcccagctactcgggaggctgaggcaggagaatcacttgaacccgggaggtggaggttgcagtgagccgagatcgcgccactgcaccccagtctcaaaactacatacatacatacatacatacatacatacatacatacatgtataaatccataaataaataaaatttaaaaattatgtttattttgccatgtaattttacaattctaaaattgtctgtattaattcaaaatctgaaatacctttaaaagttaggataaacaaattattctggaaattcatcaaataattgttttaaaaaagacaaaatcaccagaaagtgtatttatgaagttaggaagttgtaacctgcctacagcttcagttttgtgtcttgttcttacacacttttcctatcatgg

SEQ ID NO: 37995 - DNA, 601 bp, Human
cttgacatcactctgtccccaccaggaggagttactggtaagtctggctgcttgatttccatggccatgtggccactgagaagccgtctgcatcctagtgcatgctgggtctgtcgcaatgcaaggcagggacacctgagaccccgtccaccagagcagtgtttacaacactatccataactcccttcccgttaggcaaccccccccatgaccctcatcccacagcaagcctttagcaggagagacggaagaagagcccagtctttgaaaccttgcccccagttcagcaccattttccttyaaaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgccc

SEQ ID NO: 37996 - DNA, 601 bp, Human
tcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtctgagatgaccaggagttctgttttaaaggaaggaaatgtattttattttgcctaaaggaatcaaatgcaacatcagtataaaataatatattcaaggtatttcactgatttttttaacgaaccaaatacttgcttcccttattaacctstcgtcaacattgtttataaggattattagtccatttgtactttaacaaatcagtgctactagatcccatgtgattttttattttcaggattactctttgctaaaatattaaagcctgagttcaaaatattgtctgatgtgacttgtcttcccttaatattgacagagtggcatataagaccattgaaatgacatcaaatgccgtggatcccagatgtctgaaccttcagtgtgtaggctaggagcaccttaggcggacgcagatcgaagtgccagtagagatgtcacccctgcctccctg

SEQ ID NO: 37997 - DNA, 601 bp, Human
tgtcactgcaggtaaatggtgctgcctgggactgtgtggcatgggtttaactcttaagagcattttttttgttcttatatctgtcccccaaattaagagggaagtccttcattaaccatacaggttaatgagaccagtaatcccctcaacggggtgctgagccctggccatgtgcctcagatgtctgcgttaacaagcatcagccccagcaccagaccttcagagtgaggctctcggaactcactctgaagttaaagttcttcgcctctctttgaaagtttggagattcgcctaatcttayatgaaatggaaacttttatttcctctggcttatccctaatcttcttatgactttttcttctctgtaaactcgaatgaatcgccctttccctctggcaccctggccaattggaatgcgtcgccccttccctctggcaccctggccacgtcctgtgtttctgtcacagcctcagttcctcgcgtccgctcacccctgcattgcagatgccgctgcctgcgggtgcatggatccctgccaccaaagcctctgtccattctccacatgacttgtcttgaacactgtcctctggggctcactgat

SEQ ID NO: 37998 - DNA, 601 bp, Human
atgggctcattatatccaagataaatcataagccataagaccatgtccaaaatccaacaaatacatctgttctcagaagcactttaatacagatgtctgtctgacctgagcatatacctgtgcaggtgttccgaacgtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttcyttcactggatcgcatctccaagctgcccctttctcttgcctttgattttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcg

SEQ ID NO: 37999 - DNA, 601 bp, Human
atgtccaaaatccaacaaatacatctgttctcagaagcactttaatacagatgtctgtctgacctgagcatatacctgtgcaggtgttccgaacgtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttctttcactggatcgcatctccaagctgcccctttctcttgcctktgattttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggt

SEQ ID NO: 38000 - DNA, 601 bp, Human
gtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttctttcactggatcgcatctccaagctgcccctttctcttgcctttgattttgcacatcatcctgggctgtgctcccagctgtgtgtggccctggagctgactgagccacaccgtgtgtgcatgtgagagagggcaagrggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggttttccagatgagaagcagcctgtgt

SEQ ID NO: 38001 - DNA, 601 bp, Human
tttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctrtttccaaggaatgttctggaagaaacatacacacatacttgtttgccagatttacctgtgtggttttccagatgagaagcagcctgtgtcactccataagggagagtgcgtgcagcattgagagagtgagccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggt

SEQ ID NO: 38002 - DNA, 601 bp, Human
tgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggtyttccagatgagaagcagcctgtgtcactccataagggagagtgcgtgcagcattgagagagtgagccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaa

SEQ ID NO: 38003 - DNA, 601 bp, Human
ggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggttttccagatgagaagcagcctgtgtcactccataagggagagtgcgtgcagcattgagagagtgarccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaatcgacaaaaaccactgtgccacaccgacgggagatggttacttcttttcttcttcaaaatgtctg

SEQ ID NO: 38004 - DNA, 601 bp, Human
aaatgttctcaatcgacaaaaaccactgtgccacaccgacgggagatggttacttcttttcttcttcaaaatgtctgccatatgcaagtttacgaactgcacttacaagcttttttcccaaaatgttcatctttttaacctaagtttgttttatctggagaaagcacactatattaatatttgattcctgtcatcttcatcctgtgaatggcctcaatctgctctggaagatggcaaggggcttactaattcttcctttatttgaaagtagagcctatctattgtatcagttaatgttaaygatgccagataagtttcagtgtgacttcctttgaggagggagagagctctagcaagagtagaaaatccgtggggaaaaaaagcacaatttagaacgatagaagaaaccctattaaattagtctagaagttcccagtagcaaaaggaacccccgagtcctctccccacatcccgcgagtgagaacacgcagcagcatctctgtgggtagctcctgggaagggaagccacatccttggccagtgtctggcaccccagggtggagcaagactcagggagaggacccctgtcatgtggggccgt

SEQ ID NO: 38005 - DNA, 601 bp, Human
ccccacatcccgcgagtgagaacacgcagcagcatctctgtgggtagctcctgggaagggaagccacatccttggccagtgtctggcaccccagggtggagcaagactcagggagaggacccctgtcatgtggggccgtctctgtacccagcatctgctcagcccagcctggacagccagatgcaggaagcagaccctagaggtcagggaggaagctggggacagtttctctgtctacatccaccagcccaggagaaacccccagttctcggtatgtgactttcttgttctttccccctgmggggtcacctctatcagactctgcagccctcttcactgacccacctcttgctgccctaggaaacctggctgctctgctcatgaccattgtttccttgccgtgccgtgtccagggaggaggaagcacccgaacagcagcttctattctaatgttttgtacctgtatcttctcccccttttacctctctccttactgctatcttttacattaatcaaaggtgaacaccacaacgactgaatagaatagttccctaggtaagactccctgcctcttccagcagcatgggtgagtgagctggtc

SEQ ID NO: 38006 - DNA, 601 bp, Human
acaccacaacgactgaatagaatagttccctaggtaagactccctgcctcttccagcagcatgggtgagtgagctggtcatgttctttcatcgttttgttgttgttgttgttttgtttttgttgttgttgtttttaacgaccttagaagaggccgatcaccttctgggaacaccttacatcttagtgtgtatttcacctgagaccacttgctcagagccatagtttacatctgaagccaggacgctggagcacttggcactccagacagctggttcagggggctcccgctggttgagtggmcttgggcaggttacaaggcctctgtgcctcagttccctcatctatacagtggagacattagtagcatgagcctcagaggacatcgtgggaatgcagtgaggacaatttacctaacagacctggtgcttacctgccacatggtgtgcacaccgttggttcagctgcagtggatgcgagtttcccggcaggtgacttccagggtcctggcatcacacctctggtcagtggtttatctcacaaagttgagacggagtgatctgtctgtgggagttcaccactgcttgtgatttcactccgagt

SEQ ID NO: 38007 - DNA, 601 bp, Human
ccgatcaccttctgggaacaccttacatcttagtgtgtatttcacctgagaccacttgctcagagccatagtttacatctgaagccaggacgctggagcacttggcactccagacagctggttcagggggctcccgctggttgagtggccttgggcaggttacaaggcctctgtgcctcagttccctcatctatacagtggagacattagtagcatgagcctcagaggacatcgtgggaatgcagtgaggacaatttacctaacagacctggtgcttacctgccacatggtgtgcacaccrttggttcagctgcagtggatgcgagtttcccggcaggtgacttccagggtcctggcatcacacctctggtcagtggtttatctcacaaagttgagacggagtgatctgtctgtgggagttcaccactgcttgtgatttcactccgagtgtggttaatggtgacagtttactaatgaaaacatcacaagttaattctgttttccttcttattcctctgggtgccgttaacccctccttcctaatctcttcagtactttgatatttgatgtcaagattaattaccagaccagttagtccacc

SEQ ID NO: 38008 - DNA, 601 bp, Human
gcttcacaccaccttcctgtgtcttccgtttcaggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggtactgaggcgccctcaccgcaatgcgccggctccacctccccaatagcttgtctgtcctcacacctactgttccttaagttgtttcrtcatgtcatcatgcacagcttccgaaaacgatcacttggaatgattcttccttcagattgttttagcttagaagtgtggctacgtccctgaaaccttaatgccatctcaaaggcagctcttttcctccctgctgcagggtaacacccactgccaggccactgtgtgtggtggaaacgtctcttactctcagatattgaaagtcattatgcaaaacgcagggccagtcaccctgctgtcccctccttctcagcaacataaaaattgcttggattgtgataaccctccagtggagtttttaa

SEQ ID NO: 38009 - DNA, 601 bp, Human
tcccagaagcatgtcttcagaactcgggggtctgtagctgcctgtttgaccagcaagactggaacttggcaataactcagcccttaggagacgccgcaccttgttctgtgtgaagccgttcccttggcagaaggcgccttcctctgggttgctttccccccagaagccaatgcagttctgaaggccatgttttggtatcttattaggtgttgttttcatctgttacagcgtcaacagttgcatttgtttttttatcccttcacaggttccctcccacttactacgctccaagattaccaarcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcac

SEQ ID NO: 38010 - DNA, 601 bp, Human
gccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattccttttkatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatg

SEQ ID NO: 38011 - DNA, 601 bp, Human; identical to SEQ ID NO: 37994

SEQ ID NO: 38012 - DNA, 601 bp, Human; identical to SEQ ID NO: 37995

SEQ ID NO: 38013 - DNA, 601 bp, Human; identical to SEQ ID NO: 37996

SEQ ID NO: 38014 - DNA, 601 bp, Human; identical to SEQ ID NO: 37997

SEQ ID NO: 38015 - DNA, 601 bp, Human; identical to SEQ ID NO: 37998

SEQ ID NO: 38016 - DNA, 601 bp, Human; identical to SEQ ID NO: 37999

SEQ ID NO: 38017 - DNA, 601 bp, Human; identical to SEQ ID NO: 38000

SEQ ID NO: 38018 - DNA, 601 bp, Human; identical to SEQ ID NO: 38001

SEQ ID NO: 38019 - DNA, 601 bp, Human; identical to SEQ ID NO: 38002

SEQ ID NO: 38020 - DNA, 601 bp, Human; identical to SEQ ID NO: 38003

SEQ ID NO: 38021 - DNA, 601 bp, Human; identical to SEQ ID NO: 38004

SEQ ID NO: 38022 - DNA, 601 bp, Human; identical to SEQ ID NO: 38005

SEQ ID NO: 38023 - DNA, 601 bp, Human; identical to SEQ ID NO: 38006

SEQ ID NO: 38024 - DNA, 601 bp, Human; identical to SEQ ID NO: 38007

SEQ ID NO: 38025 - DNA, 601 bp, Human; identical to SEQ ID NO: 38008

SEQ ID NO: 38026 - DNA, 601 bp, Human; identical to SEQ ID NO: 38009

SEQ ID NO: 38027 - DNA, 601 bp, Human; identical to SEQ ID NO: 38010

SEQ ID NO: 38028 - DNA, 601 bp, Human
gtagctgggattacaggcacctgccatcacgcctggcaaatttttgtatttttagtagaggcggggtttcaccatgttggccaggctggtctcaaactcctgacctcaggggatcctccagcctcggcctcccaaagtgctgagattataggccggagccaccgcgcccgggctcatgacaattttctaaggcagcacagatgaaacaaggaaagcaggaaccagggtccaaaaccatgtctctctactctaaattcgatgctccttccactacactgatggctttcacagtttacagtgyatgcaaatcacctaaaggtcctgttcacagatcacagataccgaccaagtaggtcggggtggggcccgagaatctgtatttctagcgagcgcccagaagtagcggaggctgctggtcgtcgggctaccctttgcctggcaaggccctgggcaaagactacaaagagagagactcccggagacgctgaattttcagtgccaactgtcctcgactcggaacgctggccgcacctgccgtgacatcactgcacaggggtgcaattgcgtcactccccaggcgtcactgccgaaacaacccctg

SEQ ID NO: 38029 - DNA, 601 bp, Human
ctgcctcccgggttcaagcgattctcctgtctcagcctcctgagtagctgggattacaggcacctgccatcacgcctggcaaatttttgtatttttagtagaggcggggtttcaccatgttggccaggctggtctcaaactcctgacctcaggggatcctccagcctcggcctcccaaagtgctgagattataggccggagccaccgcgcccgggctcatgacaattttctaaggcagcacagatgaaacaaggaaagcaggaaccagggtccaaaaccatgtctctctactctaaattckatgctccttccactacactgatggctttcacagtttacagtgcatgcaaatcacctaaaggtcctgttcacagatcacagataccgaccaagtaggtcggggtggggcccgagaatctgtatttctagcgagcgcccagaagtagcggaggctgctggtcgtcgggctaccctttgcctggcaaggccctgggcaaagactacaaagagagagactcccggagacgctgaattttcagtgccaactgtcctcgactcggaacgctggccgcacctgccgtgacatcactgcacaggggtg

SEQ ID NO: 38030 - DNA, 601 bp, Human
acttgaaatcttctaccagatggggttgtaaatgtcacacttttaacaaagaagcgtggacctaagttctgaagcatagtgacccagctttggtctactcctcgccatgatcccctccatctcactgagcatatctgactaaagagactgcataggccgggtgtggtggctcatgcctgtaatcccagcactttgggaagctgaggcaggtggactgcttgagaccaggagttcaagaccagcctggccaaaatggtgaaaccccatctctaccaaaaatataaaaattagccaggcatcrtggcacgtgcctgtagtcccagctactcaggaggctgaggcagaacaatcacttgaacccagtaggcaaaggctgcagtgagctgagatcataccattacactccagcctcggtgacagagtgagactctgtctcaaaaaaagaaaaaaagaagcataaaacatgtgtcccatctctaacactagccttgggaaaatcaggatcgacatttcttacatataaaattggctgggtgcggcgactcacgcctgtaatcccagcactttgggaagccaaggagggagaatcacttgaggtcag

SEQ ID NO: 38031 - DNA, 601 bp, Human
agactagccttggagcctagatttcacttcattatgctccaaaatcaattcaaatgaactctcatcttcaaaatgtaaattcttcatgacagattatattttatctttaaaaataaatctcctaaccttaacaccttaattatattctctgagccttatattagagtaactcaaaaggtttttttccctgccagagaggagttttgcagcattcttaggtgtgtaaggtgtattcacctcattttgcagatacggaaaatagtgacctaagggtcatttagtttgtaatggtagcttcgawctgcactggtatcacttttttttttttttgagacagactctgactgtatcgcccaggctggagacagaggtgcgatcttggctcaccgcaaactccacctttcagactcaggcaattctcctttttcagcctctagagcagctaggactccagagtagctaggactacaggcaggtgccaccatgcccagctacatttttatatttttagtagagacggggtttcaccatgttgcccaggctggtctcgaactcctgagctcaagcaatcctcccaccttggcttcccaaagtgctggga

SEQ ID NO: 38032 - DNA, 601 bp, Human
gattattcgatccacagctgcccgactgatattgtctaaagtcattcctgaactgcgaaatctgacactggttcttcttccataagctgaaatgcaagtgtttattcttcgttacgatcaggtaaaatccagatgttccttttacagacagcagaaagggcactttgggatggaggtcacaaatcagttccccatgggccaggcgtgcccataaacggactctgtttaacctacagtgttaaaacagaggattttacctaaagatctggatttctggtttcactttaagtgtatgaagatytggaaatgctgagcctaccttcttaccaggcagttaacatggcaaccgcttctagatgagcatggttctccagttcaccaaccctctggcccacttcgccccagcccaggctgtacaggagaggcccatacagagctttcaaaaacaccgtgctcttccccagtcaatctctgggagggggctctctgaactgatattgtttagaagctctgtgcataagtcttctcttcagccaaggctgagaaccacagactaagttctcttaaaatccacacctgtccgggagcggtggctcatgcc

SEQ ID NO: 38033 - DNA, 601 bp, Human
gcgattcttaaccttttttcattactgcctgcccccgccatggagtactgataccaaagatataccgcatacctgtctatgtactagatgtctctctgtgctttatccataaaaagaacaatatgctttttgctccccatctccaccaagaaccaaccttcactctcctggagacaatggcatctccctagggaacgcttgacctcccatgattcattacttgaagtcctttggatctgcccattcagtagaccagggtgagggagatgaagaagcacccacctgaatgactggcccgacrctggtccgacccaggacagccatctgcccggcatagatgcggtttgctccatattcgcctgcatgatccacccggattattcgatccacagctgcccgactgatattgtctaaagtcattcctgaactgcgaaatctgacactggttcttcttccataagctgaaatgcaagtgtttattcttcgttacgatcaggtaaaatccagatgttccttttacagacagcagaaagggcactttgggatggaggtcacaaatcagttccccatgggccaggcgtgcccataaacggactctgtt

SEQ ID NO: 38034 - DNA, 601 bp, Human
tgggagagagccaaaatgtgaaccaggtctgtgtaactacaaatttcaggtcctcccatagcctcttgggatacaatacctctctggcacggtagggggcagggctgcaacatttcagcacagttgactgctgtgctgagcgattcttaaccttttttcattactgcctgcccccgccatggagtactgataccaaagatataccgcatacctgtctatgtactagatgtctctctgtgctttatccataaaaagaacaatatgctttttgctccccatctccaccaagaaccaaccttcrctctcctggagacaatggcatctccctagggaacgcttgacctcccatgattcattacttgaagtcctttggatctgcccattcagtagaccagggtgagggagatgaagaagcacccacctgaatgactggcccgacgctggtccgacccaggacagccatctgcccggcatagatgcggtttgctccatattcgcctgcatgatccacccggattattcgatccacagctgcccgactgatattgtctaaagtcattcctgaactgcgaaatctgacactggttcttcttccataagc

SEQ ID NO: 38035 - DNA, 601 bp, Human
ctcagcctcccaagcagctgggactacaggcatgcaccaccatgcctggctgatttgttttgtatttttagtagagacagggttttgccttgttggccaggctgatctcaaactcctaacctcaggtgatccacccgccacagcttcccaaagtgctgggattacaggtgtgagccattgcacccagctaatttttgtatttttcgtagagacggagtctcatcacattgcccaagctggtctcaaactcctgggctcaagcgatccattggcctcggcctcccaaagtgctgggattacrggcgtgagccaccacacccggccctgaatattatttacatcagaggaaaaagggagaatgctagctgcagctaacacttagatggcacgtcctaagtgccaggggccatcaaatagcttcatgcaagcaattcattcaatccacacaatccctgtgaaggacacactatgactgcgccagtatacacaacaaactgaagcacagagaggctaagtagcttgcccaagggttcagggcaggccatttaacttgtactaacttgacctttatgggccagacccggttccttacccaaaccca

SEQ ID NO: 38036 - DNA, 601 bp, Human
ctctgcctcccaggttcaagtgattctcttgcctcagcctcccaagcagctgggactacaggcatgcaccaccatgcctggctgatttgttttgtatttttagtagagacagggttttgccttgttggccaggctgatctcaaactcctaacctcaggtgatccacccgccacagcttcccaaagtgctgggattacaggtgtgagccattgcacccagctaatttttgtatttttcgtagagacggagtctcatcacattgcccaagctggtctcaaactcctgggctcaagcgatccaytggcctcggcctcccaaagtgctgggattacgggcgtgagccaccacacccggccctgaatattatttacatcagaggaaaaagggagaatgctagctgcagctaacacttagatggcacgtcctaagtgccaggggccatcaaatagcttcatgcaagcaattcattcaatccacacaatccctgtgaaggacacactatgactgcgccagtatacacaacaaactgaagcacagagaggctaagtagcttgcccaagggttcagggcaggccatttaacttgtactaacttgaccttt

SEQ ID NO: 38037 - DNA, 601 bp, Human
tgggattacaggtgtgagccatcacgcccggcctttttttttaaagtactgacattaagattctatcttaaataaatttaaccacacacaaaaaaaggcagtcaatttaacctcggaaaaatatgaagtaaacagaatgaggtcataagaggacacagcaagaattgtgaacatgatacctgaaggatttaatcatcctagatccccaagcttgcataagctcttctagagagacacgtacccagtgcaaaccccagcacgttccacaagggcatcagaactgttggccggaccctgaacrtaaccatcaactcattgaactttttcaaatggtccttttcttgatcccacattttctgcaagaaacataaaaataaagacatgcaagcattccatagaggcctcccactcatccaagcggcatacagggagcaaagcagaaacggagaaaatgatggaactgctgtctcccccattcccctcaaaacgtcaatggaaacagtaaaacatcagactaaaggaatctgtgacaaagagaagagagcaccaagaatacaaaacagtctattatctcaattccagttaagactgccatgagcca

SEQ ID NO: 38038 - DNA, 601 bp, Human
gaggcaggagaatcgctggaacccgggaggcggaggctgcaatgcaggcggagaccactgcactccagccttggggacagagtgagactccatctcaaaaaaaaaaaaaaaaaaaaaaaaaaagtgaacagcaccaggtggtgtggctcacacctgtaatctcagcactttgggaggccgaggcagaagaatcacttgagcccaggagctcaagaccaatctggacaacatagagagagactgtgcctacaaaaaattttaaaaattaaaaataaaataagtgaacaggacagggctcaaragacaagggttctggccggatgtggtggttcatgcctataattctagcactttgggaagctgaggagagaggactactggagctcagaaattcaagaccagcctggaaaacatagtgagaccccatctcttaaaaaaaaaaaaaaaaaaaaaaaattagctgtgagtggtggctatgtatgtagtcccatagctactcgggaggctgaggcaggaggatcacttgaacccaagagtttgaagatgcagtgagctatgactgtgccactgtactccggcctgggcaacggagcaagacctc

SEQ ID NO: 38039 - DNA, 601 bp, Human
caggccatagtttgccaacctcagatttagactctaaaaaactaaacagttcccttatttgctgtggaaaattatctcaggatatctattcatttattcaatctaaagggttcctgctcacagcatctgctcagaatctaccaatgataaagaagtgggccgggcgcggtggctcacgcctgcaatcccagcactttaggaggccaaggcaggaggatcacctgaggtcaggagttccagaccagcctggccaacatggtgaaaccccgtctctactaaaaatacaaaaattagctgggcrtggtggtgcatgtctgtaatcccagctacctgggacgccgaggcaggagaatcgctggaacccgggaggcggaggctgcaatgcaggcggagaccactgcactccagccttggggacagagtgagactccatctcaaaaaaaaaaaaaaaaaaaaaaaaaaagtgaacagcaccaggtggtgtggctcacacctgtaatctcagcactttgggaggccgaggcagaagaatcacttgagcccaggagctcaagaccaatctggacaacatagagagagactgtgcctacaaaaaatttta

SEQ ID NO: 38040 - DNA, 601 bp, Human
caggctgcagtgagttgtgacccggcctggacaaaagagcgaggccctgtctccaaaaaacataaaataaaataaaatatatatatatgcatgtaaaagaaaaacatgtatataaaagaaaattaagtatgagaccaaacaaggcccagcttcgtttgctgtaacttgaacaaggctggtgacctgttggtctcatggcagaaaaaacaacccagagaaaaatcaacactgcagagtttaaaaaaaaaaaaacaaaccttataatttattaacaaaattcacattgtacaaaagtacaacsataactgtacacctgtttctctgcaaatgtcacttggtaaattactatcatcttttatagacaggcaaaactggacacactttataatctttctgataaatatatcgccactctgcatccggcctggataatgctcttcaggacggcataggctggagcctgttaaaaacaataagcaaacaaagaaacatgttatgtgctcattttcggttgtaagattcagggctggcagggcaggctttggatttctctggataagaaatagatctaaggaacaatttattttagtttcaaagaaag

SEQ ID NO: 38041 - DNA, 601 bp, Human
gaaagacatgaaggaagcaaacagaagagaagatattttaagaaaaattacttgtataaggtgacaattcaatgtttttatctaggcaactcaatatctgaatatagtaattcaaaataataaaattttccttcacaggcttcagcaacagttttagcaaaaatccacctacttttaaagaaagtaaaacaaaccagagaagaggcaaagtataattcaatttgcatgtttcccaggagttcaaacacaaacactagcagcgggtctaggcttacgtttgtagaacacactaagatgctgrgaagactgcaggtaaagagttctgccagacaggaggtgtctctgacagccagtttattctctgtatgctgagagtactgaacattctgcacagtagaacggagaaggacattaagcaaaaaataccattacggacccatgtctttaatattttctcctggaagcaagggtggttcttccatttctgctaacttgttagactccctcaggacctggggtgggaaagacaaaaaaagaaacatttttttattcaaaggctactttttcactcatatttcaactgagtatacttgctcttgaa

SEQ ID NO: 38042 - DNA, 601 bp, Human
atttaaaatataatttcttagaaaaataacagtataagaagaggatattgtactgctgaccaaccaatgccagactttgtaaagaaataatcacaagtaatgttttatcaaataaacaatggatctacatggcattatgttttgtaaaatatgcattaactgattatgcaggataacttaggaatcagtatctcaaaatattatttaaaatgccacagttcataatttccaatacatggtttttatatcttaaaatattcataaattcctagtatgtcattattacaccaaatcagcagawaaaggagtatcttcatcattccaaggaagtaagggacaattctgtggagcaacaactttctaagaccctttcaacgggcttctgggaaaacttggggccatgaaatatatttaataaggtattacaacctcctgactttgcttctcattcaacacttcgaaggactggctgctttgtatggaatttgaaatgagactgatcttttcacaatcatttctaaccttcaaaatagttcccttaggaacattttaagtataaactacttttttaaatcgtttcgaatgcatatttcatttagag

SEQ ID NO: 38043 - DNA, 601 bp, Human
attaaaactgagcaattaatactgtccaattatagagctgatcaaaatcttaatcagaaatgctttaattagaaatgatcagaaatgaacaaaactagctacaaacaacacactcatgtacatacaaaaatctaatctgactcttacccgttccatgcttttgaaatataacctataattcgtgacagtcagagttcctcgtacagcgccagtgaatggacatatataagttacatctttggctgaaaaagcaagaagtccacagtttactatacattatgtgctattaaaacctgctatmtcatcttataaaattgttatgattcctagactaatttatgctgaaaaataacagaaccagtaatttccagagacctcagaatcctacaacccaagcttccatccctgcactaatctggggaagaaacacagaattaaatgggataggctgaaaaggtggagggacttctcatcccatgagacagaatggaagtaaacaaaggggctactatcctggctagataaaacaggtgtgggtagctgcagcagagacgggtgaaagaatactggtaatggtggtatcaacaataagcatgtcaag

SEQ ID NO: 38044 - DNA, 601 bp, Human
gtggtatcctatcagtactatgtgcattaaagatggttattattattattattattattattattattattatttcagacagagtcttactctgttgcccaagctggagtgcagtggcactatcttggctcactgcaacatccgcctcccaggttcaagcaattctcctgcctcagcctccccaatagctgagattacaggtgcccgccaccacgcctggttaatttttgtatttttagtagagatgcgttttcatcatgttggccagactgatctcgaactcttgacctgatgtgatccrcctgcctcagtctctgaaagtgttgggattataggcgtgagccaccatgtccggccaagatgatcattattaaaaaataagttatgaatttgtgaatatatcaaaatatgtagactgaactgggcccaaaagaattaagtctaattcatgaatcaccttttctattactgctaaattttgttttcttctatcaatgtcatactaaaataacatttctaattggaaatccattttatattttagaaaccaatttcaaaacagaggttctatttaatacaaagcttttcaaaccaaagaaaa

SEQ ID NO: 38045 - DNA, 601 bp, Human
cccgggaggcagaggctgcagtaagccaagatcacgccactgcactccagcctaagcaacagagccagactcttgtctcaaaaaaaaagaaaactacaaaaataattactaagtcattagctttaataccagagtcacaaaacttctaagattagcataacaaagtatcttgaattatacacatgctgtttcttttggcactggcagaataaaaagaaaggaacaatgtgatgtagaatctcaatgtgcatgggtgttagttaattaggccttaataacagtgacctggagaagtggtacrtagaattaaatacctatgacttaatggtaaaaatgtaacaatctatgtttcattcaagtatcaacgcatttaaagaatgccagtaaataagaacataagaaaagtctacaatatcaacttttccacactattgttttagaagtagaaaaactggccgggcacggtggctcacgcctgtaatcccagcactttgagaggccgagatgggcagatcacgaggtcaggagattgggaccatcctggctaacatgggtgaaaccccatctctactaaaaatacaaaaaaaaattagctgggcgt

SEQ ID NO: 38046 - DNA, 601 bp, Human
aatacaaaaattagccaggcatggtggcatatgcctgtaatcccagctactgaggaggctgaggtaggagaatcacttgaacccgggaggcagaggctgcagtaagccaagatcacgccactgcactccagcctaagcaacagagccagactcttgtctcaaaaaaaaagaaaactacaaaaataattactaagtcattagctttaataccagagtcacaaaacttctaagattagcataacaaagtatcttgaattatacacatgctgtttcttttggcactggcagaataaaaagaaargaacaatgtgatgtagaatctcaatgtgcatgggtgttagttaattaggccttaataacagtgacctggagaagtggtacgtagaattaaatacctatgacttaatggtaaaaatgtaacaatctatgtttcattcaagtatcaacgcatttaaagaatgccagtaaataagaacataagaaaagtctacaatatcaacttttccacactattgttttagaagtagaaaaactggccgggcacggtggctcacgcctgtaatcccagcactttgagaggccgagatgggcagatcacgag

SEQ ID NO: 38047 - DNA, 601 bp, Human
ttctaactacaaatacagtgtcctctccattagaccttttagttgactcagagacagtttctcatgctgccaaaaaaaaaaaagccaacaaattcatctagtaagtcaaagaccataaagcatccataccattttatgtagaagctaatgctctattcttactgccacaattcctaatctcttaattctctttctgtatgggtatagttgttcatttacacttcaacttattttttttcagtaataatttacctcttttctttagacacctgctttccaaagttctacactgaatgctccygggacagcaatttcttcccagattctcaaagagtagtcctcatttttataatttctaaagacacctgctagactttttggttgcttagtcatcttcttctgacactggatttttgagttagcatgaatctcctgtttcttgtatactcttggcttttagttgattcccacttattttgtattctatttcatattttgccaaataactttataactgaatgaggaaatttcaacttcactttccacatgtaagtgtggtaacaaaccccacttcaagtcatttagatatctttagctctct

SEQ ID NO: 38048 - DNA, 601 bp, Human
atgaaacctttgaaaaaaatactcaggaaaccaataatatcatttcctaaagggaggggaactggaatggctagggggacacagggttgtcctgcaaggaaaacctacctttcagtataccctgctggaccttttgaattttgtacagaatgcaagtattaccacttccttttttttttttatttaaagggggggaagtgaataatctgatgctttatcattagtccttaattttaagagatcatcttcattttcttctgtaataaacttaaaatatatccaagaaaaaaatcttaaaacyacagcttctaactacaaatacagtgtcctctccattagaccttttagttgactcagagacagtttctcatgctgccaaaaaaaaaaaagccaacaaattcatctagtaagtcaaagaccataaagcatccataccattttatgtagaagctaatgctctattcttactgccacaattcctaatctcttaattctctttctgtatgggtatagttgttcatttacacttcaacttattttttttcagtaataatttacctcttttctttagacacctgctttccaaagttctacactgaat

SEQ ID NO: 38049 - DNA, 601 bp, Human
attgcccaagcttgagtgcagtggcacattcacagctcaccacagccttgatctcccaggctcaggtggtcttcccacctcagcctcccaagtagctgggactacaggtgcatgccacacctggctaatttttatttttttgtatagatggtgtttcactatgttgcccacgctggtctcaaactcctgggctcaagcgacctgcctgcctcggcctcccaaagtgctgggattacaggtgtgagccactgcgcccagcctttgcccatttttgaagagatatagtctaatttcttttaasactattaagtgtagatctgttgaatgaatgtagctttcatttttttagtggcagcacatgataaagccagtcatgatatctgtttttcagagcctcacaatgtaataaatataataatcatcatttggatagatttttacagtttacaaagtgcctttctatatgtcactaatccttcaaacatcccataacgtggtatctatcaccaagtaaaaaatgaaggcactgtgccataaatgattcattcaagagcctacatctgagtgtgagagtaagaactagagctaaaattcaaaacta

SEQ ID NO: 38050 - DNA, 601 bp, Human
actacatactgtatatgtccttcaagagtaaattaaagaaacattctcctatatgacaaacctaaatggttattaataactttgtccatttttatttatttacttattttttgagacatggcatctcactattgcccaagcttgagtgcagtggcacattcacagctcaccacagccttgatctcccaggctcaggtggtcttcccacctcagcctcccaagtagctgggactacaggtgcatgccacacctggctaatttttatttttttgtatagatggtgtttcactatgttgcccaygctggtctcaaactcctgggctcaagcgacctgcctgcctcggcctcccaaagtgctgggattacaggtgtgagccactgcgcccagcctttgcccatttttgaagagatatagtctaatttcttttaacactattaagtgtagatctgttgaatgaatgtagctttcatttttttagtggcagcacatgataaagccagtcatgatatctgtttttcagagcctcacaatgtaataaatataataatcatcatttggatagatttttacagtttacaaagtgcctttctatatgtcact

SEQ ID NO: 38051 - DNA, 601 bp, Human
atgtgtcaccacacctggctaatttttgtatttttggtagagacagggtttcaccatgttgcccaggcttgtcttgaactcctgggctcgagcaatcctcccaccttggcctcccaaagtgctgggattacaggtgtgagccactgtgcccagatgacttgatttttcttggccttatccacaaactccatagtcctgtctataatcactacatactgtatatgtccttcaagagtaaattaaagaaacattctcctatatgacaaacctaaatggttattaataactttgtccatttttatttatttacttattttttgagacatggcatctcactattgcccaagcttgagtgcagtggcacattcacagctcaccacagccttgatctcccaggctcaggtggtcttcccacctcagcctcccaagtagctgggactacaggtgcatgccacacctggctaatttttatttttttgtatagatggtgtttcactatgttgcccacgctggtctcaaactcctgggctcaagcgacctgcctgcctcggcctcccaaagtgctgggattacaggtgtgagccactgcgcccagcctttg

SEQ ID NO: 38052 - DNA, 601 bp, Human
aagccctctacaatcctgctttctccagatctctcccttgccactgtatgctctggtctagtctatatcaaacgtctttcagctcccagatggcctcatgttctctccctacagtacttgctctatcagactattcattacattatattgtaattgttaatctatttgtttgaatgctccactgaacacaaactctttgggaacctggactttatcattttgtttcatattttagccactagtatttagaaggtattatatgaatttgataaatgcatgaatgaataaatcagtgaaccayaggaagtttccatatgaagcaaaattagtttctgaagttttcttagaaaacatggagtcagagctaaaggtcagatcacttgagaagtatacatcagagggcctaatgtaccatcccccaacccagaaaggtactcctgtctctctcccaccccacttcccatatccttgtaaaaacactaccaggagaaccactgttctcatggggaatgtcacattattcacgtaagtagcagggtggggtaggaatgagaaccaatgacttagattaccttcatggctattgtcctcctcattctta

SEQ ID NO: 38053 - DNA, 601 bp, Human
caacctctgcctcccgggttcaagcaattctcctgcctcagcctcccaagtagctgggattacaggcatgcgccaccatgcccggctaattttgtatttttagtagagacaaggtttcaccatgttggtcaggctggttgcgaactcctgacctcaggtgatccgcctgcctcagcctcccaaagtgcagggtctcattcagtttgactggatgattgactttgttgccattcatctatacaaataaatatcagaagtcaggcaccaagtgtccaccagagtgctacatgcacagctatcrcttacatacgtaaagtacatttttcactgaggtattataatactaatggatgttgctaatctaaaatatattagaaaagtaagggaggaatgcaaggcaaaatgacaacaggcaacaggcaagaaaaatgcttgaaacaatttttaaaaaacatatcaactattgagctctcgtgctccttcaatatctgctattttataaatagtgtactacttcacatataggattaataaaacaactgaaattttccatccttcactgtatacaaaattaagctattatattaaatggttggactta

SEQ ID NO: 38054 - DNA, 601 bp, Human
cgatctcagcgcactgcaacctccgcctcctgggttcaagtgaatctcctgcctcaacctcctgagtagctgggactacagccgtacgccaccatgctgggctaatttttgtattttttagtagagacggggttggccaggatggtttcaatctcctgaccacctaccttggcctcccaaagtgctgtgattataggcatgagccaccacacctggccaaatgttcctattctttatttatttatttatttttttggagacagagtttcactcttgttgcccaggctggagtgcaatggcrcgatcttggctactgcaacctctgcctcccgggttcaagcaattctcctgcctcagcctcccaagtagctgggattacaggcatgcgccaccatgcccggctaattttgtatttttagtagagacaaggtttcaccatgttggtcaggctggttgcgaactcctgacctcaggtgatccgcctgcctcagcctcccaaagtgcagggtctcattcagtttgactggatgattgactttgttgccattcatctatacaaataaatatcagaagtcaggcaccaagtgtccaccagagtgct

SEQ ID NO: 38055 - DNA, 601 bp, Human
actctgtcgcccaggctggagtgcaatggtgcgatctcagcgcactgcaacctccgcctcctgggttcaagtgaatctcctgcctcaacctcctgagtagctgggactacagccgtacgccaccatgctgggctaatttttgtattttttagtagagacggggttggccaggatggtttcaatctcctgaccacctaccttggcctcccaaagtgctgtgattataggcatgagccaccacacctggccaaatgttcctattctttatttatttatttatttttttggagacagagtttcrctcttgttgcccaggctggagtgcaatggcgcgatcttggctactgcaacctctgcctcccgggttcaagcaattctcctgcctcagcctcccaagtagctgggattacaggcatgcgccaccatgcccggctaattttgtatttttagtagagacaaggtttcaccatgttggtcaggctggttgcgaactcctgacctcaggtgatccgcctgcctcagcctcccaaagtgcagggtctcattcagtttgactggatgattgactttgttgccattcatctatacaaataaatatcag

SEQ ID NO: 38056 - DNA, 601 bp, Human
aaggacatctgaggctgctaagaaaaatcatcacctttccttcaagccaattctgggatgtggaaaacttggtctaattctttagtcagatactgatttaggaaagtatttgattattgggaaatgttatctcctgaaaaaaatactgtgaaacagggctaagtaaaccccacttaatatattagtaaaactgctcagttctaaaagcctttagaatctatgaattttgtacctaaaattatttaagctcatctttctaagatccagttataaatctgtaaggtgttctttctaggacttaaaaaaaaaaaagaacatttatcatcatgactaaagaatatacaataagataaataaatagtgactaatacacacagcaaactttttcagtgaagaatcatgcaattctgtgcagttatctaatacccatatcacactctctggaagcctctttaagtctttcttccagttttaactttactaaataaatcaatctccaatatccccatgaaagacctgctgctgtagctatttatatcctgaatccattctcctactcattaatctcagcattatgttgagtaaaaaagcacttgcaaag

SEQ ID NO: 38057 - DNA, 601 bp, Human
gccctggattcaggtagtggcatggttgtacaactttgtgaatatactaaaagcactgaaatgtacacttgaaaagatgagcgcttttcagtaatggtacctgctgctgtagttatgtcttctctctccttccctcctcctatagatttggtcaactgaaccaaaatttcaatttccacaatgctaatatttattctgctggaacaatcagctacagctaactgccaattcttcagtctgaataacttgttcaggtggaggacggtcagaagagggcaccactagtcaccgagaacactasttcgctattcctagagcagtactatacagggacttcagtgagtcataagctcagttagttgtcaactttggagaagtgggaagctaagaataactgaacacctagttattatgtaagtaagcaaaagtttatgcattattttttattaaatgatttttgctcccaaaacaacactgttaactattattattctcatttttaccaataaacaaattgaggtctaaagaggttaaataactaactcaaaatcacaccatcaagttgaagagccaagacaagaacctatatgtttaccactgt

SEQ ID NO: 38058 - DNA, 601 bp, Human
cactcgctttcttgtgttcttctttacaaaatgaatatatacgtagtctgacttgcccatatggccattattaaaattaaatatgaaacacataggaaggtatttaaacactgtaaagcactaaattttcccagcccatacgccaagtcctacccaaacataagttcttacagatgacttcctttcatatatactgaaattaccagactgtaagtttcatgtgctgagaccacatgtctggttcacctatgcttcttcacctccctgcctcttcacctcattttaatcttcatatctgagraataaactctttgcaatcaaaatgacctgcttcttttttaaccacataattctctttaaataaaaagacagaacaaggataaaagcacagaatgctatcatcatcaatgttctcaaagacttaaatctacatctacaaaatagaatgagaaaatatttggtgttcaaaataagctatggctagaaagaagaaccttatttttctggacttaatctttttatatttcatgaataaaatattctatctcctacctaactcgtgtaaaattatacttcttagagccctaatagaaacaaatta

SEQ ID NO: 38059 - DNA, 601 bp, Human
tctgaaggatggttcgaattcagataggatgggagggggaacaaaagaaatacaacataaccaaatgcacaatataaaaaaccaattcattcaaacattaaaattcactagtagttccaagtatcaaagcatttacccatttttcattgtttagaaaggtaccttcatgttgattgcaattataagtaaaaagctaatataaacaaaggggtagagagagtctttgtttgggatatagtaacacacacccaccttaatatgttctagccaatgagtagattccaagttagacaaccagtgrgtttcctcaatgttggggtacacaatctccttaagttttcgtaatgattctctcataacatgaatattgtggatatccaggaaaactagttcagcattttgataggcatcttcactttcataacctccaccctttgcctggaaaaaagcacacatcatggaaaatcataaatgaatgcacatctgtaaacaagtgacataaaatatccaatagcataaaagatgatacatattactggagacaaggaaaactccacaggaaaatgtggatggctcaggacaacttatttagcacaaccac

SEQ ID NO: 38060 - DNA, 601 bp, Human
ctggtagaactcttattttgtaaagaggctgggaaaggtctctctcagaaaggtgatatttgagcagagaccagaagagagtgattgagtaaataaactttctttgtgtgataaggattgggggagaataaagtagtttagcccaactatatgtcttataactctagggaaatttgattctgttatagccagccttttagagaccatgttgaaactgcaaattaaatatctggagttttcagaatcaaacacagcgatttatgttagttccaaatcaagcctaaggctgtatatttacacrtcacataatttaatgaatgggccacatgaacatgctctctgagtagtgtttatactttgtgattttcaagcttctaagcttctcaaagggaaacaatagtaaaaatggtctatttaaaattcttattcagtttggttttctcttcaattctgtctgaacttcagagattttaatgtgagcagaagtatcctccttcttaacgtgaaagactgcatttcccattacctcttaatatttatatatgtggttacataagtctacattttggtgagttatgttactgacagaccatatctgaaa

SEQ ID NO: 38061 - DNA, 601 bp, Human
atataaattttgcttttaaaactagaaaaacctcataattgctgactcctattaatttgcccaacgaaatagccaaatcaaaagtacctttgggtgctacataaatcatggtgtaagattcttcttagaaaagttctaaagagatctgtttctaagaatcaaatattccatcatctatttaaataaaaataattgatatagcaattgaagccttgttatgatttaaaacaatgcttaaaccaaattgggataagtacctgaaagcaataatactggatctctttaaaatactctatagcakttattgtattgttttgactaaagatttttatgtcacagagcatacagcaagcacagtataaactttagagtgagctacttttctgtaacactatgcatgaaaattcacagaatatgtcaatctgttacttaaaataacttcagctcttatttttttaaatatgcagaaatcctttgcaaaataacttaccttttctgaagtcaatcttgagttaaaactaaacataattagatataaccaaaaaagaaacacaaaagtatggtatcttaaaaaaaaaaaaaaaaaaaaaggacaatacag

SEQ ID NO: 38062 - DNA, 601 bp, Human
aacatttgtcccttcctaagaagaatttttttaaatggtagaagatatataaattttgcttttaaaactagaaaaacctcataattgctgactcctattaatttgcccaacgaaatagccaaatcaaaagtacctttgggtgctacataaatcatggtgtaagattcttcttagaaaagttctaaagagatctgtttctaagaatcaaatattccatcatctatttaaataaaaataattgatatagcaattgaagccttgttatgatttaaaacaatgcttaaaccaaattgggataagyacctgaaagcaataatactggatctctttaaaatactctatagcatttattgtattgttttgactaaagatttttatgtcacagagcatacagcaagcacagtataaactttagagtgagctacttttctgtaacactatgcatgaaaattcacagaatatgtcaatctgttacttaaaataacttcagctcttatttttttaaatatgcagaaatcctttgcaaaataacttaccttttctgaagtcaatcttgagttaaaactaaacataattagatataaccaaaaaagaaacacaa

SEQ ID NO: 38063 - DNA, 601 bp, Human
acagcttatcagggatcattatttcaataacatgaggaaaaacatttgtcccttcctaagaagaatttttttaaatggtagaagatatataaattttgcttttaaaactagaaaaacctcataattgctgactcctattaatttgcccaacgaaatagccaaatcaaaagtacctttgggtgctacataaatcatggtgtaagattcttcttagaaaagttctaaagagatctgtttctaagaatcaaatattccatcatctatttaaataaaaataattgatatagcaattgaagccttkttatgatttaaaacaatgcttaaaccaaattgggataagtacctgaaagcaataatactggatctctttaaaatactctatagcatttattgtattgttttgactaaagatttttatgtcacagagcatacagcaagcacagtataaactttagagtgagctacttttctgtaacactatgcatgaaaattcacagaatatgtcaatctgttacttaaaataacttcagctcttatttttttaaatatgcagaaatcctttgcaaaataacttaccttttctgaagtcaatcttgagtta

SEQ ID NO: 38064 - DNA, 601 bp, Human
ggtcccagcagggccagcttcagaacttgaatatgtgtggattttggcctgttcatgggatctgggaaccaagcccccacatataccaagggacaactgtataaacactgctagtatactctggtaactactggatactaaaggtaaacattacagacagcatctgggtaaagacccttctaaaagtttttcaattatttaggaaaacgcctgcccagaaacacccgtggacatcactgaatgatatccgatgtttcccagtggagatcacagaaaagactgggtcagacacttgacaaayagctagctctgactccagactagtcatgttagggatatcttaatgctttccaaaacaagcaaaaacgtttaccccactagataaatgatcaatttcagatgaatatcttattttaaaaaacacatttttttcacatgccttggcatgaatgcatgtgatatatccaaagtcaaggttccttacttactagttgaaatcgatgtccaaaacttagccattctttctccacaaggacttcaaatcctcggatggttcgatagtatccatccaacatgagcatggcaagggaagtgagctgag

SEQ ID NO: 38065 - DNA, 601 bp, Human
atcaacaataccacagtttcaaagagctttcctactcctttgatggcgaattttatttctaccaagagtcaaaggctatttaaaactgaatatggtaacagtcaaaagtggggtcctaatgttttgggtcaaacatccaaaaaaggattgtagggacttaggtagttgatatactgcctcaaagccaattccaaaggaaaaagtcaaacctaatccaagaaagtattaaacactgcacctctccttcctcttacctcccaacacaccaaaggtctgatttataaaccaaaactgaattgtrtacaccttttcagtatatatgctaaaatactagtctcatcatatcatagtcatagctacaaaaatgcttcatttaacccaacagtttctaaataattcacccaagtagaaatgcttatggaggcaagggactgttaaatatataattgatgattatttcaccccattaccattaattttcttgtattgaaataaacagtattttattgaagctaaaaatatgctcctaaataaatatgatccaaagccaggcagagccagcacttgccctactttaaattcatatggcaatctaaataaa

SEQ ID NO: 38066 - DNA, 601 bp, Human
gttggctatagattatcgtgtactcttctttgcaagaaattggtaaatgtgctttttttctagcaaacatatcagaactgatacattcaaacacatcgtttccttcaaggtattcaccttggaaagcagtacacacaaccatcaacaataccacagtttcaaagagctttcctactcctttgatggcgaattttatttctaccaagagtcaaaggctatttaaaactgaatatggtaacagtcaaaagtggggtcctaatgttttgggtcaaacatccaaaaaaggattgtagggacttakgtagttgatatactgcctcaaagccaattccaaaggaaaaagtcaaacctaatccaagaaagtattaaacactgcacctctccttcctcttacctcccaacacaccaaaggtctgatttataaaccaaaactgaattgtatacaccttttcagtatatatgctaaaatactagtctcatcatatcatagtcatagctacaaaaatgcttcatttaacccaacagtttctaaataattcacccaagtagaaatgcttatggaggcaagggactgttaaatatataattgatgattatttca

SEQ ID NO: 38067 - DNA, 601 bp, Human
cttctcccatccaagtgctaacaaggcccgaccctgcttagcttccaaaatcagatgagatgggtgcattcagggtggttggctatagattatcgtgtactcttctttgcaagaaattggtaaatgtgctttttttctagcaaacatatcagaactgatacattcaaacacatcgtttccttcaaggtattcaccttggaaagcagtacacacaaccatcaacaataccacagtttcaaagagctttcctactcctttgatggcgaattttatttctaccaagagtcaaaggctatttaaractgaatatggtaacagtcaaaagtggggtcctaatgttttgggtcaaacatccaaaaaaggattgtagggacttaggtagttgatatactgcctcaaagccaattccaaaggaaaaagtcaaacctaatccaagaaagtattaaacactgcacctctccttcctcttacctcccaacacaccaaaggtctgatttataaaccaaaactgaattgtatacaccttttcagtatatatgctaaaatactagtctcatcatatcatagtcatagctacaaaaatgcttcatttaacccaaca

SEQ ID NO: 38068 - DNA, 601 bp, Human
gatgtattcttctcccatccaagtgctaacaaggcccgaccctgcttagcttccaaaatcagatgagatgggtgcattcagggtggttggctatagattatcgtgtactcttctttgcaagaaattggtaaatgtgctttttttctagcaaacatatcagaactgatacattcaaacacatcgtttccttcaaggtattcaccttggaaagcagtacacacaaccatcaacaataccacagtttcaaagagctttcctactcctttgatggcgaattttatttctaccaagagtcaaaggytatttaaaactgaatatggtaacagtcaaaagtggggtcctaatgttttgggtcaaacatccaaaaaaggattgtagggacttaggtagttgatatactgcctcaaagccaattccaaaggaaaaagtcaaacctaatccaagaaagtattaaacactgcacctctccttcctcttacctcccaacacaccaaaggtctgatttataaaccaaaactgaattgtatacaccttttcagtatatatgctaaaatactagtctcatcatatcatagtcatagctacaaaaatgcttcattta

SEQ ID NO: 38069 - DNA, 601 bp, Human
catgttatcacttttctgatcatgatgtttctgtatctgctatatctgctaaccctaaatttgcaggctgaattttgacttaggcaattctggcaactctaggcattctctgcccaaaatgaccacaaacaacattaagattctttaaattttcaagaacatagttgtttttcttttttaaggattacacacaaaatgccaataatgtctccagaaaatgtcagcaatacacaaaagtaaacatctaaggcagataatttacaagtcaaccaacctattaaatatttagatggtgcaaaartaattgcggcttttgccattgaaatggcaattacttttgcaccgacgtaaacttttcagggaacatccatcccatcaaaccagagtcccttgtaagccactattttggcagcatctaacaaaaagaaaattcactctctaacccaagccaggggcttgactggatgtcttagttttacacaacacaattttaggggactaatcaaatgaaaaattacgaacccctgaaagttagaaggtttcgtttaatccatcctatctaatatttcagaattatttggaagcttctatgtaagattct

SEQ ID NO: 38070 - DNA, 601 bp, Human
gaggtagtatttaaaatgaagttaaacattcaaatctacattattccaagccattatggcattattcgtatggttttcttttcaaaaatcatgttatcacttttctgatcatgatgtttctgtatctgctatatctgctaaccctaaatttgcaggctgaattttgacttaggcaattctggcaactctaggcattctctgcccaaaatgaccacaaacaacattaagattctttaaattttcaagaacatagttgtttttcttttttaaggattacacacaaaatgccaataatgtctcmagaaaatgtcagcaatacacaaaagtaaacatctaaggcagataatttacaagtcaaccaacctattaaatatttagatggtgcaaaagtaattgcggcttttgccattgaaatggcaattacttttgcaccgacgtaaacttttcagggaacatccatcccatcaaaccagagtcccttgtaagccactattttggcagcatctaacaaaaagaaaattcactctctaacccaagccaggggcttgactggatgtcttagttttacacaacacaattttaggggactaatcaaatgaaa

SEQ ID NO: 38071 - DNA, 601 bp, Human
tagttaatattccataaacatattcacagtagaccagaattttgttcagcttttaactttcctaaagctactttcttcagcttattaaaacaagaccccctagaggttatccagacagaggagggaagatgcaagaaaagagagcagtgatttgtccaatgtcatacaagcagtcctaagaaccaggtatactgattaccctgccccagtgtagtatttttctactatacaattgttaactatcaatgggtaaggagtaaagttttaaatatgcacagataatctttccagctgcttttamggagacaaagttgcactgcatgaatgaaaactcccattgtatattgtaaggcacatacctgtggtttcatccgtggattccaccttatgtaatatcccacccagagctctaggtggcgcatgctggctactggataaaggacatgattggaatagctcccatagagaggattagtgaagtcttccagctggctgtttatgtaagaccacagtgacacagtccttttaggaagattctgtaggcaggaaaaataggtaaagattctccaccacataagccatttacactttagatgaaatt

SEQ ID NO: 38072 - DNA, 601 bp, Human
agacaattaaaagacagtagtcagaagattccctgttatttataggtttttagtcttaaacagttctaagtagttaatattccataaacatattcacagtagaccagaattttgttcagcttttaactttcctaaagctactttcttcagcttattaaaacaagaccccctagaggttatccagacagaggagggaagatgcaagaaaagagagcagtgatttgtccaatgtcatacaagcagtcctaagaaccaggtatactgattaccctgccccagtgtagtatttttctactatacrattgttaactatcaatgggtaaggagtaaagttttaaatatgcacagataatctttccagctgcttttaaggagacaaagttgcactgcatgaatgaaaactcccattgtatattgtaaggcacatacctgtggtttcatccgtggattccaccttatgtaatatcccacccagagctctaggtggcgcatgctggctactggataaaggacatgattggaatagctcccatagagaggattagtgaagtcttccagctggctgtttatgtaagaccacagtgacacagtccttttagga

SEQ ID NO: 38073 - DNA, 601 bp, Human
ttttaaatacttcttaaaaacttgctaattagcttctgtgtgttcagacacacaagacaagtgaaatacactgtagtaaataattagtttttaaaatatctttcatgatgtttctggtaattgggctaatctgaagggcatggaattctttgaactcctgtatggctactttctccccttcattttcccccaagcacatctataaggcctcccattttggatcaacttgctaatatgtcttaagtatgtaaataatgacggcaataattttcaactactaccacaccgtagtatcttcaayactttgccttttactatatgaagaatatggaagttgaaaagtgatcaaggtaaatcagttactgaaaaaaagaaaaacctagaatggagaaagggatatcaaatgattttgatctgtcatgacatcaaggcccaatatatgtgatgccacagaatttcagtgttggtttgaaaactgatgttcctctgcacagtgagcacagagtgtatttctaaaatggttttaatattaccagatgccaaaaatttgtaacagcatttgccttttaatagaaacttgttcccactgtgaatccaggat

SEQ ID NO: 38074 - DNA, 601 bp, Human
atcagataacttcccaaaggaagagatgatgcctaaactctagaaaataggaattagtcacaagggagaacagttgttccaggtgcacaagacagactgaaccaaagtggggaggcaggaatctgcagattacatgaggcaattgtgaacagcagagtagcattggtacgtaaaagttgaggtatgcagagactaggtcgaaggaggctaaggagcttcaacttaatcatactggtctctaaattttgtaaccctaatcaaaaagggaaaaaattacacctgcacaaccaatagacatacraagttatgaaacatgtaactgtcaattcaaatatttaaaagttttgcttgtgtaaatatataaaaagggctagtattcctcctccctccctcccacacacaccagtggtatatattaaatgcccaagtgcatgtactccatattggagacttctgcagaaggtgaggggaaccactggaaggttctcagcagagaagtggtagggttgcacttagatttccctggcttttgatttgaatttgaagtggatgcaagtatgttaagactagaagctttaaattcttgatctcttcagccatt

SEQ ID NO: 38075 - DNA, 601 bp, Human
cactgcactccagcctgggcgacagagcgagactctattttaaaaaataaaaaaagaaagccatcccacatcccacactcaggatgttctgggatctggattcatcagagctgggccaggaacacacgtgattcttaggagcaggaaggccaggggagacaatatcagctcaggctgacaccaaagtttaacagtttcatggagttatctgatttgggctcttgaagggctgaggagacataaaagggctttgaataattttttaaagggctatataaatataaggctatctaattataaytattacagtaagtaattattctttccctttatgcaatacaggatgacttctgcgcctgtatgtacattaatggaattctcctgtaagtgaatcaaggaggtatacttttaaagaaactgtattaaatttcatttctaggccaggcacggtggctcatgcctgtaatcccagcactttgggaggctggggcaggtagatcacctgaggtcaggagtttgagaccagcctgtccaacagggtgaaacctgtcaaaaaatacaaaaatggccaggcacggtggctcacgcgtgtaatcccagc

SEQ ID NO: 38076 - DNA, 601 bp, Human
tgaggcaaaagagtcgcttgaacctggtaggcagaggttgcagtgagccgagatcgtgccactgcactccagcctgggcgacagagcgagactctattttaaaaaataaaaaaagaaagccatcccacatcccacactcaggatgttctgggatctggattcatcagagctgggccaggaacacacgtgattcttaggagcaggaaggccaggggagacaatatcagctcaggctgacaccaaagtttaacagtttcatggagttatctgatttgggctcttgaagggctgaggagacatraaagggctttgaataattttttaaagggctatataaatataaggctatctaattataactattacagtaagtaattattctttccctttatgcaatacaggatgacttctgcgcctgtatgtacattaatggaattctcctgtaagtgaatcaaggaggtatacttttaaagaaactgtattaaatttcatttctaggccaggcacggtggctcatgcctgtaatcccagcactttgggaggctggggcaggtagatcacctgaggtcaggagtttgagaccagcctgtccaacagggtg

SEQ ID NO: 38077 - DNA, 601 bp, Human
ctcaagttggaaatgttttggaagatggtcacatagcagccaatacgactattaggaagcaaaaccacaaacacatacgagtaaggcatgggaaaggagttctttgtttgaaatacaaagtaggacttaagccaaaaccagccaccaaggctcctaaatgaaagccatcccgctgggcacagtggctcacgcctgtaatcccagcactttgggaggccaaggtgggcgtatcatgaagtcaggagatcgagaccatcctggctaacatggtaaaacccgtctctactaaaaaaaaaaaaaattagccgggcgtggtggcatgagcctgtagtcccagctactcaggaggctgaggcaaaagagtcgcttgaacctggtaggcagaggttgcagtgagccgagatcgtgccactgcactccagcctgggcgacagagcgagactctattttaaaaaataaaaaaagaaagccatcccacatcccacactcaggatgttctgggatctggattcatcagagctgggccaggaacacacgtgattcttaggagcaggaaggccaggggagacaatatcagctcaggctgacaccaaagtttaac

SEQ ID NO: 38078 - DNA, 601 bp, Human
caccctcaaactcctgcactcaagtgatcctcctgcttcagcctcctgagtagctaggagtacagttacgcaccaccttgcccggctaattttttttttcttttaatctttttttgtagagatgagatttcactatgttgcccagactggtttcaaactcctgatctcaagtaattctcctgcctcagcctcccaaagtactgggattataggcatgagccaccattgtctggccttgaaatattcagtaaaaagtggccgggcgcggtggctcacgcctgtaatcccagcactttgtgasgccgaggcgggcggatcacgaggtcaggagattgagaccatcctggataacacggtgaaacgccatctctactaaaaatacaaaaaaaaaaaaaaaaaaaaatgagccgggcgtgatggcgggcgcctgtagtcccagctactcaggaggctgaggcaggagaatggcatgaacccgggaggcggagcttgcagtgagcctagatcgcgccactgcgctccagcctgggcgacagagtgagactccgtctcaaaaaaaaaaaaaaaatatatatatatatatatatatatatatatatat

SEQ ID NO: 38079 - DNA, 601 bp, Human
gcaggagaattgcttgaacccgggaagcagaggttgcagtaagccaagattgtgccattgcactccagcctgggtgacagagcaagaccctgtctcaaaaaaaaaaaaaacaaaaaaaaccccccaaaaacatgcaaaacaatattttatgtgtgcatgtatgtgtgaaacaatacagtgtgtgcatgttacatttagtattacatttagttatttccatgcgtattattttatgtgtgaaacatacatgcacacataaaacaacacacatagaaatgataaatactaaatgtaacatagyggttacctttagtggggtcagaaagaaaaagtgagtggggaaggaacattgggaacttcagctatatttacaacagccaagttcttaaatttgatggtaggtacatggctatttgttgtattattctttatacgttcggttatgtctaaaatatttaatttttattaatttttttagagacagggtcttgctctgtcatccaggctggagtgcagtggcatgatcatagctcactgcaccctcaaactcctgcactcaagtgatcctcctgcttcagcctcctgagtagctaggagtaca

SEQ ID NO: 38080 - DNA, 601 bp, Human
tgctgctggttgtgagttcaatattaataaattaataatatatattaaataaggtatctttaaacagaaactcacataaaacaaggttatatgttgggtggttgatgaaaatgttgtgaccaggggctcacagaaacctgtgttttgatgttcagtgagtatggcaactttataaaacaaaactaccatgaacaacaagaatcaactataacatctatcaagtagctgctatgtgctggatgccatgcttatccttgagcatccaagattagaatctagaatatatcagccaaaaaaaaamcaccttatttttatttatttttttattttttttgagatggagtctcgctctgtcgcccaggcgggagtgcagtggcgcgatctcggctcactgcaagctctgactcccgggttcatgccattctcctgcctcagcctcccgagtagctgggactacaggcgcccgccaccatgcccagctaatttttttttgtatttttagtagagatggggtttcactgtgttagccaggatggtctcgatctcttgaccccgtgatccacctgcctcggcctcccaaagtgctgggattacaggcgtg

SEQ ID NO: 38081 - DNA, 601 bp, Human
caagctgtagtgctaagtgcaaaaagactgtgatgtgccttccagagaaaatacatgtattattaggtaagcttcattcaggcatgagttacaatgctgctggttgtgagttcaatattaataaattaataatatatattaaataaggtatctttaaacagaaactcacataaaacaaggttatatgttgggtggttgatgaaaatgttgtgaccaggggctcacagaaacctgtgttttgatgttcagtgagtatggcaactttataaaacaaaactaccatgaacaacaagaatcaacyataacatctatcaagtagctgctatgtgctggatgccatgcttatccttgagcatccaagattagaatctagaatatatcagccaaaaaaaaaccaccttatttttatttatttttttattttttttgagatggagtctcgctctgtcgcccaggcgggagtgcagtggcgcgatctcggctcactgcaagctctgactcccgggttcatgccattctcctgcctcagcctcccgagtagctgggactacaggcgcccgccaccatgcccagctaatttttttttgtatttttagtagag

SEQ ID NO: 38082 - DNA, 601 bp, Human
aaaaagtcaattaccctaaaagtagattactaaattaatagctatgaagacatgaaacaatccccaaaaccaaaaaaggtgtccaagagtattctgactatagtaaagatacctacatggaggttataaaaggatataaagaccctaccagagccgggtgcagtggctcacatctgtaatctcagcactttgggaggccaagacaggaggatcacttgaggccaggaattcaagaccagtctgggcaacataaggagaccctatctctgttggcagaggatcacttgagcttgagaggtcragactgcaatgagctgtgatcgcaccactacactccagcctggacgcctgagtgagaccctagcttaaataaataaattaattaaattaaatacccaaccagaactactcttacctgagatgtcattaaggtgggggaagtacaaagttcttcagggttctgattgtggatgttttcattttctttggcctcaggagttcttactggcttctctggtggttctggattaggagagacctctagggaggtcctaggacttgcagtcccagtccccaaggaggccctagggctggtgggtga

SEQ ID NO: 38083 - DNA, 601 bp, Human
ctaatttttgtatttttagtagaaatggggtttcaccatgttgaccaggctggtctcaaactctcgaactcctgacctcaggtgatccgcccacctcggcctcccaaactgctgggattacaggcgtgagccactgcacccggcctaggaaaagttttttttttttttctttttgagacggagtctcgctctgtcacccaggctggagtgcagtggcgcaatctcggctcactgcaagctccacctcccgggttcatgccattctcctgcctcagcctcccgagtagctgggaatacaggygcccgccaccacacccggctaattttttgtatttttagtaaagacggggtttcaccgtgttagccaggatgatctcgatctcctgacctgggaatccgcccgcctctgcctcccaaagtgctgggattacaggcatgagccaccgcgcccggccaggacaagttttacatcttgctctgttagggccctcagtgcttcatgtgaatcaagactgaaggcctctgaaagatatacttctggaaaaagaaaaataaattttaatgtacaaaaaaatagggcatcatcatgtagatgacttag

SEQ ID NO: 38084 - DNA, 601 bp, Human
ggcttgcatcagtgagcctgacttaaggaaaagttgtttttttttgtttttttttttgagacagagtttcactcttgttgcccaggctggaatgcgatggcgagatctcggctcactgcaacctccgccttctgggttcaagcaattctcctgcctcagcctcctcagtagctgggatttcaggcacatgccaccatgcccggctaatttttgtatttttagtagaaatggggtttcaccatgttgaccaggctggtctcaaactctcgaactcctgacctcaggtgatccgcccacctcrgcctcccaaactgctgggattacaggcgtgagccactgcacccggcctaggaaaagttttttttttttttctttttgagacggagtctcgctctgtcacccaggctggagtgcagtggcgcaatctcggctcactgcaagctccacctcccgggttcatgccattctcctgcctcagcctcccgagtagctgggaatacaggcgcccgccaccacacccggctaattttttgtatttttagtaaagacggggtttcaccgtgttagccaggatgatctcgatctcctgacctgggaatcc

SEQ ID NO: 38085 - DNA, 601 bp, Human
gccaccttgggaggttgaggcactgcacccaaatctttttattaaattttttttaaagagatgggatctcactatgttgcccaagctggagtgcagtggctattcacaggtgtgatcgtagcatactacagtgtcaaacacctgggctcaagtgatcctcccgcctcagcatcctgagtagctgggattacaggcttgcatcagtgagcctgacttaaggaaaagttgtttttttttgtttttttttttgagacagagtttcactcttgttgcccaggctggaatgcgatggcgagatctgggctcactgcaacctccgccttctgggttcaagcaattctcctgcctcagcctcctcagtagctgggatttcaggcacatgccaccatgcccggctaatttttgtatttttagtagaaatggggtttcaccatgttgaccaggctggtctcaaactctcgaactcctgacctcaggtgatccgcccacctcggcctcccaaactgctgggattacaggcgtgagccactgcacccggcctaggaaaagttttttttttttttctttttgagacggagtctcgctctgtcacccaggctgg

SEQ ID NO: 38086 - DNA, 601 bp, Human
tgcctgacttttagtagagatgaggcttcactatgttagcaaggctggtctcaacctcccaacctcaagtgatccactcccctcagcctcccaaagtgttgggattacaggtgtgagccatggcacctggccaacagaaccaatttctaacagtgtgatagccacttgaaattccaagatttctccttcaaggacattttctttctttttactccctcctccctttccaggtcatgaattagctcagaggtgatgttacatcacctcccggaaagttatcaaaaccttccatctctctgaratgattcaaatggtaagcaagaacagattttttcccagtaattttttttcaaaaatggctatgttttttcccagttatatttatatttacccatttttacatgtgacatgtccataattctgcctgagagaaaatatgatttataatgcatctgcaagggaagtgagcatacacaggcttcagaggattgatgacacgaataggctaggatctaagatgctctagttgcttaattctacaggaaaaatatttctccttagctgatgaccaaagcaatcccaccagagaggctaagagtaa

SEQ ID NO: 38087 - DNA, 601 bp, Human
agctattgttaacattgtagcctttataacatcacagcacaacacattactcacatatttgtgatgatgctggtataaacaaacttacagtgctgccagttgtaaaaagtatagcacatgcaattatgtacagtacataacacttgataacaataaacaactatattacttgatgtatttaatatactatgcttttaaaaatatttttctatatatattatttttgagacacagtctcactccattgcccaggttggagtgcagtggcacaatcctggctcactgcagcttctttgtcccrggttcaagtgattctcatgttctcatgccacagccttccaagtagctgggattacgggtgcgtgccaccatgcccggctaatttttgtatttttagtagagatggagtttcaccatgttggtcaggctggtcttgaactcctggtctcaagtgatctgcctgcctcagcctcccaaagtgctgggattactggcatgaaccaccacatcagcctacaatactttttattattattttagtgtgtttcctacttattaaaaaaaaagttctgctaattggccaggtgcgttggctcacacc

SEQ ID NO: 38088 - DNA, 601 bp, Human
aactcagtttgcttctactgaattatacttcatgtaatgccactggcctctcttgagggaggcaatgtgaaactggttgttgggattattgcaaggacttgttgcagatattgttcattacatcattcacaatatctttatgatgattcacaggagaatttctttttttttctttttgagacatagtcttgctctgtctcccaggctggagtgtagtggcacaatcatagctaactgtagccttgaactccagggctcaagtattctcacctcagcctctgagtagctaggactacaggcrcacacaaccatgcctggctaatttattaaaaaaaaaatttgttgcctagaatggtcttgaactcctgggctcaagtgatcctcccacctcagcctcccaaagtgctgggattacaggtgtgagccctggcacctagcctccttaaggaatgagcattgtgaattgggttaactgatcaggtttttctcttcttggattttagaaagtctggaaccaatttcatggtcatccttagtaagcttattttatagaatgcattttttatacttgcctaattcatggctccattttacatcacta

SEQ ID NO: 38089 - DNA, 601 bp, Human
taaaatgttattacccctttccaagtgtatctgtttatcaaccaaagtggggagtggggagcacatgcaggattaaggagaagagtctgtggcccttggtatcataaaagaattacagtcaggagttagggtgagctgggggtcagggatgtgactaaacctttctgaacctggggcagaatcaataaccatacctaagtggaaaacagtgtgctgggttgcaacaatgccctttgtcaaataaacaatccacagatagtcagaatcagactttatttaacaatctgaaaatgtgttcttycggctttaagtcttgcaaaatgggtcgtaagtcaaagacagatttgttcactatcctctgagtgtgtgtggttatgtctctgtataggcaagtgtctgtgtctatagatacttttgctttttatagtgattaaagctccactttagttaatgtataaagtcttattctaataatgctaaaaccagaattaaatattccctgagtctaatgttctcttctccccagcctgcctccctccatccctcccgtaaggctgctcctccgcctccattaatgccaggtctttagacagcaccagca

SEQ ID NO: 38090 - DNA, 601 bp, Human
gctgaagagtttgtggcacagtgactgctgtcattccccagtttagaaggctttctccatctcgattcgctcgctggttcagtgatgcatgtctggcacagttctcttatatttcttgctaaactactagtttacagaagttcacgccttatgggttaggtagtgtaacagtgtatttatcttacatgtccaagactccagattttaaattgtaaaaataacataaaatactcatcgattagttgtgaagactttttttgaggctttgtgttgtagaccacattcagaaacctcattcagyaacagattctgctatttttcaccaaagtctccaattgtggattcttattggagagagggtaaatatgcagttttccagtcagagcagccttttgaaatgaaaaatgaggtcttggagcctgctgtcacgaaagataatattacagactaggaccgacttttttttttttttttggaatagtattttctttataaccattattttaagtcattaggtagtctttatccctgcataagtcgctgaatttgttataggggatacagagtggtataaggcaaggttcttgccatcaagaagttt

SEQ ID NO: 38091 - DNA, 601 bp, Human
atcttacatgtccaagactccagattttaaattgtaaaaataacataaaatactcatcgattagttgtgaagactttttttgaggctttgtgttgtagaccacattcagaaacctcattcagtaacagattctgctatttttcaccaaagtctccaattgtggattcttattggagagagggtaaatatgcagttttccagtcagagcagccttttgaaatgaaaaatgaggtcttggagcctgctgtcacgaaagataatattacagactaggaccgacttttttttttttttttggaakagtattttctttataaccattattttaagtcattaggtagtctttatccctgcataagtcgctgaatttgttataggggatacagagtggtataaggcaaggttcttgccatcaagaagtttccagtttagttgggaaggccacgtataagtagaagtcatctaaaatcgcaagaagttacagtaagtctgaacacttttagaaatgctaggaagtagtttgttcattgaaaaatgagcatatgaacaaatactttattataactgcttttagtacataggaatattctttttaattcag

SEQ ID NO: 38092 - DNA, 601 bp, Human
tggctaaaaatatgcttattttgggccattttgaaagtaaatggatgcttcagaatttgactttggcgccccagcaggcttttcccttttttttttttttttgacgcagtcttgctctgtgttcaggctggagcgcagtggcgcagtctcggctcactgcagcctctgcctcctgggttcaagcgattctcctacctcagcctccttagtagctgggactacaggcgcatgccaccacacccggctaatttttgtatttttagtagagtcggggtttcaccatgttggccaggagggtctygatctcctgacctcgtgatccacccacctcggcctcccaaagtgctgggattacaggtgtgagccactgcgcccggccgtaggctttttaatttttattttaaacattcatggtccttgatccagtgggcttttgagctaagatccctaccagctgtgaagaagtttacactgtagagctattatgcaagggccatctttggttcattttatataatacctgtgggtgatggtcgttactactttcttgagctaggaaccttagtttgggagtcactgatctgtatattttttaatcttg

SEQ ID NO: 38093 - DNA, 601 bp, Human
gggccattttgaaagtaaatggatgcttcagaatttgactttggcgccccagcaggcttttcccttttttttttttttttgacgcagtcttgctctgtgttcaggctggagcgcagtggcgcagtctcggctcactgcagcctctgcctcctgggttcaagcgattctcctacctcagcctccttagtagctgggactacaggcgcatgccaccacacccggctaatttttgtatttttagtagagtcggggtttcaccatgttggccaggagggtcttgatctcctgacctcgtgatccmcccacctcggcctcccaaagtgctgggattacaggtgtgagccactgcgcccggccgtaggctttttaatttttattttaaacattcatggtccttgatccagtgggcttttgagctaagatccctaccagctgtgaagaagtttacactgtagagctattatgcaagggccatctttggttcattttatataatacctgtgggtgatggtcgttactactttcttgagctaggaaccttagtttgggagtcactgatctgtatattttttaatcttgtcaaaaaacagcacagagtcct

SEQ ID NO: 38094 - DNA, 601 bp, Human
taacttaaaacctgtgatgtgtcaggtactgttttgaatgtgtttacatatattattttactttttacttgaatttgaaattgaaaacaatttttcagataactgagttttgttttgttttttttttttgacggaatctcactctgtcacccaggcttgagtgcagtggcgcgatcgcgattcactgcaacctctgcctcccgggttcaagcaattttctgcttcagcctcccgagtagctgggattacaggtgcctggcaccacgcctggctaattttttttgtatttttagtagagacrgggtttcaccatcttggccaggctggtcttgaactcctggcctcgtgatcgacccgccttggcctcccaaagtgctgggattacaggcgtgagccaccgcaccagacccagataactgagttttaacttttaaatgctaaaacaaagtctgtaagtaacattctacaggagtcactaagtagatgacacaaggttataatttaccctgtgatctccttactatttgagttttgagaggatttcacggagagagtaaatattttataccatctttacagattacctgtactcacgaaacct

SEQ ID NO: 38095 - DNA, 601 bp, Human
ggcaccacgcctggctaattttttttgtatttttagtagagacggggtttcaccatcttggccaggctggtcttgaactcctggcctcgtgatcgacccgccttggcctcccaaagtgctgggattacaggcgtgagccaccgcaccagacccagataactgagttttaacttttaaatgctaaaacaaagtctgtaagtaacattctacaggagtcactaagtagatgacacaaggttataatttaccctgtgatctccttactatttgagttttgagaggatttcacggagagagtaamtattttataccatctttacagattacctgtactcacgaaacctctttgaatggatattatatgaaaatagtaggctgtgttcagtattattagaatcagagtctgtaaatataatttgatctttagtctttcctgtagggcattgtgttataaatgaagcaatgtaatgcgtttcttttctaaaatctagttatttggagggaagtagtgggctagacttttgaaagtgtgggtggcttacatgctgacttattaaggttgttaaagaagttgctgttattcttgcagaatggaatctaa

SEQ ID NO: 38096 - DNA, 601 bp, Human
gcaccacgcctggctaattttttttgtatttttagtagagacggggtttcaccatcttggccaggctggtcttgaactcctggcctcgtgatcgacccgccttggcctcccaaagtgctgggattacaggcgtgagccaccgcaccagacccagataactgagttttaacttttaaatgctaaaacaaagtctgtaagtaacattctacaggagtcactaagtagatgacacaaggttataatttaccctgtgatctccttactatttgagttttgagaggatttcacggagagagtaaayattttataccatctttacagattacctgtactcacgaaacctctttgaatggatattatatgaaaatagtaggctgtgttcagtattattagaatcagagtctgtaaatataatttgatctttagtctttcctgtagggcattgtgttataaatgaagcaatgtaatgcgtttcttttctaaaatctagttatttggagggaagtagtgggctagacttttgaaagtgtgggtggcttacatgctgacttattaaggttgttaaagaagttgctgttattcttgcagaatggaatctaat

SEQ ID NO: 38097 - DNA, 601 bp, Human
gccctttatcaggatgaggaagtttgcattcattacactttgctgagaatttttattacagatggacgttggattttgtcaaatgctgttttcccatctgtagagataaaagtttctcttcatttattcttttaatatggttaattgcctggattgatttttgaatgctaaacagactttatattcctagaataaaccattcttggtcagatgtattatcctgttttatatattggctagtattttgtgtgggaaattttgcgtatatcttaatgtggtattttgttttctaattttttcstgaggatatctttgtcaattgtgttattcagcttatgtcaaactcaaaattagttaaggtattttctcttcctatattttcttaaagagtttatgtacaatttgtattttttttttttttgagacggagttctgctcttgttgcccaggctggagtgcaatggcgccatcttggctcaccgcaatctctgcctcccaggttcaagcgattctcctgccttagcctcccaagtagctgggattacaggcatgcaccaccatgcctggctaattttgtatttttagttgagatggggtttct

SEQ ID NO: 38098 - DNA, 601 bp, Human
cattacactttgctgagaatttttattacagatggacgttggattttgtcaaatgctgttttcccatctgtagagataaaagtttctcttcatttattcttttaatatggttaattgcctggattgatttttgaatgctaaacagactttatattcctagaataaaccattcttggtcagatgtattatcctgttttatatattggctagtattttgtgtgggaaattttgcgtatatcttaatgtggtattttgttttctaattttttcgtgaggatatctttgtcaattgtgttattcrgcttatgtcaaactcaaaattagttaaggtattttctcttcctatattttcttaaagagtttatgtacaatttgtattttttttttttttgagacggagttctgctcttgttgcccaggctggagtgcaatggcgccatcttggctcaccgcaatctctgcctcccaggttcaagcgattctcctgccttagcctcccaagtagctgggattacaggcatgcaccaccatgcctggctaattttgtatttttagttgagatggggtttctccatgttggtcaggctggtctcgaactccc

SEQ ID NO: 38099 - DNA, 601 bp, Human
tcttgttgcccaggctggagtgcaatggcgccatcttggctcaccgcaatctctgcctcccaggttcaagcgattctcctgccttagcctcccaagtagctgggattacaggcatgcaccaccatgcctggctaattttgtatttttagttgagatggggtttctccatgttggtcaggctggtctcgaactcccgacctcaggtgatccacccgcctcggcctcccaaagtgttgggattacaggcatgagccaccgctcctggcctgatcattttcttaaatgtttgatagaatttacygttaaactactagggcctgaatttttttttttgtggcattattttgtttgaaaatggattcagtttgcttcatagaaattgggttattcagattttctagttatgtctgttttgattaagttgcatttatcaagttgtttcctttttacttttttaaaaaaacattaaaacatttctttaaaattacattttctatgcacatttcttcctcagaaaaagtaacaaggagaatggtacatagtaaaaaaattctgaatacctcatggaattgagcatttgaataatagaatattctagtta

SEQ ID NO: 38100 - DNA, 601 bp, Human
ggattcacagactgttgtgctgaaagagcctcaatgcatccttggtcggttaagtgaaaaaagctcagggcagatggcacagaaattcagtttttccaaggtaaaactgaagtgtttttgttttttgttttaaagataaagagacttggcttaggctaaattgctatataattgtatataatgaactatacattttatgcttatgcaacttagattttaaggataagactcaaatctcaggtctggaaatatataattggatgtaaagagatcactgtagtgttattaaagttattattamtatatttttattaaagttattattaatatatttttaagaaatattcttttcaaaacttaggtgaatacttgattccctggtacagatttctatcttgaaaactttctggtagtaaaactatcaaatgtatttgtgggagtggggatgtggcacctattttaagaatgaatcttttaaatttttaaacagtagtgttgggatggaacacactattaatattaacttgaattttctaaaaagagtttttaaaaaatgtttgcttaggtttttggcccagcaactacacagaaggaattcttt

SEQ ID NO: 38101 - DNA, 601 bp, Human
tttggcccagcaactacacagaaggaattctttcagggttgcattatgcaaccagtaaaagacctcttgaaaggacagagtcgtctgatttttacttacgggctaaccaattcaggaaaaacatatacatttcaaggtaaatattgttttattttggttggaaaggataaggaagcaataataatcactcagtgtttttataatacatacatgtagttatgttgctattacctagtatgcgtttgctctatttttaatagtactagcatattattacgtattgctgtttttttttttttttggcgggggagggacagagtctcactctgttgcccaggctggagtgcagtggtgtgatctcagctcactacaacctctgcctcctgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatatgcccaccttggccttccaaagtgcttggattacaggcaagagccaccatgcctggcctt

SEQ ID NO: 38102 - DNA, 601 bp, Human
gtttgctctatttttaatagtactagcatattattacgtattgctgtttttttttttttttggcgggggagggacagagtctcactctgttgcccaggctggagtgcagtggtgtgatctcagctcactacaacctctgcctcctgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatrtgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaat

SEQ ID NO: 38103 - DNA, 601 bp, Human
tgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatatgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctc

SEQ ID NO: 38104 - DNA, 601 bp, Human
tacaggcgtgcgccaccatgccaagctagtttttatatttttgtagaaatgggggttcaccattttggccaggctagtctcgaactcctgacctcaggtgatatgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaarttttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaa

SEQ ID NO: 38105 - DNA, 601 bp, Human
gtctcgaactcctgacctcaggtgatatgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaawgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatga

SEQ ID NO: 38106 - DNA, 601 bp, Human
tattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatcctyagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcgg

SEQ ID NO: 38107 - DNA, 601 bp, Human
gatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagkaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttataaaccctt

SEQ ID NO: 38108 - DNA, 601 bp, Human
caataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttamggttatcatcagaacaagagaaagaagaaattgctagcaaaagtgcattgcttcggcaaattaaagaggtatggaaatattttagtatgtaaaatatgtataattcctgacttcttataaaccctttagattgtttcaccatatattggaatctggtttgtggtggtagtgttttttgttattatttatgttttcgagaaaaataaagcttaaagtgtgaagacatcttttgtatttatattataccaacagcaagaatgtttaaacaatacaaatgtaaatggttctgaaatctttttt

SEQ ID NO: 38109 - DNA, 601 bp, Human
aaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttatraaccctttagattgtttcaccatatattggaatctggtttgtggtggtagtgttttttgttattatttatgttttcgagaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagta

SEQ ID NO: 38110 - DNA, 601 bp, Human
cagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttataaaccctttagattgtttcaccatatattggaatctggtttgtggtggtagtgttttttgttrttatttatgttttcgagaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagtaaaagtttcctttaatttcattcctaaagaaaaaattattaatagattgggaagtattgtttt

SEQ ID NO: 38111 - DNA, 601 bp, Human
gaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagtaaaagtttcctttaatttcattcctaaagaaaaaattattaatagattgggaagtattgtttttggaccttttctctctmtatataaaatccatatacagagctttctatctgtatatacacaaacatggtcatatatatgatgtgtatatcttcatacctttgtttttatatgtatgatataatttttttttttaaacaaaaaagagatcttactatgcttaccattctatgacttggtatttcatttagcgtatcttaaatctcttcctaccttaaatcatgtgcgttttatctgttatgtctttaacttgtttttttaaattttaaatcagcttttaaaactaagtctccattgatggacatttgtattgtttctgt

SEQ ID NO: 38112 - DNA, 601 bp, Human
agaagtaaaaagtaaaagtttcctttaatttcattcctaaagaaaaaattattaatagattgggaagtattgtttttggaccttttctctctctatataaaatccatatacagagctttctatctgtatatacacaaacatggtcatatatatgatgtgtatatcttcatacctttgtttttatatgtatgatataatttttttttttaaacaaaaaagagatcttactatgcttaccattctatgacttggtatttcatttagcgtatcttaaatctcttcctaccttaaatcatgtgcrttttatctgttatgtctttaacttgtttttttaaattttaaatcagcttttaaaactaagtctccattgatggacatttgtattgtttctgtgttttactattttgaacagtgtttcagtaaagaaacattccattgcaaatatatttggtgctaattttcccaaactcaggccaagattggatatttaataatgtctggtttgataggtgaaaaatggctcacttgagcctactttatatttttttaattgtaaattagttgattagtacatcttagaattttttcctgtgaattgtca

SEQ ID NO: 38113 - DNA, 601 bp, Human
tcactgggcatggtggttcatgcctgtaatctcagaactttgggagactgaagcaggctgatcacttgaggccaggagttggagactagcctggccaacatggcgaaaccccgtctctattaaaaatacaaaaaattagctgggcatggtgactcacacctgtagtcccagctgcttgggaggctgaggcacaagaattgcttgaacccgggaggtggaggttacagtgagccgagattgcgccactacattccagcctgggtgacagagcaagactctctcaaaaaaaaaaaaaaaaaaattctaacaagttatccagttaaaacatgatactgttttgcctatgaaatgattaaaatgttaaaaaaaaatgagataatgtgctttcatatattgtaaatggttctagaaagcaaattggcaatagtgtgttaagagtgagaacattaaaatattttatatcttttcatccaccaattcacttttaggtgtatactccaaggaaatgggtttatttctatttctaaggaaataataagaatgcagaagaaaatatgtaaagatgtttggcaaaacttggtgaataaattaaatgtttaat

SEQ ID NO: 38114 - DNA, 601 bp, Human
gccaggagttggagactagcctggccaacatggcgaaaccccgtctctattaaaaatacaaaaaattagctgggcatggtgactcacacctgtagtcccagctgcttgggaggctgaggcacaagaattgcttgaacccgggaggtggaggttacagtgagccgagattgcgccactacattccagcctgggtgacagagcaagactctctcaaaaaaaaaaaaaaaaaaattctaacaagttatccagttaaaacatgatactgttttgcctatgaaatgattaaaatgttaaaaaaaaatgagataatgtgctttcatatattgtaaatggttctagaaagcaaattggcaatagtgtgttaagagtgagaacattaaaatattttatatcttttcatccaccaattcacttttaggtgtatactccaaggaaatgggtttatttctatttctaaggaaataataagaatgcagaagaaaatatgtaaagatgtttggcaaaacttggtgaataaattaaatgtttaataataagggaataattaagtcatttcacatgttttatatagccatcaaatgttgtaaacaatttttaatta

SEQ ID NO: 38115 - DNA, 601 bp, Human
gtggcaggattatacatgataatattctttttcatagttctctgtatttttccatgaaactatattatttaactaggaaaaattaaagaattcattgaattgagtagatgaaaggttgtgatttggtagtgacttatttggataggtaattaatatcttgattatttaaccttaatgaaaatgtttttttaattttttaaaacaatcttttttttaggttactgtgcataatgatagtgatgatactctttatggtaaggtttcgttgctcacttatctttgatgtatcgattatatgaartacacttgaaaagcttttaatttttaaatcacttctaatgttttatttttattattaaaaaatttttaggctgggcgcggtggctcacgcctgtaatcccagcactttgggaggctgaggtgggtggatcatgaggtcaagagattgagaccatcctggccaacatgatgaaaccccgtctctactaaaaataaaaaaattacctgggcgtggtggcgcgggcctgtagtcctagctacctgggaggctgaagcaggagaatccttgaactcaggaggtggaggttgcagtgagccgaga

SEQ ID NO: 38116 - DNA, 601 bp, Human
aaaaataaaaaaattacctgggcgtggtggcgcgggcctgtagtcctagctacctgggaggctgaagcaggagaatccttgaactcaggaggtggaggttgcagtgagccgagatcgcgccactgcactccagcctgacaacagagtgaaactgtctcaaaaaaaaaaattttcaccttgtatttatttattttttttctatagacctcttctttggttactaaggatttaatttctataatgacatagtcggtgatacctggaaaatgatacatatttatatgaaatgtcagtcattgtratgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttggttaatccacatattatttacatcttcctttgttccaaaaagtttttaacatagatggtcaaaagattaagcatacttggtttttcaagtgtgagaatcgatttgtacttttgtcacgtttttagtcagttgctta

SEQ ID NO: 38117 - DNA, 601 bp, Human
aaaattttcaccttgtatttatttattttttttctatagacctcttctttggttactaaggatttaatttctataatgacatagtcggtgatacctggaaaatgatacatatttatatgaaatgtcagtcattgtgatgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttgrttaatccacatattatttacatcttcctttgttccaaaaagtttttaacatagatggtcaaaagattaagcatacttggtttttcaagtgtgagaatcgatttgtacttttgtcacgtttttagtcagttgcttactttcgtgattgttttttctttttcttttttttgtaggaagtttaactaactctttgaatatctcagagtttgaagaatccataaaagattatgaacaagccaacttgaatatggctaatagtataaaattttctgtgtgggtttctttctttgaaatttacaat

SEQ ID NO: 38118 - DNA, 601 bp, Human
ataaaattttctgtgtgggtttctttctttgaaatttacaatgaatatatttatgacttatttgttcctgtatcatctaaattccaaaagagaaagatgctgcgcctttcccaagacgtaaagggctattcttttataaaaggtatactaatgaatatttttatcttattgctctgaagttctcttcctgggctttgtgatagctgtaagactaaaacaaatagaaaattgaaaattgtaatgctaattattaacattaagagaagaagataattttgtgctttggaagtatgttttggtrtatttattaaacttgaatataaaagggtctattttggtattgtatttgcttgagtatcattaattggatttgtggtgatgggaaaagctgtgtatggttatgttcacgttattctcctgctttgtaacagtgtccaaattttggagctatgaaatgttactattcttccggagtggtttttctaaccttttaaaacaattattcacagtaggaaacacatattaataacatcatgattcagtacctacatgcatgtatatatattcatatgtaatatttacaactcaaaagtttcgttaa

SEQ ID NO: 38119 - DNA, 601 bp, Human
aaaacgccatctctacaaaaaatacaaaaattagcctggcatgatcgtatgcatctgtagtcccagctactcaggaggctgaggcaggaggatcacttgagcctaggaggtcaaggctgtagagagccatgatcacgcctttgcactccaggctgggcaacagagtgaaaccttgtctccaaaataaataaataaataaataaataaataaataaataaataaataaaaattaaaatactggtcatgattcaataaatctgattttatgattcactaataaattacaatcttcagtgtttmatagctaggtaattttacaggtttaatctgtactgtactttgccactctttttttccctgagtgtctaattctaaggaattgttactgtattcaattttccgtttggcagactctgttgacaaacatttattttgtgtgtttgtgtaatttacattctagaacattgttacaatcttctctggtgtaacctgaaatagctgagttgactccagctaggatgtgttgttagaagaaagatttcattatatgtcactaggaaaagactttcaaagagattacattgtagaacacattctttg

SEQ ID NO: 38120 - DNA, 601 bp, Human
taatatatatcctctttattttttaaagatctacaatggattcaagtatctgattccaaagaagcctatagacttttaaaactaggaataaagcaccagagtgttgccttcacaaaattgaataatgcttccagtagaaggtaaagaataaactctgtaagagtaaactcgaatcaccgatagtattctgtgttaatttaaacacagctaattttacattaaagtgggcagtaggttctctcgtgttaaattcataaggcataaaaaacatttggtatacagaataacactaaacacgttyatcaatactgtttcctgtcctgacagtagatttattaatttataggaaatctctgaggtatttttactctttctttatgtcagtatctaagctcagtatttttggagttggtaataatggtggccttttctctgggtctttctcacttatcccctgaatactatataaatatactcagtgagggtataatctcaaggggttaaggaaggaagttttgatgggattgggggatgagaggcaaaggaaataagtttaagcagtgagataattaaagcaggctttttcttagagaaggagccc

SEQ ID NO: 38121 - DNA, 601 bp, Human
agtattctgtgttaatttaaacacagctaattttacattaaagtgggcagtaggttctctcgtgttaaattcataaggcataaaaaacatttggtatacagaataacactaaacacgttcatcaatactgtttcctgtcctgacagtagatttattaatttataggaaatctctgaggtatttttactctttctttatgtcagtatctaagctcagtatttttggagttggtaataatggtggccttttctctgggtctttctcacttatcccctgaatactatataaatatactcagtgmgggtataatctcaaggggttaaggaaggaagttttgatgggattgggggatgagaggcaaaggaaataagtttaagcagtgagataattaaagcaggctttttcttagagaaggagccctgttcccgtagtcagttgggcatgggacaatacaagatccggatctataggtcaaatgtatgctttgctttaggtatgtattcagagtattggctagctgtacataatatcattttaactaatattatcttttcaaacaaaatgtcgctttattataaatgatactattaatagaagttga

SEQ ID NO: 38122 - DNA, 601 bp, Human
tgttcccgtagtcagttgggcatgggacaatacaagatccggatctataggtcaaatgtatgctttgctttaggtatgtattcagagtattggctagctgtacataatatcattttaactaatattatcttttcaaacaaaatgtcgctttattataaatgatactattaatagaagttgaactgtcaggatataatttgagggatttagagctaggcaaaaggtgattttaggcatttgggtatgtaagtgacagtagaacactggcttgaaatatttaacagctaattggaaaatgcartggtggactgtagttatactagggtataaataagattgatttgaatacttgtctctcctatttagaatgcagaaattaaaaatgataagataacatttgatctttgtatttcagtcacagcatattcactgttaaaatattacagattgaagattctgaaatgtctcgtgtaattcgagtcagtgagtaagttgaatattctttaaatttaattatttgtaattgttttgaagaacttttaaagtactttttttttcttaattcagattatctttatgtgatcttgctggttcagaacga

SEQ ID NO: 38123 - DNA, 601 bp, Human
agtaaatataaatcagccttcaccatttctatttagggtgtttcatgacatctcttatatacttgctctatactagggaacataacccagttaaatgtggttttctttataatttacatagtgggttattgttagtaagtagcagcagttaaaacaaacagccaggcatggtggcttatgcctgtaatcccagcacttttggaggccgaggcaggaggattgcttgagcccaggagttcaagaccagcctcatctctactaaaaataaaaataaaaaaattaaccaggtgtggtggcaggmacctgtaatccctgctaccctggaggcagaggcgagaggatcgcttgagcctaagatgttgaggctacagtgagctctgattgtgccactgtactccagtctgggcaaccgagctagaccctgtctcaaaacagaaacaaaaacaaaaacaaacaagaaaagataaaaagaaaactgagaaggactattacatctgaaactaatcactaccctaaagtttaatttcatgataggtggcttaattatttctttgtaaaatgtctcagcaccctgatttcatgagatgttttttaacttaca

SEQ ID NO: 38124 - DNA, 601 bp, Human
ctatactagggaacataacccagttaaatgtggttttctttataatttacatagtgggttattgttagtaagtagcagcagttaaaacaaacagccaggcatggtggcttatgcctgtaatcccagcacttttggaggccgaggcaggaggattgcttgagcccaggagttcaagaccagcctcatctctactaaaaataaaaataaaaaaattaaccaggtgtggtggcaggcacctgtaatccctgctaccctggaggcagaggcgagaggatcgcttgagcctaagatgttgaggctrcagtgagctctgattgtgccactgtactccagtctgggcaaccgagctagaccctgtctcaaaacagaaacaaaaacaaaaacaaacaagaaaagataaaaagaaaactgagaaggactattacatctgaaactaatcactaccctaaagtttaatttcatgataggtggcttaattatttctttgtaaaatgtctcagcaccctgatttcatgagatgttttttaacttacaatgttttctgaaaattttttctgtaggtttcaacagcatgtgcctttccgggaaagtaaactgactc

SEQ ID NO: 38125 - DNA, 601 bp, Human
gttgcccatgctaggattaaaatgacctttagtaataagaattagtaataaacatcagttataaattaatgagtatttttggaatgaattgtctgctctgccattcatcttgttcatttggtacttctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtkttcatttgacttaaatttataaaataatcattttctagtggacagttcttgtcttttctgttttaaaagtcacattgaatattttaacaggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtg

SEQ ID NO: 38126 - DNA, 601 bp, Human
acacattgcttttgattattgtgtttctttaatcatttctaatctagcactgacatttttgaaaagtgggtcctagttttctcatagaatacctgcaatttagatttgtttgattatttcttcatgatttaggtttaatacattagggaagctttttatgtaggttaagttgtaaattttccattgcatcacaccaagagccacatgatgtctgatttttccattcttagagatgctaagttttgctcacttggttaagataacagtatttcagatctgtattgcaaaaccatattatctrtggggtgttacttatagaccatgtgagtatcctttcactaagtgattttatgtattccatcagacctttattttgcagtctcaagtacaagtgttaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcacgatctcggctt

SEQ ID NO: 38127 - DNA, 601 bp, Human
taatctagcactgacatttttgaaaagtgggtcctagttttctcatagaatacctgcaatttagatttgtttgattatttcttcatgatttaggtttaatacattagggaagctttttatgtaggttaagttgtaaattttccattgcatcacaccaagagccacatgatgtctgatttttccattcttagagatgctaagttttgctcacttggttaagataacagtatttcagatctgtattgcaaaaccatattatctgtggggtgttacttatagaccatgtgagtatcctttcacwaagtgattttatgtattccatcagacctttattttgcagtctcaagtacaagtgttaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcacgatctcggcttactgcaacctctgcctcctgggttcaagcgattctcctg

SEQ ID NO: 38128 - DNA, 601 bp, Human
gcaatttagatttgtttgattatttcttcatgatttaggtttaatacattagggaagctttttatgtaggttaagttgtaaattttccattgcatcacaccaagagccacatgatgtctgatttttccattcttagagatgctaagttttgctcacttggttaagataacagtatttcagatctgtattgcaaaaccatattatctgtggggtgttacttatagaccatgtgagtatcctttcactaagtgattttatgtattccatcagacctttattttgcagtctcaagtacaagtgytaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaag

SEQ ID NO: 38129 - DNA, 601 bp, Human
ccatattatctgtggggtgttacttatagaccatgtgagtatcctttcactaagtgattttatgtattccatcagacctttattttgcagtctcaagtacaagtgttaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcaygatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggagtcctcttaccagtg

SEQ ID NO: 38130 - DNA, 601 bp, Human
tctgtccaattatagtatttatttatttatttatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattayaggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaa

SEQ ID NO: 38131 - DNA, 601 bp, Human
ccaattatagtatttatttatttatttatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcrtgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaagtccc

SEQ ID NO: 38132 - DNA, 601 bp, Human
agagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggartcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaagtcccactttatctggtcactatgtgattagaccgtgttacttgggcttctgtaatgtattaaatagtacct

SEQ ID NO: 38133 - DNA, 601 bp, Human
ttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagawcgatgatgtattaggctaaatactctcattttaataatttaccttcatgtccctgaaagcaattattgaacatatgtttggaaacaagaatgatagcttcagatgtagtacaagtcccactttatctggtcactatgtgattagaccgtgttacttgggcttctgtaatgtattaaatagtacctcctcagtgacgaaaggagcctttaatagtctagtttggctggtgcagtggctcacacctgtaattcgagcactttgggaagctgaggtaggaggattgcttgagctcaggagttc

SEQ ID NO: 38134 - DNA, 601 bp, Human
ctcccaaagtgctgggattataggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgrtagcttcagatgtagtacaagtcccactttatctggtcactatgtgattagaccgtgttacttgggcttctgtaatgtattaaatagtacctcctcagtgacgaaaggagcctttaatagtctagtttggctggtgcagtggctcacacctgtaattcgagcactttgggaagctgaggtaggaggattgcttgagctcaggagttcaaaactagcctgggcaacatagtgagaccccatctctacaaaaaagtaaaattagttaggcatgatgatgcacaggtgtagtcccagctactt

SEQ ID NO: 38135 - DNA, 601 bp, Human
ggctggtgcagtggctcacacctgtaattcgagcactttgggaagctgaggtaggaggattgcttgagctcaggagttcaaaactagcctgggcaacatagtgagaccccatctctacaaaaaagtaaaattagttaggcatgatgatgcacaggtgtagtcccagctacttgggaggctgcagtgggaagattgcttgagcccaggatttctaggcagcagtgagccatcactgcactactgcactctggcctgggtgacagagtgagaccttgtcttaaaaacaaagaaacaaaccaaraaacccagtttttttttttcatttcaaagttgaaatttttgtataatgttggttagtaaaatttctgaaattactagagaaaaatatttaatgctatagtttatgatggattatatagtataaatgcttatcatataagattgactaaatattttaaggaaattcatcaaaatgtctaatatttgacatttaaaaatcaatatgattaggtgttggcatgctttatttttttcttctagagacaaagtcttgctctgttacctaggctggagtgcaatagtgtagttatggctcactgca

SEQ ID NO: 38136 - DNA, 601 bp, Human
tcctgggctcaagtgatcctcttgcctcagtctcctgagtagctgggaccacagatgcatgccaccacccctaactaatttttaaaaatgttttgtagacatgaggccttgctctattgcccaggctgatcttgaacccttgggctcaggcaatcctcctgccttgcaaagcgctgggattacagatgtgagtcaatgtgcccagccctttcttgacattttaattaaaggattgggacttttaaaaaccattataaaataccttggtattagcatacatatacttaaattcgtttagctrtaatagccagcctaaattttttcagcaaaaactttatcagatgctaacaatgataaaacctaattattgaaaactattaaacttcccgccaggcgcggtggctcatgcctgtaatcccagcactttgggaggccaaggtgggtggatcatgaggttgagagattaagaccatcctggctaacacggtgaaaccctgtctctactaaaaatacaaaaaattagccaggcgtggtttctggcgcctgtagtcccagctactcgggaggttgaggcaggagaatggcgtgaacctggggggcg

SEQ ID NO: 38137 - DNA, 601 bp, Human
tagacatgaggccttgctctattgcccaggctgatcttgaacccttgggctcaggcaatcctcctgccttgcaaagcgctgggattacagatgtgagtcaatgtgcccagccctttcttgacattttaattaaaggattgggacttttaaaaaccattataaaataccttggtattagcatacatatacttaaattcgtttagctataatagccagcctaaattttttcagcaaaaactttatcagatgctaacaatgataaaacctaattattgaaaactattaaacttcccgccaggcrcggtggctcatgcctgtaatcccagcactttgggaggccaaggtgggtggatcatgaggttgagagattaagaccatcctggctaacacggtgaaaccctgtctctactaaaaatacaaaaaattagccaggcgtggtttctggcgcctgtagtcccagctactcgggaggttgaggcaggagaatggcgtgaacctggggggcggaggttgcagtgagccgagatcgagccactgcactccagcctgggcgacagagtgagactccgtctcaaaaaaaataaataaataaaataaacaa

SEQ ID NO: 38138 - DNA, 601 bp, Human
tactaaaaatacaaaaaattagccaggcgtggtttctggcgcctgtagtcccagctactcgggaggttgaggcaggagaatggcgtgaacctggggggcggaggttgcagtgagccgagatcgagccactgcactccagcctgggcgacagagtgagactccgtctcaaaaaaaataaataaataaaataaacaaacttcccaaggtttttccacattcattctgatgtctccttcaatagttattatttattgttttactcagaaagtatgtagtttaaaattattaaaatagtattatrtatttatagtagagtgaaaaagaaaatctaaatataaagatctctcaaatctaccatgaatgttaatggatttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttttcattatttaaacacaactaccatcacaaaacaacaacactgtgatcagcattcatacaaccagaacat

SEQ ID NO: 38139 - DNA, 601 bp, Human
ggcaggagaatggcgtgaacctggggggcggaggttgcagtgagccgagatcgagccactgcactccagcctgggcgacagagtgagactccgtctcaaaaaaaataaataaataaaataaacaaacttcccaaggtttttccacattcattctgatgtctccttcaatagttattatttattgttttactcagaaagtatgtagtttaaaattattaaaatagtattatgtatttatagtagagtgaaaaagaaaatctaaatataaagatctctcaaatctaccatgaatgttaatggwtttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttttcattatttaaacacaactaccatcacaaaacaacaacactgtgatcagcattcatacaaccagaacatggggttatattataattattttcagtataaattcttggaggcagagtttcaaagtctggatagctgtaga

SEQ ID NO: 38140 - DNA, 601 bp, Human
ccttcaatagttattatttattgttttactcagaaagtatgtagtttaaaattattaaaatagtattatgtatttatagtagagtgaaaaagaaaatctaaatataaagatctctcaaatctaccatgaatgttaatggatttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttytcattatttaaacacaactaccatcacaaaacaacaacactgtgatcagcattcatacaaccagaacatggggttatattataattattttcagtataaattcttggaggcagagtttcaaagtctggatagctgtagaactattttcaaatataaagttgagacattggaagatctgtagcttagagtttattgtttaatttgttgttgagtaactttaaatagaaacattaaaaagaatatgtagctgtttccttaatgctacaatttatgttatgaatgtataatggtcatgttaag

SEQ ID NO: 38141 - DNA, 601 bp, Human
aagatctctcaaatctaccatgaatgttaatggatttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttttcattatttaaacacaactaccatcacaaaacaacaacactgtgatcagcattcatacaaccagaacatggggttatattataattattttcagtataaattcttrgaggcagagtttcaaagtctggatagctgtagaactattttcaaatataaagttgagacattggaagatctgtagcttagagtttattgtttaatttgttgttgagtaactttaaatagaaacattaaaaagaatatgtagctgtttccttaatgctacaatttatgttatgaatgtataatggtcatgttaagtgttttatttattgctttatttatatattgcacatttttcatgattatgtatgtgtttcaaaggctatagaattgctgttgacatctggatagttataaaagccta

SEQ ID NO: 38142 - DNA, 601 bp, Human
tgttaatggatttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttttcattatttaaacacaactaccatcacaaaacaacaacactgtgatcagcattcatacaaccagaacatggggttatattataattattttcagtataaattcttggaggcagagtttcaaagtctggayagctgtagaactattttcaaatataaagttgagacattggaagatctgtagcttagagtttattgtttaatttgttgttgagtaactttaaatagaaacattaaaaagaatatgtagctgtttccttaatgctacaatttatgttatgaatgtataatggtcatgttaagtgttttatttattgctttatttatatattgcacatttttcatgattatgtatgtgtttcaaaggctatagaattgctgttgacatctggatagttataaaagcctaatataagtttatgtaacatcttta

SEQ ID NO: 38143 - DNA, 601 bp, Human
tctcctgccttagcctcctgagtagctgggattacaggcacacaccaccacgcccagctaatttttgtgtttttagtagagacggtgttgctgtgttggccaggctggtttcaaactcctggcctgaagtgatccacccgcctccgcctcccaaattgctgggattacaggcgtgaaccactgtacctggactaaattttcttttaatctagaatatacttaaacttagatgtttaaaacaaaaacacaaagtagttcgttttctgtttcttaatgggattaatttgtattttgaagggaractctgcttcaagaacgagagatattagaagaaaatgctgaacgtcgtttggctatcttcaaggatttggttggtaaatgtgacactcgagaagaagcagcgaaagacatttgtgccacaaaagttgaaactgaagtatgttaattgaagtatttaaaaatatccagtgaggttttggtaccagggtttagtgtaccacatcaatgatgagaaacaccaagatagtttagaattaaaacaatgctttgtgtgtagctttattataattaggcatgtttttttagaagtgtaaggcaccaa

SEQ ID NO: 38144 - DNA, 601 bp, Human
ccactgaagctgaaattgatcagttttttgggggagttggtttttttttgtttttgtttagttttttaatcactcagttcaagtgcctgtgacagtgatgtccagacgtctgctgtcaagcaaaccttatgtatccttgacgtggtttgggattgactgagttgtgaaaatgtaggtttgtttcatgcactatcccaacaaaaccttttaagtctcattatataattgaaagtatacctgaactaggtaatcataattgttctataatgacttgtcacagtttgtaacattgtttttatgygaaaatatgcctcatggtccatacagcagaaaataaataatggaacacaggtttttcataattggagttgcttctatataatttattttaaagaatttcaagtgatgaattttttgcttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcactta

SEQ ID NO: 38145 - DNA, 601 bp, Human
tctgctgtcaagcaaaccttatgtatccttgacgtggtttgggattgactgagttgtgaaaatgtaggtttgtttcatgcactatcccaacaaaaccttttaagtctcattatataattgaaagtatacctgaactaggtaatcataattgttctataatgacttgtcacagtttgtaacattgtttttatgcgaaaatatgcctcatggtccatacagcagaaaataaataatggaacacaggtttttcataattggagttgcttctatataatttattttaaagaatttcaagtgatgrattttttgcttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaacc

SEQ ID NO: 38146 - DNA, 601 bp, Human
aaaatgagcttctcaacaaaaaaagtcaaaacaagtgttaactttatgagtaaagctgtaaattttgttatatatatatattttttatgacagcgtctcgctctgtcaccaaggctggagtcagtagtggcatcacagctcactgcagccttctactcctgggctcaattactcctcttgcctcagcttcctgaatacttgggaccacaagtgtgcactaccacagcggctgcattttttttttttcttttttgtagagatgggatcttgctatgctgcccagattggtcttgaactcctrggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccctttttttttttaaagacagggtctcactctgtcacccaggctggagcgcagaggcatgatcatggctcactgcagttttc

SEQ ID NO: 38147 - DNA, 601 bp, Human
accacagcggctgcattttttttttttcttttttgtagagatgggatcttgctatgctgcccagattggtcttgaactcctaggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccctttttttttttaaagacagggtctcactctgtcacccaggctggagcgcagaggcatgatcatggctcactgcagttttccacctcctgggctcaagtgatccttccaccttagtctcctgagtagcttggactacagacatgtgccaccatgctgagggcattttatatacataaatagaattgtttgtaatatctgcattttaagaattagttgcaataactgctctgcccttttttgtgtgaaacaaatgggtagaaaataacacgtaagtggtgcctttgcattatgaaatgtac

SEQ ID NO: 38148 - DNA, 601 bp, Human
ccacagcggctgcattttttttttttcttttttgtagagatgggatcttgctatgctgcccagattggtcttgaactcctaggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccytttttttttttaaagacagggtctcactctgtcacccaggctggagcgcagaggcatgatcatggctcactgcagttttccacctcctgggctcaagtgatccttccaccttagtctcctgagtagcttggactacagacatgtgccaccatgctgagggcattttatatacataaatagaattgtttgtaatatctgcattttaagaattagttgcaataactgctctgcccttttttgtgtgaaacaaatgggtagaaaataacacgtaagtggtgcctttgcattatgaaatgtact

SEQ ID NO: 38149 - DNA, 601 bp, Human
ctatgccagttctttactatttagcatatgccacctatttttatcctgagttttagaagtggctttttctgaaacattaccctgttgtggttgaattagcagatttttttttaatgagtagggtgtgcttctagtgctatcaaaatcctttttattgaatgtaacagtaaagtgtcactagagcagcatatgtttcatagttattcagtgatacatatttttagatgcttagatatttattttcaatgttctttattttttcagaatcagattcattgattcaagagcttgagacatctawtaaggtaatgctttaagttttattttgtcttgataaggtatttaattaacaaaggggtatgaatgatgactagatttgtttattttaaaaaataattaaacagtaatatagtctcttggtatgcatgggggattggttttattctgttattttttctgttcttctttggcttgagtcttcttatttcaacttgtatttatcctttcaaaaagctgaatattttaaaatatgatcagatataaataattcaagatcttggtatctaatatccagtatttaaagaacaaaaatgtacttaga

SEQ ID NO: 38150 - DNA, 601 bp, Human
gttagggttacaggtggccaccacccccggctgatttttgtatttttcagtggagacgggctttcacgatgttggccaggctggtctcaaactcctgacttcaggtaatctccccaccaggtaatttggcctcccaaagtgctgggattacaggcatgagccactgtgcctggcccagggtgacatattaaaagggatagcagctaggatttgagcccaggcagtctggctccaaattcctcttatatgctatatagcttcttttttctttgtgtgtgtgtgtgtgtgtgtgtgtgtgtggatgtaatttttttaaaggcaaaaataagatcatgctgtgcatagtgtgttgccactgattagctttatttaactttaaaatttgaaggaattataaaactgtttgcattattaatcatatttgcattctagttatcctaaagtatattcatgaaacattgctttttcttctttccaaagaaaataattacacagaatcaaagaattaaagaattgataaatataattgatcaaaaagaagatactatcaacgaatttcagaacctaaagtctcatatggaaaacacatttaaatgcaatg

SEQ ID NO: 38151 - DNA, 601 bp, Human
tgtgtgtgtgtgtgtgtgtgtgtgtgtatgtaatttttttaaaggcaaaaataagatcatgctgtgcatagtgtgttgccactgattagctttatttaactttaaaatttgaaggaattataaaactgtttgcattattaatcatatttgcattctagttatcctaaagtatattcatgaaacattgctttttcttctttccaaagaaaataattacacagaatcaaagaattaaagaattgataaatataattgatcaaaaagaagatactatcaacgaatttcagaacctaaagtctcwtatggaaaacacatttaaatgcaatgtaagaatttaaccttgtgttatattaataaattagataagcatatgttttggttgaaaggaaataatttaaaatagcttatgcaactaagactaatttattgagaatgttgaattgcttatgcaacattgaactcaatttactgttttccaaatctgaatttttgagaacttagacgagggtgtttgacttctttgaacatacttttccacaagatacgctggcagtgctttgcatgtaaaaaggaggagaatatgtagcctttggacgtttaa

SEQ ID NO: 38152 - DNA, 601 bp, Human
atgatcagcttgtcttttaatccatgtcttttaaaatggcttttggttttctttttttggggtaagctccttcaaattattcttttatttagaaatggtaaaatatatggtaataatgtagtaagctgagtaaacttagagccaaacatcttgctttgttgaaaggtgcttttttatgtcttttctatgaccaaaagaagcaggcgtggtatcttataaaaagtgactgttgagtttcctttgtatcttgatagtcaaactctaatacccaccaacattccctgattcatctgaactttaratgggcatttgataccacaggggtaaatgaggagcattctagaagagcactctgtctaatctcctatagtaggcctttcttttggtatttattagatacatgattcattctctggtttttctgtacctgaactgggagaaatatcctaatatttaatatgttaataataaactatttagtaataattagtatttaataaggtggaggagcaagaaacacttgtggagtgtccaacgtgtgccaggtactatgctagattattggaattatacagattaataaaatctactaccctaacaa

SEQ ID NO: 38153 - DNA, 601 bp, Human
tttaaaatggcttttggttttctttttttggggtaagctccttcaaattattcttttatttagaaatggtaaaatatatggtaataatgtagtaagctgagtaaacttagagccaaacatcttgctttgttgaaaggtgcttttttatgtcttttctatgaccaaaagaagcaggcgtggtatcttataaaaagtgactgttgagtttcctttgtatcttgatagtcaaactctaatacccaccaacattccctgattcatctgaactttaaatgggcatttgataccacaggggtaaatraggagcattctagaagagcactctgtctaatctcctatagtaggcctttcttttggtatttattagatacatgattcattctctggtttttctgtacctgaactgggagaaatatcctaatatttaatatgttaataataaactatttagtaataattagtatttaataaggtggaggagcaagaaacacttgtggagtgtccaacgtgtgccaggtactatgctagattattggaattatacagattaataaaatctactaccctaacaatcccccaataagaaaaaaacaacataaat

SEQ ID NO: 38154 - DNA, 601 bp, Human
tttcctttgtatcttgatagtcaaactctaatacccaccaacattccctgattcatctgaactttaaatgggcatttgataccacaggggtaaatgaggagcattctagaagagcactctgtctaatctcctatagtaggcctttcttttggtatttattagatacatgattcattctctggtttttctgtacctgaactgggagaaatatcctaatatttaatatgttaataataaactatttagtaataattagtatttaataaggtggaggagcaagaaacacttgtggagtgtccarcgtgtgccaggtactatgctagattattggaattatacagattaataaaatctactaccctaacaatcccccaataagaaaaaaacaacataaatatagttataatacaatgtgcagtcgtagtcaatgtgtgaagctgtgagtgggtggggagttaggaatactttgtggagatgaaaatgattaagttgagccttaaagggtgagtaaaatttagccttttgaaggtagaggaaggggacagtggtagtcaggagagacaagaaggtacattggccttccatgtaccagaatcagagt

SEQ ID NO: 38155 - DNA, 601 bp, Human
gaggagcaagaaacacttgtggagtgtccaacgtgtgccaggtactatgctagattattggaattatacagattaataaaatctactaccctaacaatcccccaataagaaaaaaacaacataaatatagttataatacaatgtgcagtcgtagtcaatgtgtgaagctgtgagtgggtggggagttaggaatactttgtggagatgaaaatgattaagttgagccttaaagggtgagtaaaatttagccttttgaaggtagaggaaggggacagtggtagtcaggagagacaagaaggtrcattggccttccatgtaccagaatcagagtgcacaaagtcatggaaatgagaaatctttcagtgagtgcaggaaaatacaaacaatttgttgtttaggaagaaagtttgaagcaaggagaggtgagaaatgaggctaggagtagtagaataggataagatgaaagaccttgaatactgcattaaagagtttggggagtcagtgggggagtcattttcaccagaggaatagcaaagaggagtttttcatttgagtagatatttttggaaacttggaagataggattgagatggaattagac

SEQ ID NO: 38156 - DNA, 601 bp, Human
gagcaagaaacacttgtggagtgtccaacgtgtgccaggtactatgctagattattggaattatacagattaataaaatctactaccctaacaatcccccaataagaaaaaaacaacataaatatagttataatacaatgtgcagtcgtagtcaatgtgtgaagctgtgagtgggtggggagttaggaatactttgtggagatgaaaatgattaagttgagccttaaagggtgagtaaaatttagccttttgaaggtagaggaaggggacagtggtagtcaggagagacaagaaggtacaytggccttccatgtaccagaatcagagtgcacaaagtcatggaaatgagaaatctttcagtgagtgcaggaaaatacaaacaatttgttgtttaggaagaaagtttgaagcaaggagaggtgagaaatgaggctaggagtagtagaataggataagatgaaagaccttgaatactgcattaaagagtttggggagtcagtgggggagtcattttcaccagaggaatagcaaagaggagtttttcatttgagtagatatttttggaaacttggaagataggattgagatggaattagactac

SEQ ID NO: 38157 - DNA, 601 bp, Human
gcagccttgaactgctgggctcaagagatcccattgccttagccttccgagtagctgggactgcaggcatggaccacaacacctggaattttaattttttgtagagacgggttctcactgtgtggcccaggctggtctcaaactcctgggcttgagtaatcctccggcctcagcctcccaaagtgctgggattacaggcaggagcccctgtgcttggttgctactagccttttcaagggaggcagtctgccttaaaaaaaaaaaaagtctaaatgacgtatctagaagctcagtttcaaagctgtctgtaggctgtatatctttgaatatatatcgacttaaagctaagggcaaaactatttttctaggagttgttaatgtttaagacaatactaatctttaagaggctttggctacaaaacaaaataaatagttgagttcatatttttcttttcaaagcacatttctgatgtgacttcagagatttatcttcttaagattctccagttatccccaaatgttacttatttgctagagccatcagttattttaggacgaaacttaagaaataacttagaaaatgtctcaacaaatttgaaaa

SEQ ID NO: 38158 - DNA, 601 bp, Human
acttcagcaagatgaaccaccagcaaagaaaggtactacttcagctgccagcagcaggcgtttaagaaagctaatttctaaaccagtaaatagaacaaggcaaacagaggggcattcacttgtctaaggaaaaatcttgagaaaatctaaacgtcttgaatttttattctggaaagttatacattttctagggatgggcatagttaaagcttttatcttaataaatatgcttttagaaattgtgcttttattatttctttcgcagtctatgtaataatttctgtgcttataatagttaaaactcattactttgattttataaatatagtattttctgcctaaatcccagcacattattttgttttctttgtttgcattctttattcatttggagaaaaggatattttacagtaagactttgagctaaatattattaataataaatgtattcaagctgtatttgtgataccaggagacagtctgatgaaagataatacatgttgaagattattttttaaaaaatctttaatagtaactgggcaagtttgttgtaaatataaagaagggcaaacctttgaattttagaggaggtagactcttt

SEQ ID NO: 38159 - DNA, 601 bp, Human
tttttagtagagacagggtttcaccatgttggccaggatggtctcgatctcctgacctcgtgatccacccgcctctgcctcccaaagtgctgggattacaggcgtgagccaccgtgcccggccagaaagtagtaggtttcttaactagaaggatttcaagccaaacctacattataattgtcttctgctcttatagattagtaacccttgtacttcatattatatctgggatcattaaacaagaagaatttgattcttacatagtgaggatatcacataaaaatacaggttaattaaacaraaatggtcagtgagggagtgaatggcggtcagaagaacatatggaattgattgtattagagcaaagtcgtgtagaaaattcacataaaaattgtaccagaacaatgttgtaaagtctacttgcaaacatcatataaacatcaaaccatgaagtataacaaaacaggaaaaaatttctaaaaacgaagagtcagattctggcctgttttgaagtaaggtttcgaggatctgagacactcatctgacccttaatggaaattgtatgaaatataaaaagatatgtagatataaatttatatat

SEQ ID NO: 38160 - DNA, 601 bp, Human
aggtttcgaggatctgagacactcatctgacccttaatggaaattgtatgaaatataaaaagatatgtagatataaatttatatatctagaagattgttaattatatttcaagatttaatcatggaatctatgaggaaagtttaaaagaatataatttatactgggcacttacgtggggtgagtttatttgtcagagtgaacttatgaattaaattgtagctaatagtgtatctgttctgggtataatttgatctgtactgattataatggctaaagttcttacatgtatacaacatttaygtagtcatttaacttacattacgtattaactcattttagtctcttagcattattctgtagagtaagttgggcaggtaagggtatctttattctagcaatatacatattaagcctgaaaaaggcaaacttttatgcattttcaattagttgaatccttctgtacagattttcaggttctattaatagttaaatctatccaatgcacagtgtcgtcaacccatttgtcatcttgatcttcacaactttgagataggtggtattattcctatatcacatttgaggaaacagtcgtagtatgaa

SEQ ID NO: 38161 - DNA, 601 bp, Human
gattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggawctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagat

SEQ ID NO: 38162 - DNA, 601 bp, Human
atcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcrtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatataattttgtaaagattgttaccatttcacatgtatggtcctaagcagttaatgatgcattaccatagaaaagtggtttatgttttttagattgaaagaggaactctctgcaagctctgctcgtacccagaatctgaaagcagatcttcag

SEQ ID NO: 38163 - DNA, 601 bp, Human
ttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatayaattttgtaaagattgttaccatttcacatgtatggtcctaagcagttaatgatgcattaccatagaaaagtggtttatgttttttagattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtaggttatttgaaaagttatgtggccagtttatgataaagattgttttccttatatatcaaacttagacatt

SEQ ID NO: 38164 - DNA, 601 bp, Human
ctgaaagcagatcttcagaggaaggaagaagattatgctgacctgaaagagaaactgactgatgccaaaaagcagattaagcaagtacagaaagaggtaggttatttgaaaagttatgtggccagtttatgataaagattgttttccttatatatcaaacttagacattaatcttaggattgaatagaacatttatccactttataatttttcttaaaattacaagaacagttacttcacgagagaaaatttagctgatttaaacaagctgaagaatgtccaacattaagagaaatatgtrccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattt

SEQ ID NO: 38165 - DNA, 601 bp, Human
aagaacagttacttcacgagagaaaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatatttttta

SEQ ID NO: 38166 - DNA, 601 bp, Human
cagttacttcacgagagaaaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctc

SEQ ID NO: 38167 - DNA, 601 bp, Human
aaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttct

SEQ ID NO: 38168 - DNA, 601 bp, Human
tagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttctcaaac

SEQ ID NO: 38169 - DNA, 601 bp, Human
tgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttctcaaactttt

SEQ ID NO: 38170 - DNA, 601 bp, Human
cttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttctcaaacttttatttttcacatcatatttctgagattgattttgtacagtcgtaattaatcattttcacctctgtatagtattctgttgtgtgacttagcgcaatttatttagtctcttgttgatgacca

SEQ ID NO: 38171 - DNA, 601 bp, Human
aaccatattttttaatctctaaacagtattttcttctcaaacttttatttttcacatcatatttctgagattgattttgtacagtcgtaattaatcattttcacctctgtatagtattctgttgtgtgacttagcgcaatttatttagtctcttgttgatgaccatttagattgtttattattttttgcccatagccataatgcaaatatcttctatatgctcttggtacacatatgcaaaagtttatataccaagtggggaattactgtgttagaggatatgaagtgttatctcatggtrgttttaatttgcattcttttgattgctaatgaagtacagcttctattcatatttttatttctatttgtctatcccagtttctgctctgttgaagtcatttgttcattttaattgtgctgtcttttttttttttttttaaagtatgtagtttttatttttacttatttaaaaaaaatttactggtttattataaaggatacaactcaagaacagacaaatagaagggatacacaggacagattaagggggacagagggtggtgcagagcttctgtgccctctctgggtgtaccaccctcct

SEQ ID NO: 38172 - DNA, 601 bp, Human
aatttatttagtctcttgttgatgaccatttagattgtttattattttttgcccatagccataatgcaaatatcttctatatgctcttggtacacatatgcaaaagtttatataccaagtggggaattactgtgttagaggatatgaagtgttatctcatggtagttttaatttgcattcttttgattgctaatgaagtacagcttctattcatatttttatttctatttgtctatcccagtttctgctctgttgaagtcatttgttcattttaattgtgctgtcttttttttttttttttaaagtatgtagtttttatttttacttatttaaaaaaaatttactggtttattataaaggatacaactcaagaacagacaaatagaagggatacacaggacagattaagggggacagagggtggtgcagagcttctgtgccctctctgggtgtaccaccctcctaagacctcagtgtgctcaccaagtgggacactctctgaacctcactgtacaatagttctcatgactcaatctccaaccctcctctcttccacagagtttggtgggtgggactgaaatttccaactctaatcattttt

SEQ ID NO: 38173 - DNA, 601 bp, Human
tgtcttttttttttttttttaaagtatgtagtttttatttttacttatttaaaaaaaatttactggtttattataaaggatacaactcaagaacagacaaatagaagggatacacaggacagattaagggggacagagggtggtgcagagcttctgtgccctctctgggtgtaccaccctcctaagacctcagtgtgctcaccaagtgggacactctctgaacctcactgtacaatagttctcatgactcaatctccaaccctcctctcttccacagagtttggtgggtgggactgaaatktccaactctaatcatttttggtcttttggtgagtagccctacccttaagctatttcaaaggagcctccactcaaagctatttcattagcataaattcaggtgtgattaaaagggggctcttttttctaagtttatttattttgttttgggacagggtcttactctgtcacccaatctggagtgcagtggcgtgatcatagctcactgtaactttgaactcctgggctcaagtgatcctcccatctcagcctccctagtagctgagactacaggtgtgccaccatgccctagctcctttta

SEQ ID NO: 38174 - DNA, 601 bp, Human
tttcaagtatagatagcagtccccagcctttttggtaccagtgattggttttgtggaagacaatttttccatggaccagggtaggggctggctgctttaaggatgattcaaacacattacagttattgtgcactttatattattattacattgtaatatataatgaagcaattatacaattcaccataatgtagaatcagtgggagccctgagcttgttttcctacaactagacggtcccatctgggggtgatgggagacagtggcagatcagcaggcattagattctcataaggaatgcrcaacctaggttcattgcatgcagagttcacaatagggtttgcactcctatgagaatctaatgcctctgttgatctgacagtaggcggagctcaggcggtaatgtgagtgatggggagtggctgtaaatacagatgaagcttcactcccttgtctgccgctcacctcctgctgtgtggcccagttcctaacaagctatggatcagtatttgtctgtggccaggtggttgaggctccctcctcatatagatgactatttaacattactctaatgatgggtattaaaagtattttctatttct

SEQ ID NO: 38175 - DNA, 601 bp, Human
agtggcagatcagcaggcattagattctcataaggaatgcacaacctaggttcattgcatgcagagttcacaatagggtttgcactcctatgagaatctaatgcctctgttgatctgacagtaggcggagctcaggcggtaatgtgagtgatggggagtggctgtaaatacagatgaagcttcactcccttgtctgccgctcacctcctgctgtgtggcccagttcctaacaagctatggatcagtatttgtctgtggccaggtggttgaggctccctcctcatatagatgactatttaayattactctaatgatgggtattaaaagtattttctatttctcaaatgtgtagttttaaagcaaataataataattatagcaatttaatctaggccagctgctatgctgagttgacatattatcttaatcctcacacaatatcgggtatagacactgtttttaacttccattttgttgataagaaaacagacattgagggatacagtagtctccctttactggcagttttgctttctgtggtttcagttacctgtggccaaccatgagctgaaaatactaaatagaaattccaggaataaac

SEQ ID NO: 38176 - DNA, 601 bp, Human
cgctcacctcctgctgtgtggcccagttcctaacaagctatggatcagtatttgtctgtggccaggtggttgaggctccctcctcatatagatgactatttaacattactctaatgatgggtattaaaagtattttctatttctcaaatgtgtagttttaaagcaaataataataattatagcaatttaatctaggccagctgctatgctgagttgacatattatcttaatcctcacacaatatcgggtatagacactgtttttaacttccattttgttgataagaaaacagacattgagrgatacagtagtctccctttactggcagttttgctttctgtggtttcagttacctgtggccaaccatgagctgaaaatactaaatagaaattccaggaataaacagttcaattgcaggtcattctgagtagtgggtcaaaagcttgtgccatcctgtcctgcctggagttagaattatccctttgcctagcatatccacattgttagtgctacctattaatcacttagtcatctcaattatcagatcacgtgtcatggtatcagggacagtgtttgtgttcaagtaacttttattttactt

SEQ ID NO: 38177 - DNA, 601 bp, Human
ctcctcatatagatgactatttaacattactctaatgatgggtattaaaagtattttctatttctcaaatgtgtagttttaaagcaaataataataattatagcaatttaatctaggccagctgctatgctgagttgacatattatcttaatcctcacacaatatcgggtatagacactgtttttaacttccattttgttgataagaaaacagacattgagggatacagtagtctccctttactggcagttttgctttctgtggtttcagttacctgtggccaaccatgagctgaaaatastaaatagaaattccaggaataaacagttcaattgcaggtcattctgagtagtgggtcaaaagcttgtgccatcctgtcctgcctggagttagaattatccctttgcctagcatatccacattgttagtgctacctattaatcacttagtcatctcaattatcagatcacgtgtcatggtatcagggacagtgtttgtgttcaagtaacttttattttacttaataatggtctcaacatgcaaaagtagtgatgctggcaattcagataagccaaaatgttgttgtaaagggcttccttta

SEQ ID NO: 38178 - DNA, 601 bp, Human
atagacactgtttttaacttccattttgttgataagaaaacagacattgagggatacagtagtctccctttactggcagttttgctttctgtggtttcagttacctgtggccaaccatgagctgaaaatactaaatagaaattccaggaataaacagttcaattgcaggtcattctgagtagtgggtcaaaagcttgtgccatcctgtcctgcctggagttagaattatccctttgcctagcatatccacattgttagtgctacctattaatcacttagtcatctcaattatcagatcacstgtcatggtatcagggacagtgtttgtgttcaagtaacttttattttacttaataatggtctcaacatgcaaaagtagtgatgctggcaattcagataagccaaaatgttgttgtaaagggcttcctttaaatgaaaaggtaaaagttcttaacttaataaataaagaaaaaaaattgtaatctgaggttgctaagatctatggtaagaacaaatcttccatctgtgaaattgcgaagaagaaaaaagaaatttatgttagttttgctggtgcacctcactgcaaaagttatggccacaa

SEQ ID NO: 38179 - DNA, 601 bp, Human
cttgtctaagttcactcagtagtaagtgctagagccagaatggaaaccgaggcagtccttacatgcatctttgtgcagcacatagcctctattattgttagttatatagttgatgaagatggtgtttattacttgaagcctcatttttttaaacaaaattagcaaatattatgaatatgtgattatcatgtatgtattattggaacataaagcttaaaacaatgtaagaatcctctgaaaccataccactctgagctactataataagggcatcttcaagcctttttttttttttttttttgggcggagtctcactctgttgcccaggctggagtgcagtggcgtgatctcggctcactgcaacctccacctcccgggttcaagcaattcttctgcctcagtctcccgagtagctgggactacaggcacgtgccaccatgcccggctaatgttttttgtatttttagtagagatggggtttcactgtgttagccaggatggtctcgatctcctgacctcgtgatccacttgcctccgcctcccagagtgctggtattacaggcatgagccaccatgcccggccttctctatgctttttatg

SEQ ID NO: 38180 - DNA, 601 bp, Human
ctggagtgcagtggcgtgatctcggctcactgcaacctccacctcccgggttcaagcaattcttctgcctcagtctcccgagtagctgggactacaggcacgtgccaccatgcccggctaatgttttttgtatttttagtagagatggggtttcactgtgttagccaggatggtctcgatctcctgacctcgtgatccacttgcctccgcctcccagagtgctggtattacaggcatgagccaccatgcccggccttctctatgctttttatggggcatcttttcatttaatttccttccrtttttgagctctctagcgagtgtgaaaatggagttttggcagtaaagctccacaagggaatagaagagaaggctctgctgccagttagataacttccctctggaaatcctggcaagatgtactgaaaggtttcagagggggttggtatgatggaaactagtataaggatgtacctatattagcttttttgggtgagaaattaatatatatattagtccatagtacctcgatttccctacgtttatggcattagattaccggcaacagcagaaatcaattgaccttcacttgcgtgggtac

SEQ ID NO: 38181 - DNA, 601 bp, Human
tgggggtatgacttgcttcattggtgccctgcagctcaaacccctagggggagcatgcagacgggcaggtcttgagtgtgggctctgaccctgtggcagcatctggggttgagtgtttacagctcctgaaggccccagtgggcgtgttctacagggtgttttttcagcctagccgtccacaggcggcttgtgttaatcagctcaattagaccctctgccttattgcaaggacagagggctttctgtatcccgggattcttgctctagtgtactggaaaaatcggatcacacatgggcgtgkagaaggttttattgagtggagttagctctctgcagatgtatggggagccagaaggggatggagcgggaaggtggtcttgccctgggcggccggactctcctctgactgcccgcaaccaaattccgtgtcatctcacagtagatggcctgccagcatctgctggtatctgctggtgtgttcttccagtgtgttcctctagatgttcagctgcttgtgtgtgtgcctgccagggtctcagggtttttgtaggcacaggatgggggcgtggcaggccagggtggtcttgaaaaatgcaacatt

SEQ ID NO: 38182 - DNA, 601 bp, Human
aacatcacactgtggggactgttatggggtggggggagtggggagggatagcattgggatatatacctaatgctagatgacgagttagtgggtgcagcgcaccagcatgtcacatgtatacatatgtaactaacctgcacattgtgcacatgtaccctaaaacttaaagtataataataataataataaaatttttaaaaagctgcttaataatttagattcaaatcctaggtgctgaattatgaattatgcttttcttactcagattgtattgatttgttgtttgaaatattacaaaatkacttttttctttttgagacggagattcgctcttgtcatccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgacctcaggtgatccacccgccttggcctcccaaagtggtgggattacaggcttgagccaccgtgcctggccaca

SEQ ID NO: 38183 - DNA, 601 bp, Human
gtggggagggatagcattgggatatatacctaatgctagatgacgagttagtgggtgcagcgcaccagcatgtcacatgtatacatatgtaactaacctgcacattgtgcacatgtaccctaaaacttaaagtataataataataataataaaatttttaaaaagctgcttaataatttagattcaaatcctaggtgctgaattatgaattatgcttttcttactcagattgtattgatttgttgtttgaaatattacaaaattacttttttctttttgagacggagattcgctcttgtcrtccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgacctcaggtgatccacccgccttggcctcccaaagtggtgggattacaggcttgagccaccgtgcctggccacaaaatttcttttatagatgatacatatttctgttttta

SEQ ID NO: 38184 - DNA, 601 bp, Human
ctaggtgctgaattatgaattatgcttttcttactcagattgtattgatttgttgtttgaaatattacaaaattacttttttctttttgagacggagattcgctcttgtcatccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgrcctcaggtgatccacccgccttggcctcccaaagtggtgggattacaggcttgagccaccgtgcctggccacaaaatttcttttatagatgatacatatttctgtttttaaaatgatacagactcctctcctcctcattaccccttaacttctttgttctgtgagtggcagaactaggatttgaacccaggtgtgcttcactcttaagtctcagactctctttactaatccatgttatttgtacttggccaacaaaagaaagggtaacacaaccagattattacttatttagctgactta

SEQ ID NO: 38185 - DNA, 601 bp, Human
cggagattcgctcttgtcatccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgacctcaggtgatccacccgccttggcctcccaaagtggtgggattacaggcttgagccaccgtgcctggccacaaaatttcttttatagatgrtacatatttctgtttttaaaatgatacagactcctctcctcctcattaccccttaacttctttgttctgtgagtggcagaactaggatttgaacccaggtgtgcttcactcttaagtctcagactctctttactaatccatgttatttgtacttggccaacaaaagaaagggtaacacaaccagattattacttatttagctgacttatacattggtggggttaacttggatgggtaacttggatgtgaaaatatatctctgcacacagtactgttttcttctgcctttcttaggccttg

SEQ ID NO: 38186 - DNA, 601 bp, Human
caccgtgcctggccacaaaatttcttttatagatgatacatatttctgtttttaaaatgatacagactcctctcctcctcattaccccttaacttctttgttctgtgagtggcagaactaggatttgaacccaggtgtgcttcactcttaagtctcagactctctttactaatccatgttatttgtacttggccaacaaaagaaagggtaacacaaccagattattacttatttagctgacttatacattggtggggttaacttggatgggtaacttggatgtgaaaatatatctctgcayacagtactgttttcttctgcctttcttaggccttgtcaccctaacatctcctatttcataggaaatagttcatagctatcttttaggattcccctttactttggctcctttgtccctcttggtgaatgtggacacatcttagatactctggaaaagtctacccttggaccaggttgccctatagtttttatcatattttaatttttgttttctttgccaaatatggagaagtatggcataggcccaccgtgactattttaatctgacttccaccttttctatgcttctaagtcacttgta

SEQ ID NO: 38187 - DNA, 601 bp, Human
attgaagacatgcgaatgacactagaagaacaggaacaaactcaggtagaacaggatcaagtgcttgaggctaaattagaggaagttgaaaggctggccacaggtaaaacaagattgcttacatttctctaaatatactttttcatttaaaaaaaaatttcctagatttcttcccttgttaaagtagtacgtattttcagtgattgataatggaaaagtatttggtgttttttgaatgtcctattacttgtcattttccactgtgatgaaaattgtttcactaaaattatatgcagtaaaagagtaaggacactgcatgataacttacgaattatatattgcaagttatggatgataacttgcagtgttccctagatgttaagagtaagttttcaactgagtttcacctttgtcaggcttttagcattatcttgtatgttgatctcaataaatactttgatttcattgctttcagaataccatcagagtttttctagagtatatggaaaaatataacatttactaataaaaatgttatgtgtgattcttgtagaaagggcaagaaatttagaattaagaaattgtctagccattttatata

SEQ ID NO: 38188 - DNA, 601 bp, Human
gaacaaactcaggtagaacaggatcaagtgcttgaggctaaattagaggaagttgaaaggctggccacaggtaaaacaagattgcttacatttctctaaatatactttttcatttaaaaaaaaatttcctagatttcttcccttgttaaagtagtacgtattttcagtgattgataatggaaaagtatttggtgttttttgaatgtcctattacttgtcattttccactgtgatgaaaattgtttcactaaaattatatgcagtaaaggagtaaggacactgcatgataacttacgaattrtatattgcaagttatggatgataacttgcagtgttccctagatgttaagagtaagttttcaactgagtttcacctttgtcaggcttttagcattatcttgtatgttgatctcaataaatactttgatttcattgctttcagaataccatcagagtttttctagagtatatggaaaaatataacatttactaataaaaatgttatgtgtgattcttgtagaaagggcaagaaatttagaattaagaaattgtctagccattttatatataaccttggcagggtacttgtgcttactcagcc

SEQ ID NO: 38189 - DNA, 601 bp, Human
gatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccrtttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacatacaacatatgggggaaactttttttttcataggatttaccaaatactatttcattttgtacattttattagaagtggcattcataacagaagctgtag

SEQ ID NO: 38190 - DNA, 601 bp, Human
gattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacatacaacatatgggggaaactttttttttcrtaggatttaccaaatactatttcattttgtacattttattagaagtggcattcataacagaagctgtaggattgaaggaaacataatagttttgggagattgtctgcctctaaattttttaaaattctggctgtgtattaaacatatgctgaaaacaaatacaaaaactactttttttgttacatattatatattctagaatttacccttttcattgtgaaattccaaaagcagttagaacaaaataaatattatgaaaaaagtgtatcaaccgtattgagaatgtttgcattaaaaagt

SEQ ID NO: 38191 - DNA, 601 bp, Human
ttgtatatctgaacacatataaaactatactatatagaaggtattctattttgtgtgtgtgtgtttttttcttgttcagctttaacatacaacatatgggggaaactttttttttcataggatttaccaaatactatttcattttgtacattttattagaagtggcattcataacagaagctgtaggattgaaggaaacataatagttttgggagattgtctgcctctaaattttttaaaattctggctgtgtattaaacatatgctgaaaacaaatacaaaaactactttttttgttacrtattatatattctagaatttacccttttcattgtgaaattccaaaagcagttagaacaaaataaatattatgaaaaaagtgtatcaaccgtattgagaatgtttgcattaaaaagtatttgtgtattttgcattgttctaagatgatgtaatcacattagtgtagattataaactttgtaatcctggaatggactgccatactttgtaatatagtgattttagaagttttcttttcgtttttttgagacggaatcttgctctgttgccaggctggagtgcagtgacgtgatctcggctca

SEQ ID NO: 38192 - DNA, 601 bp, Human
gaacaaaataaatattatgaaaaaagtgtatcaaccgtattgagaatgtttgcattaaaaagtatttgtgtattttgcattgttctaagatgatgtaatcacattagtgtagattataaactttgtaatcctggaatggactgccatactttgtaatatagtgattttagaagttttcttttcgtttttttgagacggaatcttgctctgttgccaggctggagtgcagtgacgtgatctcggctcactgcagcctccaccccctgggttcaagcgattctcctgcctcagcctcccgagyagctgggactacaggtacacgccagctcgcccagctaatttttttgtattagtagagatggggtttcaccatgttggccagggtggtcttgatctcctgacctcgtgatccgcccaccttggcctcccaaactgctggaattacgggcgtgagccaccgcacccagcctagaagttttttaagtggtattattatttttatttcaaatgaagttctacttgggttttttatatatattattaaatgcctctgaacccaaagaatctgtggtaccagtttgaaaattactgatcagcagta

SEQ ID NO: 38193 - DNA, 601 bp, Human
cctcccctccctcccctttcctttttcctttccttcttccttttcttcatcctgtcctccttcttcctttccttcctttctcctttcccttccccgtgcccatccccttccccttccctttccctttcccttttctttcctcttttaaagagacaaggtcttgttctgtcacccaggctggaatgcagtggtgcagtcatggctcactgccgcctcagacttcagggcaaaagcaatctttccagctcagcctcccaagtaactgggactacaggcacatgccaccacacctaggtaaatyttttattttttgtagggacagagacttgctgtgttgcccaggctggtctcaaactcctggtctcaagcagtcctcctgcctcagcttcccccaagtgttgggattatgggtgtgagccactgtgcattgtacccggcctgaaatgttaattttcaataaggtaaggacagtttttccactttttttcttccctagctttaaagctgcttttaacattgaatattgaacagagttggccagtttttattaaaatgaggctgttgtgagctaaactttccagcatgcttgctaaactccaga

SEQ ID NO: 38194 - DNA, 601 bp, Human
ccaaggacttgaagatggtgtgttatattatttcctgaaagctttgaagttttttatctttcatatttagatactagaattgatttttgtgttggtgtgagatagtggtcaaagctcttgatgtttgttttaatgtgaattaccaattgatgtggaaatatttattgaaaagactgtttctttctcactgctgtgccacttttgtcgtaaatcatttgcccacgggttaattttgtatgtgttgtaagattagggttggggttctttttttttttcatttggttattctgttgttccagcmccatttattgggaagattgtccttccttttatttaatttttttgccacttttttaagtcagttgaccatgcatttgtagatcgtctcttctgtcccattgatttctctgtctttacatgctgtcttgattattgtgctaacttgaaattatagataattgctgtcattttgttcttcattttcaaaataattttgagtattctagatgatttgcatctccatataatttttagagtcaccttttccatttccacacacattcacacatacctgaattttgataaaaactgcttttactct

SEQ ID NO: 38195 - DNA, 601 bp, Human
tgctgtcattttgttcttcattttcaaaataattttgagtattctagatgatttgcatctccatataatttttagagtcaccttttccatttccacacacattcacacatacctgaattttgataaaaactgcttttactctctagatctatttggaggagacatcttaacaatattgagtattttgatccttcaacacagaccaatctctctatttatttaggtgttctttaatctctttcagcagtattttatggttttatacattttctttatcagtatttcatgatttttgaacctrttgtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagccgatttttggaatgagatgggatatggataaaaataacatggacatttaatttataaaatgatatgtgttgttttatagttaaatattttatctagactacttaatttgtcttgtaatcttgtttgcagctatatttatggtgttac

SEQ ID NO: 38196 - DNA, 601 bp, Human
ggaggagacatcttaacaatattgagtattttgatccttcaacacagaccaatctctctatttatttaggtgttctttaatctctttcagcagtattttatggttttatacattttctttatcagtatttcatgatttttgaacctgttgtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagcygatttttggaatgagatgggatatggataaaaataacatggacatttaatttataaaatgatatgtgttgttttatagttaaatattttatctagactacttaatttgtcttgtaatcttgtttgcagctatatttatggtgttacatgtaataatttctaaacattcttagattcataatatatcaaggttgattttaatattttctttatttcctgattaggaaatactgacagcccagctgacagagaaagatagtgaccttcaaaagtggcgagaagaacgagatcaactggttgc

SEQ ID NO: 38197 - DNA, 601 bp, Human
gtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagccgatttttggaatgagatgggatatggataaaaataacatggacatttaatttataaaatgatatgtgttgttttatagttaaatattttatctagactacttaatttgtcttgtaatcttgtttgcagctatatttatggtgttacatrtaataatttctaaacattcttagattcataatatatcaaggttgattttaatattttctttatttcctgattaggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagtcagtagtcttttttgctatgcctttttaattgaacatagtaattact

SEQ ID NO: 38198 - DNA, 601 bp, Human
ataaagatacaaattattttgaaagtaagcctaatggtagagagacattatgagtcattcagctgttacttttatattaccttgagactggaaatcctgaaagaggagagaattgccttttacagatagctgcttcccagtaaatagaatctgggtacatctgaagctagtctttctggaataatctgtacttaaaaatcttctgctttaaagccttcagacaataggaaaaatatgtatgtgtgtgtcacatcaaaagactattattgtaagagagattacttgctttaaaaagaggtaktattgtgttgtttaataatatatcctagaaagtcagaaaaactaggtatcaactgctgtcgctgtggttttgggacctttgagaagaattacttaacatttctgatctttatctaaaacaggtaatagtgttttcctaacagagttgtgaaattaatgaagattgtaaaacaagtagcacagttcttactccagtggaaatcaatatatgctagttactttcccttttatgaattcagtagagtctttcttatttggcagtaatggggaggtgacataagaggtttacttgacttttgat

SEQ ID NO: 38199 - DNA, 601 bp, Human
caaacgtattagttcagcagatcctgacaaacttcaaactgaacctctatcgacaagttttgaaatttccagaaataaaatagaggtgggtatttggcagcacagtccacttatttattctctttatccactattactaaataacacgtacaagtaagttgctgaagataccttactgcacaattagctgtgtgtgctctgggctgtgtgaaagaaactagaggcttttgaggagaggtgaaattcttttgggagattatatgcccaaatgatgttaatctcatcttaaaagcagtagatytgttaatagaaacaaacttgatggtcagaaataggaaatcctactaatgagaaaatagggataatttgctctcataaaaggttgctttaataaacattgtgttaaatagtattttttggaattgtatccatttagtagctttgtcaccagtcttcaataacaactcgtgagtttccttaatttgtattgggcttagggttctgtgaataactttggataatatagagattcttaggttggatatgaaatagataaaaattctatgttacttaaaatttttgaagataaaattacttttta

SEQ ID NO: 38200 - DNA, 601 bp, Human
tcaatgggaagagtagcaaagtatttgcagcctacttctttaatataaccaggctgtttgtcaaagatctcagcctcctcccttggagatttctgatttactgggtttgtggtagagtccaggagtcttttaaacaaattctgtaagtaattcttatgatcatacaagtttgggaaatagcgatgttacccctaattttaacataccatgtgtgagcctgaagaaagtagatgattgctcaatctttctgttcttgctgtgatctagcacgctttttgtctttcccaatgcattgtcttgrataggcatttgagagaattaattctttgtggtttataaatgtatactctacaaataatatttttccttttacattctgttgtaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggtaaatacttaactgatg

SEQ ID NO: 38201 - DNA, 601 bp, Human
ttgtagagtttctgccgagagatccgctgttagtctgatgggcttccctttgtgggtaacccgacctttctctttggctccccttaacattttttccttcattttgactttgctgaatctgacaattatgtgtcttggagttgctcttctcgaggagtatctttgtggcgttctctgtatttcctgaatctgaatgttggcctgccttgctagattgaggaagttctcctggataatatcctgcagaatgttttccaacttggttccattctccccgtcactttcaggtacaccaatcagrcatagatttggtcttttcacatagtcccatatttctcagaggctttgtttgtttctttttattcttttttctctaaacttcccttctcgcttcatttcattcatttcatctaaaaagcagagcgcctctcctcctccaaaggaatgcagttcctcaccagcaatggaacaaagctggaaggagaatgactttgacaaattgagagaagaaggcttcagacgatcaaactactccgagctacaggaggaaattcaaaccaaaggcaaagaagttgaaaactttgaaaaaaatttagactaa

SEQ ID NO: 38202 - DNA, 601 bp, Human
gtggcgttctctgtatttcctgaatctgaatgttggcctgccttgctagattgaggaagttctcctggataatatcctgcagaatgttttccaacttggttccattctccccgtcactttcaggtacaccaatcagacatagatttggtcttttcacatagtcccatatttctcagaggctttgtttgtttctttttattcttttttctctaaacttcccttctcgcttcatttcattcatttcatctaaaaagcagagcgcctctcctcctccaaaggaatgcagttcctcaccagcaayggaacaaagctggaaggagaatgactttgacaaattgagagaagaaggcttcagacgatcaaactactccgagctacaggaggaaattcaaaccaaaggcaaagaagttgaaaactttgaaaaaaatttagactaatgtataactagaaaaaccaatacagagaagtgcttaaaggatctgatggagctgaaagccaaggctcaagaactacgtgaagaatgcagaagcctcaggagccgatgcagtcaactgggagaaagggtatcagtaatacttatttttaaagtaacttgttttaa

SEQ ID NO: 38203 - DNA, 601 bp, Human
cactttcaggtacaccaatcagacatagatttggtcttttcacatagtcccatatttctcagaggctttgtttgtttctttttattcttttttctctaaacttcccttctcgcttcatttcattcatttcatctaaaaagcagagcgcctctcctcctccaaaggaatgcagttcctcaccagcaatggaacaaagctggaaggagaatgactttgacaaattgagagaagaaggcttcagacgatcaaactactccgagctacaggaggaaattcaaaccaaaggcaaagaagttgaaawctttgaaaaaaatttagactaatgtataactagaaaaaccaatacagagaagtgcttaaaggatctgatggagctgaaagccaaggctcaagaactacgtgaagaatgcagaagcctcaggagccgatgcagtcaactgggagaaagggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaacta

SEQ ID NO: 38204 - DNA, 601 bp, Human
agtgcttaaaggatctgatggagctgaaagccaaggctcaagaactacgtgaagaatgcagaagcctcaggagccgatgcagtcaactgggagaaagggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaactatactcctgaggctctctgtcaggtaataattttgctgagtgaatattattyagcatagtttttctgctacacatgtaacacctttagagattgttttatggagtcttactagttaacttttgttttatatttatttaattttttaaaataacattaaaacactgagtttcatcatctagttggctttttcttgatccattttttttcaacgaagaaggaaacaccgagtgtagttctcaagaaggttaaaatataaatattttattaattttactattggcatatatccctcatgtatatttcagaaaagatttacagattgttgtagatacatcatgtagaaactttaaa

SEQ ID NO: 38205 - DNA, 601 bp, Human
caggagccgatgcagtcaactgggagaaagggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaactatactcctgaggctctctgtcaggtaataattttgctgagtgaatattattcagcatagtttttctgctacacatgtaacacctttagagattgttttatggagtcttactagttaacktttgttttatatttatttaattttttaaaataacattaaaacactgagtttcatcatctagttggctttttcttgatccattttttttcaacgaagaaggaaacaccgagtgtagttctcaagaaggttaaaatataaatattttattaattttactattggcatatatccctcatgtatatttcagaaaagatttacagattgttgtagatacatcatgtagaaactttaaattttctaactgattttactcaatcttcactgctataataaactaagtacatgggcccccatgaaaat

SEQ ID NO: 38206 - DNA, 601 bp, Human
gctgcacccatcagtctgtcacctacattaggtatttctcctaatgctatccctcccctagccccccaccccccgacaggctatattctaatccagtgaagactccaaagagctccttactgaccactatgtgtggaggtagcctcatggtctcttttcacttgcatcctatgattaccatctgtcttttccctgtcatggtgtctgcttcttatgacccttataacttctgctttgtaatttggattctgaggttcagtcatgatcttttctctgcttctcttcttgccccctttttccygaacttttatctttggtacaactaggatttgcagcagttcaagtcagtgagtatatctgtaaagggctttgtcctatgtgaggttatttggggaaaagaagagtaagatgccatacccatgttgtagagaagaaagataatattttaaaagttttaacattttacctttggttatttgaagtttcgtttttattttatttttgatattgtcaaatgtcaatgagagaacttagacatagatgcttgtattatttgggagttaggcaataggtaggtatattgtatgctgtattttaaagc

SEQ ID NO: 38207 - DNA, 601 bp, Human
ccagaactaatttgaaatttcctatttcagatgatagaaattcttctgtcaaaaaggaacaaaaggtgtgtcttttaatttgtccaaaattgtagcaattatccagaaatccagttgtgttcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttatatacttaaagtttyctacctgagaattcataacctgtctctggcctctttaattcagctgtggccataactatttccttctaacacttctcatcaacaataacaaaaaatgttttgtttattaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttaga

SEQ ID NO: 38208 - DNA, 601 bp, Human
aacaaaaggtgtgtcttttaatttgtccaaaattgtagcaattatccagaaatccagttgtgttcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttatatacttaaagtttcctacctgagaattcataacctgtctctggcctctttaattcagctgtggccataacyatttccttctaacacttctcatcaacaataacaaaaaatgttttgtttattaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaat

SEQ ID NO: 38209 - DNA, 601 bp, Human
tcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttatatacttaaagtttcctacctgagaattcataacctgtctctggcctctttaattcagctgtggccataactatttccttctaacacttctcatcaacaataacaaaaaatgttttgtttattaggttgccataygtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaatattatacttcaaataggcattgtcctatactaggtactgtgggaagaaacatgtaaaaggatg

SEQ ID NO: 38210 - DNA, 601 bp, Human
gtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaatattatacttcaaataggcattgtcctatactaggtactgtgggaagaaacatgtaaaaggatgatagatctaggtgttcgctatgtagtagaagagaaaggcttgtatttaagtaaytgatccagagcaggctacttaatatagtaataggggtataagcaaaggtatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagtttctgtttttggttggggcaggaaatccccttcctcatccctgttttctgcttatcactagagacagaaactaaaaaccatggcttcaggccgctaaa

SEQ ID NO: 38211 - DNA, 601 bp, Human
attgtcctatactaggtactgtgggaagaaacatgtaaaaggatgatagatctaggtgttcgctatgtagtagaagagaaaggcttgtatttaagtaactgatccagagcaggctacttaatatagtaataggggtataagcaaaggtatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagyttctgtttttggttggggcaggaaatccccttcctcatccctgttttctgcttatcactagagacagaaactaaaaaccatggcttcaggccgctaaaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcag

SEQ ID NO: 38212 - DNA, 601 bp, Human
aagtaactgatccagagcaggctacttaatatagtaataggggtataagcaaaggtatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagtttctgtttttggttggggcaggaaatccccttcctcatccctgttttctgcttatcactagagacagaaactaaaaaccatggcttcaggcygctaaaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcaca

SEQ ID NO: 38213 - DNA, 601 bp, Human
aaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcacatatgyggaaggaatggttttaacacaggtggagtatcagaaaaatgtaggaaatgttcatgcaattacaggcagcaatacacatctggcatgtagaatgtggaaggactatcttaggggtgagatggagtagtgggtttttgtgaggttacctgaatgacagcaataggatgaattagagaccagagtgaggggtatagggaaggaaaggaactagaagcagggggcagttaaattgaatcaaatatgttgtgtgaaaatactttttgtcgaaggcttaccacagacgtttccaaactttgttgg

SEQ ID NO: 38214 - DNA, 601 bp, Human
aaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcacatatgcggaaggaatggttttaacacaggtggartatcagaaaaatgtaggaaatgttcatgcaattacaggcagcaatacacatctggcatgtagaatgtggaaggactatcttaggggtgagatggagtagtgggtttttgtgaggttacctgaatgacagcaataggatgaattagagaccagagtgaggggtatagggaaggaaaggaactagaagcagggggcagttaaattgaatcaaatatgttgtgtgaaaatactttttgtcgaaggcttaccacagacgtttccaaactttgttggttcacagtgcccttaatgtctcagtaat

SEQ ID NO: 38215 - DNA, 601 bp, Human
agttcctagaatttgccagcttctttcttaccttcatatcattgatttcttttgctttttcctgtgctttcttttatctggaacacaccctggcttttgtcttagctggccccttacccttgagccctcatagctgatggaacgttattagggagacaccttccttcatcaccctgtcactacccctcatccccagcatcacttaatctttattattcaatcctattttttgtcttagcactttttaaactgtaattctttgctttcttattatcttttacactagaatataatctgcacagacaaaatgtctgtctagttcatactgtcagctcttagtatagtggctagcacatagtagtgatgagtttggctctaggccaacatatgtatgatttttaaacatttctattttttttaggctgtaccataggcaattacaaagacttacctgacaagcttcccttcctacaccagacttgatgcatagccaatgcattataatctcttaagggagttatagtcaaggatccagcatcccccaagctagtcatgctcttactcatatttgcatatttagcctgagtgcctccattcagag

SEQ ID NO: 38216 - DNA, 601 bp, Human
agggggaaccttgaagacgcttttctccactgtaactcggtacttttccacgtatagctccctccaacctccagccctgaggtctataaaactgcgagagccttttgtttggggctgcctgggtggtaaaatgaccaccacttctatgctgatctgtattattctgtggtggactatagaagagggtgggtaggagctggtgctttctcaggtttagtctctcgcatatactgttgaaataagtggttaaaaagctgggttgttactttcattttggcttgttgtcttaactggcttctcsgatacctggactctcagctctctcaagcccagctcagcccttaacaagtagtcttctcaatttagtctaatgccttaaatgttttttctatttaaaaaaaaaatttgatatcacatgtgtgtgaatttctatccaggaattttcccacatggaaatatgttttctattaaaaaaaagtactatgtactatgtacatagtaaggaatttaaaaattcctattctacttccctaaaagcaatcagctgttaacagtttggtttctctccatttgtgtgtggacttgaagtaaagggtttaca

SEQ ID NO: 38217 - DNA, 601 bp, Human
tttgtttggggctgcctgggtggtaaaatgaccaccacttctatgctgatctgtattattctgtggtggactatagaagagggtgggtaggagctggtgctttctcaggtttagtctctcgcatatactgttgaaataagtggttaaaaagctgggttgttactttcattttggcttgttgtcttaactggcttctccgatacctggactctcagctctctcaagcccagctcagcccttaacaagtagtcttctcaatttagtctaatgccttaaatgttttttctatttaaaaaaaaattttgatatcacatgtgtgtgaatttctatccaggaattttcccacatggaaatatgttttctattaaaaaaaagtactatgtactatgtacatagtaaggaatttaaaaattcctattctacttccctaaaagcaatcagctgttaacagtttggtttctctccatttgtgtgtggacttgaagtaaagggtttacaaagtattttcatgcagcattcattgtgcataactttatgcatgagcattgaactagatcatctaccaccttatttttaatgctgcatgatccactatgtatat

SEQ ID NO: 38218 - DNA, 601 bp, Human
tctattaaaaaaaagtactatgtactatgtacatagtaaggaatttaaaaattcctattctacttccctaaaagcaatcagctgttaacagtttggtttctctccatttgtgtgtggacttgaagtaaagggtttacaaagtattttcatgcagcattcattgtgcataactttatgcatgagcattgaactagatcatctaccaccttatttttaatgctgcatgatccactatgtatatatcctgctcttttgcttaacatagcataaacattttccaagtcattaaagatgcctgagrttttttactacattgaacattaatcaaatgatactttatttgctttttttttgctgtcaatcattatttcatgttctcttgacatttactttttttctttgtgatttgtctattcatgccctttcaccatatatatattgcagtgtttttagtttgtgtatgttcattctttattaaggatttcaaaccatctttattaaggatttcaaatcacctttgcaattagaaaattatttcaggaactaattaacaattttattttatagcaaagaagataattgaaacaatgagctcttcaaa

SEQ ID NO: 38219 - DNA, 601 bp, Human
ctacttccctaaaagcaatcagctgttaacagtttggtttctctccatttgtgtgtggacttgaagtaaagggtttacaaagtattttcatgcagcattcattgtgcataactttatgcatgagcattgaactagatcatctaccaccttatttttaatgctgcatgatccactatgtatatatcctgctcttttgcttaacatagcataaacattttccaagtcattaaagatgcctgagattttttactacattgaacattaatcaaatgatactttatttgctttttttttgctgtcratcattatttcatgttctcttgacatttactttttttctttgtgatttgtctattcatgccctttcaccatatatatattgcagtgtttttagtttgtgtatgttcattctttattaaggatttcaaaccatctttattaaggatttcaaatcacctttgcaattagaaaattatttcaggaactaattaacaattttattttatagcaaagaagataattgaaacaatgagctcttcaaagctctcaaatgtagaagcaagtaaagaaaatgtgtctcaaccaaaacgagccaaacgga

SEQ ID NO: 38220 - DNA, 601 bp, Human
tgcttaacatagcataaacattttccaagtcattaaagatgcctgagattttttactacattgaacattaatcaaatgatactttatttgctttttttttgctgtcaatcattatttcatgttctcttgacatttactttttttctttgtgatttgtctattcatgccctttcaccatatatatattgcagtgtttttagtttgtgtatgttcattctttattaaggatttcaaaccatctttattaaggatttcaaatcacctttgcaattagaaaattatttcaggaactaattaacawttttattttatagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtggtaagctagtatttctgttttcatcaatgtagaactgttcgtgttctttttaattttttacagtggtttgaatttcaattctttagatctctgaaaacacatgctataaaggtcatgcttttagtctcacatgtgttaagttta

SEQ ID NO: 38221 - DNA, 601 bp, Human
ttaagtttatactaattaaatataaatactgtattaaatgtatataagcgtcatgcatttgcatttgaaaatgcatcagaggaatttatttccaataatagaattgtcaccatttagtaacttatttgcctccacaatctttttttctttttctttctcttttttaaatcacgggagttgtacaaatctgggcccaagtgttcctggtaaaaatataaaactgacattcagccatttcctcccacctttcccctaagcctttgaggatctattaggaagagactgtagttatcaccctgastctatgattcattctcctgattcagaacagtatgtgctgtcacagggaaagctcaaattttctgtcatgcttgcatttgcttagtggatgaaagtgaaggtaaaaaaataattaaaagaaattaaaaaaattaaaaagaagtggccaagaaaaatcaggagaaaccttttttgccacaagagctttcagatatgagattgacacttgaatgcaagatgtaaagagttagggtaaattagggcatggtgttgtaagtaccattctgtcagtcatttttgagcatctgtttgattagtacct

SEQ ID NO: 38222 - DNA, 601 bp, Human
aaaattaaaaagaagtggccaagaaaaatcaggagaaaccttttttgccacaagagctttcagatatgagattgacacttgaatgcaagatgtaaagagttagggtaaattagggcatggtgttgtaagtaccattctgtcagtcatttttgagcatctgtttgattagtacctgatttcttcccttggctgaaaattgttttcttagttactatataatgtgctttctactttctaagttatacatttgttgccacgaaagatcatttcttaaaaattatttgaggcacttgtctccaamtattttagtaattattttaagttatatctgccttgaattcaatatggagtctaggttattttacttctagaatttgatagtgttgaatcttttacaaagtctgttttttaaataaatttttatagaagatggcatatctgtagtctaagtaaaaaaaattctccaatgtatcatttcagttactaagcacatgaacatgtcttactcattataaacaagcttttatttttattttcacttacaagctttgaaaaactatgaaatttttaatttcagattttaatggaccagaaaatgaag

SEQ ID NO: 38223 - DNA, 601 bp, Human
gacaagcagcccagtcacacctgtgactgatgggcctcagcctggcctggcctcaacactcctgggctcccaatgtctcactgctctttagctggagaggacctgctaaactgcagcagggcacttgggaagatcctgggctttggtgtcccacaaatctgagttggaatcatgccattgatcaatgctacttgatctgcctgtgttttatgtctctaaattggaagccatgcccctccaactgggttgtgggaaataacatacaatgatgggtgtgacacgcggcctgctccttccctckactccccaagggttttggagcgagctggcctcctccacctctctaacttccatcagtctctgcagtgacctgcccgcctgtgctcctctggctcactgctgttgttttctgctgactatggattatttttccccctgtctccttttcatcacctccttgcatcccaacaaccctcccaggctttcctgttgtgctcaaatccccatttccttagccttccctggcagttgagctcagcggtgtatgctttgggtggggtgtggggagggagagcaggctccctttcctcctccaggctgg

SEQ ID NO: 38224 - DNA, 601 bp, Human
gctatatttaggggccaccccacactctcaggtagggagtgaaacttgtagctcagtgactgagtattctaaaggacagggtaccaaaagacgggactgtgagagttcacaattgaccatgaccttcaattaaagccccaaagtcggcagctcaaagggggctaaaaatgaccaaagcaacatgaccaatgggggaggtggggaaaacaacataaaagggacatctgtccaaccaacccaatgcctcccttcctcccaagacccttcctcccaactctgaataaactccgcaagttcaacrttagtgggtgaggagcagagcacctggacagacctgcacaggaaggagcctgcagcctgcggggtggggtcacttactgggctcctattggctggatgcagtgggattaggggtcagggttctcactccttctgactctggggtctgagaaaacacagcaacgaggtgaatgacatgggagacagacctggggtcttttagggacggaaagcctcagccaagacccagactcccagggtcatcaacctcctcgggtcactaaccctccccagtgtctgtctacccctaagtccagagaac

SEQ ID NO: 38225 - DNA, 601 bp, Human
agcccctcctcccaccttgggactgcccccacactgttacctgtccctggtccaggaggattcgggcagctaactcagcctcctggagagacacacacggattcacacagaaacacatgaccatgtggcgtcccagatggagagacaaacagacaaagagaggcaagtaaagacagaccaacaaatgaccaaagacagaaagagattgacaaagagagacacggaaaggatgaaggttagtgtagtgacgagacaagggcctgactcccaattatagtgtatggggagagagactagggtrgtggtgaagcagtggtgtgagttagaataagatcagtacgcttgggaagttagaaggcaagggggatgcttagaggtctggaatttgggcatgggagtcaaacggtctctaataaccttggccgcctcaggcgtctgtcctggcaacagtggcttctcctctgtgatctgcacctcctgcagctccgccatggtggcctggcaggatgaggaaatgagactgggaagttgtctctacatccccacatcgcctcaaacaccaggcttcctctctcagcacaggaagatgcagggaacagag

SEQ ID NO: 38226 - DNA, 601 bp, Human
ttagagagagaagaggaggggaaggaaggagaggggagagatagggaagggaaaggactagaatagaaggaaagaaagcaaagagagaagagagggccaagcagaggccatccttctactggggaagaggacagcccctcctcccaccttgggactgcccccacactgttacctgtccctggtccaggaggattcgggcagctaactcagcctcctggagagacacacacggattcacacagaaacacatgaccatgtggcgtcccagatggagagacaaacagacaaagagaggcaagtraagacagaccaacaaatgaccaaagacagaaagagattgacaaagagagacacggaaaggatgaaggttagtgtagtgacgagacaagggcctgactcccaattatagtgtatggggagagagactagggtagtggtgaagcagtggtgtgagttagaataagatcagtacgcttgggaagttagaaggcaagggggatgcttagaggtctggaatttgggcatgggagtcaaacggtctctaataaccttggccgcctcaggcgtctgtcctggcaacagtggcttctcctctgtgatc

SEQ ID NO: 38227 - DNA, 601 bp, Human
aagacacttggtctggtgttctcttccttccccaactctctctcacccgcagagctccccatccaccaggtgtgggcatgaaggagaggggagtgggagagaaagagacaggtctatctggttcctcagggattatgtcaccccctttcattcctccctgactttctgatcagagaaggccctccttagcctgaggcagggccaagcatagacccttttccttccctccacccattagggctattctgttgactctggccaattttccaaacccaccaccttttctcaataatcaaggcgsgagcatgaaggaagaagatatattgagttcagaagctgaaactggctcaggaaccacggtgaacctggaagttctaagggtctccttgtgctggaaagagaactctggtttggaggggttcccaggcctctcactttaggtactgcaggacgcaagggatcatgtctgcaagctggtccagagatgggtactgatatctggaaaagagaggcatgttaaggaagataccaacctgccctcacaccccccacctcaggatgtcctactcattctctcccagaatcaccactgccctccctt

SEQ ID NO: 38228 - DNA, 601 bp, Human
gagggacagcagaaggaaggaaatgagaaacagggcatggccttatcccctccccgctaagctcgacccactcctggactcccacagggcctgactccccacctagtgcccacttcctcccccaaacagcactaataaacagtattctcctaatcagtctggaccctcctttccctcctctgggctttttatttcttacagcatatctcgccaggatgtaggctccagctccaacaccaactccaattattgtagagaaactgtgaaagggaaagaaatatacgcctcatgggatctgctrtccaaaacctgccacagcccatctcttcaaactcttcaccctccctcctgagtccacgggcacaaagaaaggcagacacggacctttctttggaggacgcgaaaaagaagggcccaagaagccaaaggttggcacgggtagtcagggtagatacctgaagtctatccccagctttctgctggagagctagtgtcttaaaaacaaacacccatccaccagccaaccaacacactgttttcccatatagatagctctttgtccattctcaattttcaagagccagttcaacttgttctgctt

SEQ ID NO: 38229 - DNA, 601 bp, Human
gtgagaaagttcagggtattggccaggcacagtggctcacgtctgtaatcccagcactttgggaggccgaggcgggtggatcacgaggtcaggagttcaagaccaccctggccaagatggtgaaaccccatctctactaataatacaaatattagccaggcgtggtggcgggtgcctgtaatcccagctacttgggaggctgaggcaggagaatcacttgaacccaggaagcagaggttgcagtgagccaagatcaagccactgcactccagccttggcaacagagtgagacaccatctcaaaaaaaaaaaaaaaagaaaaagaaaaagaaagttcaggatattataagagactcaggcaaagtgacagcttcactttcctgcccctttactccctccttgaagttcagagtccatccagttaggctatctaccagagcctaactggatccatacgaggggatccccaaccgtaggtctcagcacacaggcccctccaaaccttgtgggctgcccaatccatccaacccttggcattgggatcaatgttgatgaggacaagaccttcaacagtgtccgggtggttaagctgagggacagca

SEQ ID NO: 38230 - DNA, 601 bp, Human
caattactgcttctgcatttctctcacatgcatacacacacagcccacccacttgttgtagctgttccagtacaattcaatgttatccaggttgggtgcatgtgtaatgatatttctgtacttttgtatcaactcagaatttccagagagctcttcctgaaggagagaacaaggagaaaaattagggatggaaagagaaaacaacaattactggaggaaaagaggtaagccttcttccttccccaaatcctgtcccagctaaggaagttagcccaagcattcaagttccctgctgctcccstcgactcttctacatctcctacacccacttacctggctgaaaagatgtccaaggatcatctccggaatggaagaggtgaggcctgttagctatgaggagaaggcaggtgagaaagttcagggtattggccaggcacagtggctcacgtctgtaatcccagcactttgggaggccgaggcgggtggatcacgaggtcaggagttcaagaccaccctggccaagatggtgaaaccccatctctactaataatacaaatattagccaggcgtggtggcgggtgcctgtaatcccagctacttg

SEQ ID NO: 38231 - DNA, 601 bp, Human
tcactgtagcccatgccttgcaggaagtacttgaaggcctcggtcagcttgcctggctgcggaagtaagaagaggcgagggagacggtgagatgaggttagaggaagagctggagcctgaggctgcggcactgtggggccgggtgtgtggcaaagggcagagcccagtgccaccggtatcctatgtcccttccccatcccatggacggcagcggcactcacctgagtcagctggggctgacctccggagtcagccatctgttcaggagagcaccacccagaaaaagtgaaacacacataartgagccatgcagagaggtggaaagggtctctcttccctagcttcttcactctagcccctttgttttgttcttcgttcaccccatttgctcccatgccgggccctggaggcttagcagctgcatgtagagaggatatatgactgtggacgggggcccaggaacaggttactgaccttgaggaacgaggtctgggtggggtccagttttgagttacattccacctggagtaagcaggaggctgaatgaatgaggtcacgcccactgtggcgcctcccccgtaagggacccaggaacccagac

SEQ ID NO: 38232 - DNA, 601 bp, Human
ttcaacaggagacctccatggtgtgccccgggggccccgaagaaagagttccagactcgctgctctgggacagggtgcgagagcgggaccggttgccatcaacggatgctgcactggtcagagaggctgtacgagaccgggacaggcgagtcatgcaggatgaggccactgtggagacagcacgatgcacaagcagtcagagaggaagtggggaaggggggctggcgactcagggtgtggtccttggattatggactagttataactaagccaggggatcaacgagctcgattgggcagayagcggtgagtccaggcattcacctaaaacggttccaccccgtcagtgcctatctctcctctagtgcagcaagctcttgtccccatactcactgtagcccatgccttgcaggaagtacttgaaggcctcggtcagcttgcctggctgcggaagtaagaagaggcgagggagacggtgagatgaggttagaggaagagctggagcctgaggctgcggcactgtggggccgggtgtgtggcaaagggcagagcccagtgccaccggtatcctatgtcccttccccatcccatggacggcagcg

SEQ ID NO: 38233 - DNA, 601 bp, Human
ccaacttcctttttacactggatgtttctatcacatcctgaggaccactaacccaccagcaagtctccccctgacacacattcacgtaggtccatacccttcagagtcctaaagggttaatgagaagccacctcagctttggtgaatggagccccagccccaaatcccctccccttgcaaatatgggacaagtagggagagtctgatggaggcaccaggacaactacaacaacctcttacccctcagctatagacacctagatcaggacagaggatgcatatgccctctccaccttaacaycaaaatgggggaggaggagaatttaggggtctgggtccctaagagatattaggacatctcttccaggagctggggggaatcacgggttaaaggtcaaggttagggtagcaatcaaagatcaaggtcatctccccgcatgatctgccctttttcccttgcttacggtggcccaatgccccttcagcacctcccaggttagctctgggggaggtgagggctgggtcccactctagggcaacaagggccattcaacaggagacctccatggtgtgccccgggggccccgaagaaagagttcca

SEQ ID NO: 38234 - DNA, 601 bp, Human; identical to SEQ ID NO: 38075

SEQ ID NO: 38235 - DNA, 601 bp, Human; identical to SEQ ID NO: 38076

SEQ ID NO: 38236 - DNA, 601 bp, Human; identical to SEQ ID NO: 38077

SEQ ID NO: 38237 - DNA, 601 bp, Human; identical to SEQ ID NO: 38078

SEQ ID NO: 38238 - DNA, 601 bp, Human; identical to SEQ ID NO: 38079

SEQ ID NO: 38239 - DNA, 601 bp, Human; identical to SEQ ID NO: 38080

SEQ ID NO: 38240 - DNA, 601 bp, Human; identical to SEQ ID NO: 38081

SEQ ID NO: 38241 - DNA, 601 bp, Human; identical to SEQ ID NO: 38082

SEQ ID NO: 38242 - DNA, 601 bp, Human; identical to SEQ ID NO: 38083

SEQ ID NO: 38243 - DNA, 601 bp, Human; identical to SEQ ID NO: 38084

SEQ ID NO: 38244 - DNA, 601 bp, Human; identical to SEQ ID NO: 38085

SEQ ID NO: 38245 - DNA, 601 bp, Human; identical to SEQ ID NO: 38086

SEQ ID NO: 38246 - DNA, 601 bp, Human; identical to SEQ ID NO: 38087

SEQ ID NO: 38247 - DNA, 601 bp, Human; identical to SEQ ID NO: 38088

SEQ ID NO: 38248 - DNA, 601 bp, Human; identical to SEQ ID NO: 38089

SEQ ID NO: 38249 - DNA, 601 bp, Human
cggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtgagcgctcagtcccgggcctcccgtgggagcgtgcgcgtgggagcgcacagccactgttcacccgggattacacagttgcccaggaggggtgtttgagcaggagcatctgaggccaggaggacgggggttcagatcccagccctgccacttactggctgtgtgmccttgagcaagtgacttaagctgtctgtgctgcaggcacctgcctacctggaaaatgaggatcacgtaggtctttgctataggggtccttcgaggattagagttaaaattttcataaagcggccaggcacagtggcttatgcctataatcccagcactttgagaggccgaggtgggtggatcacttgaggctaggaatttgagaccagcctggccaacataatgaaaccccatctttactaaaagtacaaaaattatccgggcgtgctggcgcgcgcctgtaatcccagctgcttgggtg

SEQ ID NO: 38250 - DNA, 601 bp, Human
ttaaaattttcataaagcggccaggcacagtggcttatgcctataatcccagcactttgagaggccgaggtgggtggatcacttgaggctaggaatttgagaccagcctggccaacataatgaaaccccatctttactaaaagtacaaaaattatccgggcgtgctggcgcgcgcctgtaatcccagctgcttgggtggctgaggcaggagaatcgcttgaactcgggaggtagaggttgcagtaagctgagattgcgccactgcactccagcctgggtgacagagtgagaccctgtctctataaataaacaaacaaacaaacaaataaaaataaattttcgtaaagcgcttagaacaatgcctggcaccaagggttctgataaagaagtccttttccagtttcaagttcttaactctgtgccagcactgagccgagtgctcagcaagcgcctctccccgcgagtcctcagcaagcgcctctccccgcgagtcctcagcaagcgcctctccccgcgagtgctcagcaagcccctctccccgcgagtgctcagcaagagcctctccccccgagtgctcagcaagcgcctctccccccgagtg

SEQ ID NO: 38251 - DNA, 601 bp, Human
tgcctataatcccagcactttgagaggccgaggtgggtggatcacttgaggctaggaatttgagaccagcctggccaacataatgaaaccccatctttactaaaagtacaaaaattatccgggcgtgctggcgcgcgcctgtaatcccagctgcttgggtggctgaggcaggagaatcgcttgaactcgggaggtagaggttgcagtaagctgagattgcgccactgcactccagcctgggtgacagagtgagaccctgtctcaataaataaacaaacaaacaaacaaataaaaataaatkttcgtaaagcgcttagaacaatgcctggcaccaagggttctgataaagaagtccttttccagtttcaagttcttaactctgtgccagcactgagccgagtgctcagcaagcgcctctccccgcgagtcctcagcaagcgcctctccccgcgagtcctcagcaagcgcctctccccgcgagtgctcagcaagcccctctccccgcgagtgctcagcaagagcctctccccccgagtgctcagcaagcgcctctccccccgagtgctcagcaagcgcctttccccgcgagtgctcagcaagc

SEQ ID NO: 38252 - DNA, 601 bp, Human
caacataatgaaaccccatctttactaaaagtacaaaaattatccgggcgtgctggcgcgcgcctgtaatcccagctgcttgggtggctgaggcaggagaatcgcttgaactcgggaggtagaggttgcagtaagctgagattgcgccactgcactccagcctgggtgacagagtgagaccctgtctcaataaataaacaaacaaacaaacaaataaaaataaattttcgtaaagcgcttagaacaatgcctggcaccaagggttctgataaagaagtccttttccagtttcaagttcttaactctgtgccagcactgagccgagtgctcagcaagcgcctctccccgcgagtcctcagcaagcgcctctccccgcgagtcctcagcaagcgcctctccccgcgagtgctcagcaagcccctctccccgcgagtgctcagcaagagcctctccccccgagtgctcagcaagcgcctctccccccgagtgctcagcaagcgcctttccccgcgagtgctcagcaagcacctcgctcccagtggccgagtgcctctccattcgttctcattctccaacacattctccattcattctccattca

SEQ ID NO: 38253 - DNA, 601 bp, Human
ctctccccgcgagtcctcagcaagcgcctctccccgcgagtcctcagcaagcgcctctccccgcgagtgctcagcaagcccctctccccgcgagtgctcagcaagagcctctccccccgagtgctcagcaagcgcctctccccccgagtgctcagcaagcgcctttccccgcgagtgctcagcaagcacctcgctcccagtggccgagtgcctctccattcgttctcattctccaacacattctccattcattctccattcattggtgttctcaatctccaacacatacccagcagcaggygtcatttgtcatccccattctacagatgaaaaaactgagggtcagagaggtgacgctgccagccctgggctggtgacagagcaggcacacacccaggtccagaaggacttgggtcccccctgcccatgctgcaccctgctcaccctcccacccacaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtcc

SEQ ID NO: 38254 - DNA, 601 bp, Human
gagcacctgcacgtgcatgttgtaagagttggcatgtgtgtgtgtgtcaacgtacatgtgggcacacatgactgtgagtgtgcatgcacatgcctgcgtatgcaaaggagcgtgcaagcatgcgtgtccacaggggtgtgagtgtgtgcgtgaacacctggagccgggagaaaacaggcctatctggagggggagcaaagtacaggcatcaccctgagggagtagaaaacctgcaggaagattcctaggctgtcacgggggccccagcgccctgtgtccaccctccagacgagaaactgasgctgggagggctgaggaaatggtctccctggcctgcgggcatggctggggcccagagccaagttctggggcagttttgtctggatcaaagctggaaagactctgacatggtcggcaggaggtgctcgagagtcgggccaccataccccacagctccagaggcgccgtctgctccttgggctgtgagggtggctctgctggagccatggtcatgtggggggacagggatttcgtgggtccgcttgagggttcttagtcctcaccgccctcctaacttccctccctattcatcgttacaggg

SEQ ID NO: 38255 - DNA, 601 bp, Human
cttatttatttatgtatttatttttgagacagagtctcgctctgtcacccaggctggagtgcagtggtgcaatctcggctcactgcaacctccgcctcccaggctcaagcaattctcctgcctcagcctcttgggtagctgggattacaaacgcccgtcaccacgccaagctaattgtttgtatttttagtagagacagggtttcaacatgttggccaggctggtctcgaactcctgatctcaggtgatccgtccacttcggcctcccaaagtgttgggattacaggcgtgagccaccacrcttggccccaaggggcatccttaaatccaggtgcctgttcattctgcctccatcctgctgagagccaggcccagggtacgcatggaggggggcatggaccaacccaggccctgctgtcaggaagctcatggctcatatggaggctcctgtgtcccagcactgagctggggggacttctgactcctgcccaaaccctacagctccaaatcacccccagtcctgggtgaaggctgcccaggagagcaagctaaggaggggggtggcaggaccagaggctggggtcgagcactgatacccaga

SEQ ID NO: 38256 - DNA, 601 bp, Human
catgtcgcccccagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggccccygcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagccccaaaaggttgcaggaaggtgggtaagggccgcaaacaatgttggtggctgagatgagagctgggaccccacagggctggatggccttcctgggcccttttctggcctgcagcaggcatggagaccgcctcggcc

SEQ ID NO: 38257 - DNA, 601 bp, Human; identical to SEQ ID NO: 33089

SEQ ID NO: 38258 - DNA, 601 bp, Human; identical to SEQ ID NO: 33090

SEQ ID NO: 38259 - DNA, 601 bp, Human; identical to SEQ ID NO: 33091

SEQ ID NO: 38260 - DNA, 601 bp, Human; identical to SEQ ID NO: 33092

SEQ ID NO: 38261 - DNA, 601 bp, Human; identical to SEQ ID NO: 33093

SEQ ID NO: 38262 - DNA, 601 bp, Human; identical to SEQ ID NO: 33094

SEQ ID NO: 38263 - DNA, 601 bp, Human; identical to SEQ ID NO: 33095

SEQ ID NO: 38264 - DNA, 601 bp, Human; identical to SEQ ID NO: 33096

SEQ ID NO: 38265 - DNA, 601 bp, Human; identical to SEQ ID NO: 33097

SEQ ID NO: 38266 - DNA, 601 bp, Human; identical to SEQ ID NO: 33098

SEQ ID NO: 38267 - DNA, 601 bp, Human; identical to SEQ ID NO: 33099

SEQ ID NO: 38268 - DNA, 601 bp, Human; identical to SEQ ID NO: 33100

SEQ ID NO: 38269 - DNA, 601 bp, Human; identical to SEQ ID NO: 33101

SEQ ID NO: 38270 - DNA, 601 bp, Human; identical to SEQ ID NO: 33102

SEQ ID NO: 38271 - DNA, 601 bp, Human; identical to SEQ ID NO: 33103

SEQ ID NO: 38272 - DNA, 601 bp, Human; identical to SEQ ID NO: 33104

SEQ ID NO: 38273 - DNA, 601 bp, Human; identical to SEQ ID NO: 33105

SEQ ID NO: 38274 - DNA, 601 bp, Human; identical to SEQ ID NO: 33106

SEQ ID NO: 38275 - DNA, 601 bp, Human; identical to SEQ ID NO: 33107

SEQ ID NO: 38276 - DNA, 601 bp, Human; identical to SEQ ID NO: 33108

SEQ ID NO: 38277 - DNA, 601 bp, Human; identical to SEQ ID NO: 33109

SEQ ID NO: 38278 - DNA, 601 bp, Human; identical to SEQ ID NO: 33110

SEQ ID NO: 38279 - DNA, 601 bp, Human; identical to SEQ ID NO: 33111

SEQ ID NO: 38280 - DNA, 601 bp, Human; identical to SEQ ID NO: 33112

SEQ ID NO: 38281 - DNA, 601 bp, Human; identical to SEQ ID NO: 33113

SEQ ID NO: 38282 - DNA, 601 bp, Human; identical to SEQ ID NO: 33114

SEQ ID NO: 38283 - DNA, 601 bp, Human
tacttataaatttcatgcatgctaaaaaaaaaccatgtagtctttcataacttcccagaaattatatttttgttcaatagctttcagtctcccatcatggcaataaaaacaaagatcaatgtataccatatatgctttccattctaagtaataaataagattatcaattacataaaatataatggtggtcagcaaaagacccaatgctatttcaagtggtaactaaagcatgaggagtggtaaggagtaagacttacccaaaaggccttctcatcgttgacttgtcaaaaagtaactcacygtaaggcagtttcttaaacttatctctgccaacagccacataaaactgcccattctccaactctgctccactctcaacaagttttccttctaaagtataaagcctgtcgaaaatatgaacaccaacaattagaattttaaccaacatttaaagaattgcttaagattacaaagtattctggatgtcaaaaaaattaaaattacatagtaaataaaaacattctgtacttaatttagctcatttgttactatcctcattattgcattatagatgcctcaaagttatcagattccactaaat

SEQ ID NO: 38284 - DNA, 601 bp, Human
actgaatctctccaaaaatagaaggacacatatataaaaaaaattcttattaattgtatgagaaaggccaacgtgagttacagttttcttattaccatcaggtacacactgttgatcacagcaggttaacctagggctgcttagcaaagatggctaaagatttgatttcatggatgggtaaggttggttagcgataagtcagctggtaaataattcaaaggtgctagaaaaccatgtgctcttgcatagttcaaacaccacccctgaaattccacttcatctattacttatttagaagctyttggccagcctctccatcaagttacacaaattgtgaattaattgcaaacacactggtgatattctgctctacttctgcggacgacaaccaaaaaaaatttttttttgcaatggcaaggtggccacagaatctctgggaaaagcaacagagatggatccctgggcaccatgagcaagccgagagatcctgcagcatgggccagagctcttcttttttttttttttttttttttttttttttttttttttttgagacggagtctcgctctgtcgcccaggctggagtgcagtggcgggatct

SEQ ID NO: 38285 - DNA, 601 bp, Human
aaattacaggattattttttaaagttatatttatggaagatggaaggacaggcaatccattcatttctgtaaaatctatttatgtgatatgttgaattaagctagaccactggaaaaaaatcatgttggatcttactatctagtcccacacagaattacactttgatttcattttgtaagctttcatcaaaagctactacaacaaagagttgtatgaaacctactattacaggtgccatataaatgacgctgaggactatgtagaactaatatggggaatttcttatagaataggactatkattatctcaccttgagaaaagataagagacatgctgagcattttcatttagatgttaagaacattttgaataactcatatagtggattgcagataacttcgtactgttactgaaacctggccaccagaacattttgcattttgccaccgctaaacttgctttccctaagcaagataaatcagatgcatcaataataaataatcaagtagacctcagtgatcatagtgggtattaggaatgagtagtccaaggcccacttcagcagttacagccttgagggaggtggaccttgaactgacg

SEQ ID NO: 38286 - DNA, 601 bp, Human
ccagcctgggtagcagagtgagaccttgtcacaaaaaaaaagtccctaattagatgttgtctcaaaaaaaaaatcacaaactaggcacttccttatttgaactcccaagaatttagattcactctcattacataccacaggtcaatgccaaattacataaccttgatcttgacggatgcccaattcctatcaaaagcctatttttcccctttaaaaaaatattcatttgtcataattggcaaataaaaattgtatgttcatagcatacaaaatgatgttttgaaatatgtatccattgtgraatggcttgagttaattaacatacaccttacctcacatacttatcttttgtggtgagaacccttcaaatctgctctgttagtgattttcaagtatacaatacattgttattatacgttagacaccttactgtacaatagatctcttgaacttattcctcctttctcgcagaaattttgtatcatttgaccaacatctctccaaccctgtactcagtccctggtaaccaccattctaccttctacttctatgagtttaactgtttttagattacacatataagtgagatcatatggtatgt

SEQ ID NO: 38287 - DNA, 601 bp, Human
ggaggtcaaagctgcagtgagctgtgatcacgccactgaactccagcctgggtagcagagtgagaccttgtcacaaaaaaaaagtccctaattagatgttgtctcaaaaaaaaaatcacaaactaggcacttccttatttgaactcccaagaatttagattcactctcattacataccacaggtcaatgccaaattacataaccttgatcttgacggatgcccaattcctatcaaaagcctatttttcccctttaaaaaaatattcatttgtcataattggcaaataaaaattgtatgttyatagcatacaaaatgatgttttgaaatatgtatccattgtggaatggcttgagttaattaacatacaccttacctcacatacttatcttttgtggtgagaacccttcaaatctgctctgttagtgattttcaagtatacaatacattgttattatacgttagacaccttactgtacaatagatctcttgaacttattcctcctttctcgcagaaattttgtatcatttgaccaacatctctccaaccctgtactcagtccctggtaaccaccattctaccttctacttctatgagtttaa

SEQ ID NO: 38288 - DNA, 601 bp, Human
gcccagctatcacaggaggatgaagtgggaggatcacttgagcccgggaggtcaaagctgcagtgagctgtgatcacgccactgaactccagcctgggtagcagagtgagaccttgtcacaaaaaaaaagtccctaattagatgttgtctcaaaaaaaaaatcacaaactaggcacttccttatttgaactcccaagaatttagattcactctcattacataccacaggtcaatgccaaattacataaccttgatcttgacggatgcccaattcctatcaaaagcctatttttcccctttaaaaaaatattcatttgtcataattggcaaataaaaattgtatgttcatagcatacaaaatgatgttttgaaatatgtatccattgtggaatggcttgagttaattaacatacaccttacctcacatacttatcttttgtggtgagaacccttcaaatctgctctgttagtgattttcaagtatacaatacattgttattatacgttagacaccttactgtacaatagatctcttgaacttattcctcctttctcgcagaaattttgtatcatttgaccaacatctctccaaccctgtact

SEQ ID NO: 38289 - DNA, 601 bp, Human
agaggatcgcttgagtccaggagttaaaaaccagcctgtgcaacacagggagggagacttcctccatattaaaaaatatgtatatatggcctggcatggtggcacctgtgggcccagctatcacaggaggatgaagtgggaggatcacttgagcccgggaggtcaaagctgcagtgagctgtgatcacgccactgaactccagcctgggtagcagagtgagaccttgtcacaaaaaaaaagtccctaattagatgttgtctcaaaaaaaaaatcacaaactaggcacttccttatttgaaytcccaagaatttagattcactctcattacataccacaggtcaatgccaaattacataaccttgatcttgacggatgcccaattcctatcaaaagcctatttttcccctttaaaaaaatattcatttgtcataattggcaaataaaaattgtatgttcatagcatacaaaatgatgttttgaaatatgtatccattgtggaatggcttgagttaattaacatacaccttacctcacatacttatcttttgtggtgagaacccttcaaatctgctctgttagtgattttcaagtatacaata

SEQ ID NO: 38290 - DNA, 601 bp, Human
acgtggctgtaatctcatcactttgagaggtcaaggcaagaggatcgcttgagtccaggagttaaaaaccagcctgtgcaacacagggagggagacttcctccatattaaaaaatatgtatatatggcctggcatggtggcacctgtgggcccagctatcacaggaggatgaagtgggaggatcacttgagcccgggaggtcaaagctgcagtgagctgtgatcacgccactgaactccagcctgggtagcagagtgagaccttgtcacaaaaaaaaagtccctaattagatgttgtctcaaaaaaaaaatcacaaactaggcacttccttatttgaactcccaagaatttagattcactctcattacataccacaggtcaatgccaaattacataaccttgatcttgacggatgcccaattcctatcaaaagcctatttttcccctttaaaaaaatattcatttgtcataattggcaaataaaaattgtatgttcatagcatacaaaatgatgttttgaaatatgtatccattgtggaatggcttgagttaattaacatacaccttacctcacatacttatcttttgtggtgagaaccct

SEQ ID NO: 38291 - DNA, 601 bp, Human
atatagtacaagttcaatctcaataaatgtcaattgtttcttgtaaattctctgtatttcctggtattttcctacaatcatatctcgctttgtacaagaattgttacatggaacaaaatgttacacggtgaacagaatttctagtcattttattagtagacagtccttctgtaaaagttaactattcatttttaacttacaattcacataaatttggtttctcatatatttcggtatgcttaaaatatacctatactaatatgttagggagaacaagataaaatatatcattgttataagwaagagatgagtcaaataagattaaatctctttgtgagtaactgctctgttactaatccctaattaggccgggcatggtggcacgtggctgtaatctcatcactttgagaggtcaaggcaagaggatcgcttgagtccaggagttaaaaaccagcctgtgcaacacagggagggagacttcctccatattaaaaaatatgtatatatggcctggcatggtggcacctgtgggcccagctatcacaggaggatgaagtgggaggatcacttgagcccgggaggtcaaagctgcagtgagctg

SEQ ID NO: 38292 - DNA, 601 bp, Human
tctaatgttataattcgtaggtagtattcgaccatagtgtcacattatattcagcaataactatgtgcttatctttcaagtatgataacccttcatttttcttgcgatccatatactctctttttaaaaatcttctaagccacggcagcatagtccttgttttgttggttgttttcattttcttctggactggtaatttttacttctggccttggtggtctttgagggtctacatcagcctagaagaaaatagatcaaaacaaaggtattcagctgtttggttcacaaaggtaatgacatytataaagaaaaaattactcaagattctatttaattatataaatatttaactaaaaagagttcctggggttccctttgtttttttgtctatcattacccagtggacatactgttttctcaacacttgtacaaaagtccttttggggttcataatctactagtgcttgaaaggccctgactcattttgtatgctgcaggctttatttttctcattttttcttgatttctctttgagcttttcttcaatttagttatacttttcagtttagcattttcagagacaaaggaagaaaaaattcag

SEQ ID NO: 38293 - DNA, 601 bp, Human
cgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggt

SEQ ID NO: 38294 - DNA, 601 bp, Human
tgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatatgagggtcagttcaggcactgtgcgtaaagcacatagcaccgtgtctagtaggtactctctgttccttaactgtckttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgct

SEQ ID NO: 38295 - DNA, 601 bp, Human
aggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatatgagggtcagttcaggcactgtgcgtaaagcacatagcaccgtgtctagtaggtactctctgttccttaactgtcgttccttgattrctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccag

SEQ ID NO: 38296 - DNA, 601 bp, Human
ctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatatgagggtcagttcaggcactgtgcgtaaagcacatagcaccgtgtctagtaggtactctctgttccttaactgtcgttccttgattgctcttaagatacgacartgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcg

SEQ ID NO: 38297 - DNA, 601 bp, Human
aggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagcggcgcgatctcggctcactgcaacctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttt

SEQ ID NO: 38298 - DNA, 601 bp, Human
ttctgggccccacttccagagggtttttcttttttttttttcttttgagacggagtcttgctctgtcgcccaggctggagtgcagcggcgcgatctcggctcactgcaacctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggatyacaggcgtgagctaccgctcccggccttttttttttttttttttttttttttaaagacagggtctcgctccgtcgcccaaactggagtgccgtggtgcgatctcggctcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactg

SEQ ID NO: 38299 - DNA, 601 bp, Human
agtcttgctctgtcgcccaggctggagtgcagcggcgcgatctcggctcactgcaacctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttttttttttttaagacagggtctcgctccgtcgcccaaactggagtgccgtggtgcgatctcggctcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttgg

SEQ ID NO: 38300 - DNA, 601 bp, Human
ccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcttttgcagggacggaggcaagctcctgagcgggcacttgctgttcctctcacctgtacatctgttggggaaaggctccttctcatccttcagagctgagcttacatgtcactgcccaagagaccttcttaactgtgggtgtc

SEQ ID NO: 38301 - DNA, 601 bp, Human
ctgtgccttgccgagaagcttgggctctgttggcagagccagagagtggcattcattcagcttgtgaattctggaagaatttctggctctggagaattaaagggacatttccagcagcagagctccagtagcttttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctc

SEQ ID NO: 38302 - DNA, 601 bp, Human
ttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcktgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttg

SEQ ID NO: 38303 - DNA, 601 bp, Human
gagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgygcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccc

SEQ ID NO: 38304 - DNA, 601 bp, Human
gtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtc

SEQ ID NO: 38305 - DNA, 601 bp, Human
cacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgtttttttttkttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccccgctggccctcagttctctggatcagggttgaaaggctgaaattctttgggtgttagcttaggatgcctc

SEQ ID NO: 38306 - DNA, 601 bp, Human
atttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcct

SEQ ID NO: 38307 - DNA, 601 bp, Human
ttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacag

SEQ ID NO: 38308 - DNA, 601 bp, Human
ccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacg

SEQ ID NO: 38309 - DNA, 601 bp, Human
gagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacacacacactggctgtcctcacygtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttg

SEQ ID NO: 38310 - DNA, 601 bp, Human
gcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgttcaggctggtcgcgaactcctgacctcaggtaatccgcctgccttgccctcctgaagtactgggattacagacatgagccaccgcgcccggccacagag

SEQ ID NO: 38311 - DNA, 601 bp, Human
gaaggagaagcaggagttggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctg

SEQ ID NO: 38312 - DNA, 601 bp, Human
ctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaatmggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatct

SEQ ID NO: 38313 - DNA, 601 bp, Human
atagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaataggactagtttgtgtaactgatttgttcaraataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatctgtggaaagaataaacattttagctgggca

SEQ ID NO: 38314 - DNA, 601 bp, Human
tggtgacacgtgtttctagttattgacctatgtttttaattataactttgggtggtggtctgaaatgaaatgttaagtttgacgcaaaaataggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctac

SEQ ID NO: 38315 - DNA, 601 bp, Human
ttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagg

SEQ ID NO: 38316 - DNA, 601 bp, Human
cctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagattt

SEQ ID NO: 38317 - DNA, 601 bp, Human
cctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaa

SEQ ID NO: 38318 - DNA, 601 bp, Human
agtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcat

SEQ ID NO: 38319 - DNA, 601 bp, Human
cctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctgg

SEQ ID NO: 38320 - DNA, 601 bp, Human
ctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcytgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgt

SEQ ID NO: 38321 - DNA, 601 bp, Human
cagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatc

SEQ ID NO: 38322 - DNA, 601 bp, Human
ggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgaggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttacagggaagggctctttgcagagagagtgcctgatacgtagcagctggtacttctccatcttgaaactgtccttcctggttttgtctaatttgtcatcatgggatt

SEQ ID NO: 38323 - DNA, 601 bp, Human
caagaccctgtttcagaaaacaaaaacccaaaaagcaaaacccccacagtatatatagaaatacaagatttgtgaggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagtgaggaaggaaatcaggggtcacccttacagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccct

SEQ ID NO: 38324 - DNA, 601 bp, Human
cctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagygaggaaggaaatcaggggtcacccttacagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgt

SEQ ID NO: 38325 - DNA, 601 bp, Human
agcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttayagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaag

SEQ ID NO: 38326 - DNA, 601 bp, Human
aaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttacagsgaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctg

SEQ ID NO: 38327 - DNA, 601 bp, Human
gctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattgcttttgtttgctgtgatccattttgtaagggaagtcactataatgttgttatttaagagaaagagacaaacggaaagaaacaaacagctggtgtttaacgactccgtcagacccaattataaagcatcaactagt

SEQ ID NO: 38328 - DNA, 601 bp, Human
atagcctgaggtcccctcgtcccatccagctaccaccacggccaccactgcagccaggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaagtttgtattgtttctttaaatgtttgtttcagtttgtttttgtttttcat

SEQ ID NO: 38329 - DNA, 601 bp, Human
ttttctctttgctcatttggttaacctcctctgagtgatgccaagagcatagatatatcagacaggcctggctcaaattctaaccctgtgagctctgcactatttatttaacctctctgggcctctcaagtcatcttatttttggaagatgcctcagagcctcttagattttctcacctgtaaaaggggataacgttatctacctataggggttaattacatgatctaatacagttgccctccaaagttttgagttccacaatgtggattcaatgaattgtggatccagaatattcagggraaaaaaatgcatgtgtattgaatatgtagaggcctttttccttgtcattattccctaaacaatacagtataacaactatttaaatagcatttacattgtatcaggcattataactaatttagaggtgacttaagtaaggtatacagaaggatgtgtgcataggttatatgcaaaaactgcacctgtttatgccagggacttaaacattcgtggatcttggcatctgtggttgcgaggtgggtcctggaactaattcgtcatggatactgagggacatgtagcacaacaaatgttacattt

SEQ ID NO: 38330 - DNA, 601 bp, Human
caccaccctaaggaccttccactcacctgactgcttctccttcctctttctcctccacacacagaagcaggcaagggtgccaaggaacagtgcgcttagaatcacgatgatcaccaaaaacggccaaaatctgaattctgaggaatacagaaggcgtgagaactgagctgtcagctcgctctcttcttccttcccacctgcctgctgcaggggctgcctcaaaacccacttttctctgtgttgtggctgattgcctcgtgctctgagaactcacggtcaaggttttctctttgctcatttrgttaacctcctctgagtgatgccaagagcatagatatatcagacaggcctggctcaaattctaaccctgtgagctctgcactatttatttaacctctctgggcctctcaagtcatcttatttttggaagatgcctcagagcctcttagattttctcacctgtaaaaggggataacgttatctacctataggggttaattacatgatctaatacagttgccctccaaagttttgagttccacaatgtggattcaatgaattgtggatccagaatattcagggaaaaaaaatgcatgtgtat

SEQ ID NO: 38331 - DNA, 601 bp, Human
aaccatcattgaaagagcattttccaagccagctgagagagaccccagcctccgggatgacatacgtgatttctcctggttttcagatccttgacatcttcgtaaattgtcaaaaattccttgggactggtctctgagggaggaagaaaacaaagagcagagctgcagaaacctccagaagggcttttgcttctaacaggtcccacctctaccccaaatggccaaaccttaaaaaaggttctagaaaggaggcaagttaatgctcttcccaggaaccccaaagagcacagaggcagcaacsgaactgcccctcccacacctcctcccaaaccagctgtctacagggaaatctgcgcattgggatcagaaggcatgaactgggagagagagcctagcaacctgcttgccccccgccaccacgcacacaaacataccaaagctcgttgaggaaaaggagatgctgtgctcccagacacatcccactggacgcaggacaaagtcacaggatccaaggcctcaggcaggagcaccaccctaaggaccttccactcacctgactgcttctccttcctctttctcctccacacacagaagcaggcaa

SEQ ID NO: 38332 - DNA, 601 bp, Human
gtgtttctagaaagattagagctgggtctcaaagtgagaccacatgaaacttgagatttaggccttcaaattggagccctgagacaatagggagaggccagagagggctgaggccaggcagggaggagctcttgagtcggaagaagtaagctaataggcctgaatcccaaagaggtttcctttgctctaagttgtttttcctcctgtggtctcctaatctcaagtcatcttctttttggaaaaatagattatttttagcaagcacccgggcatcactggctgtgggtagattcacatgctytcaggaatttgtaccagagtctggtagcagtgagagaaacaaagtccccttttattattcacattccaatagccactgctttatttttcacattcccatagccactgctggggcaaaaataaataaataaataaagataaaaataaaaaaacaggcatggggagctgctctaacagcctctgaacccagaggcatctgggagaggatgcttgcctgctctgcgaggctgcacagggcctcacgtatgtggccagcgcggaagagccccaccacatgtgcttcctgcgtgctgctgggtct

SEQ ID NO: 38333 - DNA, 601 bp, Human
ctttcctttagtaacttagaaacccttccttgcagagctctgagtagggctgttatctgagccttacctcagagcactgaaattcagaaagtttaaacatttcaaagaccaaacacagttaagccctctctagatcatctttgaggccaccttgcccttgacctcaagtcagcgccctgggcagctatagtgctgggtgcagccctgaacccaagggccaaagcaggaagcagagcttcctgcttcccttttcttgttcctaccccttaggaaatcggtggtggaggtatttcatgctgcyggccactgaaagcatattgccagtttgggttctactgggagccagtggaggcagcagggttcattaggcaaggtgcaagcaaaattcctggaagcaagaagaagctaagagaagcagagaactgtcagctgtccttagaggctggggagtcatgggcatctgacaatgtcaataacttcatttgtgttttaaaatactgcaggagtttgttgcttttctctcccgtccagacccgtgtgaagtgtttctagaaagattagagctgggtctcaaagtgagaccacatgaaacttgagattt

SEQ ID NO: 38334 - DNA, 601 bp, Human
tccagcacaatcttacaaaggttatctcttccgtttctcctcctcaaccctgcccagatggaagcttcaagtgttagtgaaaagagccctggactagccaggaggtcagacaacctgagtgctagtctcgctctgtcattaatgaaagcttctatttgttgagcatttatcttatacatgtattctcctctaactgtttttttgtttatttgtttttgagacaagagtttcgctctattgcctgggctggagtgcaatgtctcgatcttggctcaccgcaacctctgcctcctgggttcargcaattctcctgccccagcctcctgagtagctgggattacaggtgcctgccatcatgcccagctaatttttgtatttttagagacagggtttcaccatgtgggccaggctggtctcaaacccctgacctcgtgatccgcccgcctcggcctcccaaagtgttgggattacaggcatgagccaccgcgcctggcctcttctctaactcttttaacactcctataaaataagaatgatcataatttgccccatgccacaaatgaggctccaaaaggataaatagcccaagtcaggcagtgcg

SEQ ID NO: 38335 - DNA, 601 bp, Human
ctgggctttaggttgactctttccaatctgcaaaagaaaaggagaaacttcagacccttgcactgggaggtccttatcacaatcctgtgaggtatgacttgccatccccattttacagatttaaaaaatgaagctcagagtgacaaaacaaattactcaggatccacgactagtgtgaagtgcaggagggacttgaatctagttcttctggctccaattccagtactctcttaaccacatatgctttttcatgacctcacaagctacctgggtctacacagtgccctctatgaccctgggwtgtccagttggctttaatgttgggtgatagctgaagtgccaggaattccagcaggcagccacccatccctcccttctgaccaatggcagcatctttattggaccacaggtggggaggctcaggtgtagtatgaggctaatgggtagtgggggaggttgggggatgctctccatgccttaatttctctgagtataaatggaaagtataattatacctatcttgtagcattctgtgaggactaaataaaataatccatgtgaagacactggcaggctaccttatccataataaacccccaag

SEQ ID NO: 38336 - DNA, 601 bp, Human
ccctcccttcaatgtgcatcctggggaacactcatcaggactcagaacttaaatagaacatggtttctgagaggcctcttcctctgggaagccacttctatgaagaagccaaatggatttctaacaatgcgtcttcataaatcaaacatcataccatggacaaagctggtctcaacaccccagttatcaggtcagcatgtgctctgggtgatttttctactcagagatgggcttgctttgcaccatctactctcccttcagcccactccccctggtggccaactggccagaggtaaaggtrtgagatgcagggagaaagttttttctctgcaattgagtaaagcccaggccctggcccccacccacgtgcagaacctgccagccagttcacagccggacagtccaggctttcagaggagggctgtttcttcttcccctgagtcaccattatcattccttcctcttgctttggaagatgggcctgggccggcgagagtctagaaatgcagtcaacccagagaggggagaaaaggaaacaagtgacagcttgaaaatcaggtggagggaatctcgatgctaataacatcacttacataacact

SEQ ID NO: 38337 - DNA, 601 bp, Human
tgtctggcctgacgactcagggaacccagcatagtgtctagattccaactgcctcattctcagccctcagctgcctgagccctcccttcaatgtgcatcctggggaacactcatcaggactcagaacttaaatagaacatggtttctgagaggcctcttcctctgggaagccacttctatgaagaagccaaatggatttctaacaatgcgtcttcataaatcaaacatcataccatggacaaagctggtctcaacaccccagttatcaggtcagcatgtgctctgggtgatttttctactyagagatgggcttgctttgcaccatctactctcccttcagcccactccccctggtggccaactggccagaggtaaaggtatgagatgcagggagaaagttttttctctgcaattgagtaaagcccaggccctggcccccacccacgtgcagaacctgccagccagttcacagccggacagtccaggctttcagaggagggctgtttcttcttcccctgagtcaccattatcattccttcctcttgctttggaagatgggcctgggccggcgagagtctagaaatgcagtcaacccagagag

SEQ ID NO: 38338 - DNA, 601 bp, Human
gttttttcctgaaggagatgggaatctttaagcaggagagagacgtcagttttgtggcttacaaagatcactgtggccacggtgtgaaagatgattgaaaggaaggaataagactgagacttcaggggaatgttgctactgcaagcatacaaaaaataaggaagagcagaggcaaatgtggaaagaaggaccaccttggatagacagatgggagatggaactgatgagtctttgtgacaggatgtgggggtggggtgagggagagaagctgaggatgattttcaggtttggggggtaacargtagatatatgaaggatacctttacggaaatatgggttgtaggaagaagatctgtttctagggaagagatgtcagttttggacctaaagagtttggatacttgtgagacatctgactggaaatgagaatggaatgttggatacctgagtctggagcttaagagaggaaagacggagagagagatccaggctaattctagattggtgagcaggtagatagcatgacccaagaggtggtggaagaggcaggtaggtgagtgcccagggtggaagcccaagagaacagacaacgtgggaatga

SEQ ID NO: 38339 - DNA, 601 bp, Human
aaaatatcctggctcttcgcatttaccaacagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccacttttttttttttkttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaa

SEQ ID NO: 38340 - DNA, 601 bp, Human
ttatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagstggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggag

SEQ ID NO: 38341 - DNA, 601 bp, Human
aatagacttttgggtccttataacactgatacaatgccttctttgatttcctggtttctgagacttgtgtaagaaagagctgaacttcttactcatttttatctttatcttactcatttgtatctgcttgcctcttatctttgattcagtaattgaggtttactggtagcctgcaaacgtgattctcattgagctgttttccctaccatgttgtagaattataggattatacagtgtgtgttcagtgtgtcattttcaagacgtctattacagcaagcagtaaatgacggataatttaggmctggctgtgattatggcttttagttaatatgatcaaagtagagtcttactgtaaatccacggagccgggtgcagatgacatcactgaagtgcgtgctgtccggaagcttgtggacacactgctgtcccggtgattagatacaagtgtgtctcttttggctgccatctgctccctcctcactgggcagggatgtttttccatccccctacctgttgctggggccatttgtctttatcctcagtgaggctctgcagatggtgctgtcctttccatgaagttaggggtggaccagacttgtgt

SEQ ID NO: 38342 - DNA, 601 bp, Human
cgtctattacagcaagcagtaaatgacggataatttaggactggctgtgattatggcttttagttaatatgatcaaagtagagtcttactgtaaatccacggagccgggtgcagatgacatcactgaagtgcgtgctgtccggaagcttgtggacacactgctgtcccggtgattagatacaagtgtgtctcttttggctgccatctgctccctcctcactgggcagggatgtttttccatccccctacctgttgctggggccatttgtctttatcctcagtgaggctctgcagatggtgctgtcctttccatgaagttaggggtggaccagacttgtgtgttctgttctgtgctgctttttggtcttatcattgataactactttgaagagttccaaaaccttacatgtataagtggtcagaagcaattctttggtatttgattcacatagagacttttgaccatttgctttctaaagccacacagtgaatggacagcttgccattgtctagttgcttttattctctttcaggtgttgagccagtgcaggttcaggaaactgtggaaaatcacttgaagagtttgctgatcaaacatttt

SEQ ID NO: 38343 - DNA, 601 bp, Human
catctgtggctgggagcagcctcggggagctggccttggcacaaacaggatggcaggttcagagcacagtccttgaggacatccgtcacataggagagctgagagaaatgtttttctggctactccatgtggtgatgggccagaacacctgtgccatttaaatggcctctttctcttttgctaagggcatacaagctggggcagcatgagctccctgtgtgtgcaaggcagctctatgcggttctcggtgtctcctaggaagcaactttcagtaccctcctgtgttgagtccgattttctraaagctgagcgggcatctagggacctttctgtcactcagccgactgtgtggctgtggccagctctgggtctgcctcccccagaactagatgcccatggggagtccatcagcaccaatctcctgtgatcgtttatacaacagaatctccactcaagtaaaagtggggcctcctcctatcttgctgtttgtgtgtgtgttggcagaccccagcgtggctggaacagatgattgcacataccacgtggcgggaccttttttataaactggctgaagcccatccagactgtttgatgctgaact

SEQ ID NO: 38344 - DNA, 601 bp, Human
gttggcagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggt

SEQ ID NO: 38345 - DNA, 601 bp, Human
ctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcct

SEQ ID NO: 38346 - DNA, 601 bp, Human
gctgaggcaggagaatcgcttaacctgggaggcagaggttgcagtgagccaagatcgcgccattgcactctatcctgggcaacaagagcaaaactgcatctcaaaaaaaaaaaaaaaaaagaaagaaaatgtcatgttctacttcctgtttctaacacagtcactgttttcctcgttaaagctcactgcaaatctaacttcatcatggtgaactaatttagagcatcctccagagctgaagcagaacattccagaacccgttgtggaaaaaccctttcaagaagctgttttaagaggctckggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttatt

SEQ ID NO: 38347 - DNA, 601 bp, Human
cagaccctcagtggcaggggtggcctgcatgccccctgagcttcgggctctccccagtcgggcctcgcgtagtagcgcgcgctcttccaactccagcaacaggcgtgcagcaggactacgtgggcgctcgggctggtgtgtgcgcaggtgcgagcgcagcagagcccgctgcgccgcgcggtggccgcagtgagggcactggaaggcctgggctcctgggtgcgcccgcaggtgcaaagcaaggatagagttgaagcggaagcgcttcccgcatacagggcaggggaagcgccgttcgccygcacgactctcagaccagctcaccgctcccatcccgagcgaccctgcgctcacggctggcccgttggagtatcgctgcagatccagctcgccgtcgaaagccggcggcgacggcgctaagtggccgctcggggcgcggggacgtgagccctgtggagaaagatctgcgtagagcaaagggtgaaggtagagctgtaaaggaagcaagggcgtcgcctcgagggccagaaggacaacacgagggaaggtgggctggggcctgaactaggaacacagggtgctactcacctcgggaagatgg

SEQ ID NO: 38348 - DNA, 601 bp, Human
tattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaagactggcagagtggctcctcaacagggacacaaaccttctctgccagcccagggaccccgttctttgaccctcacctctgccacttctaaggcactgtgactcccttgggctgggtgggtaccgccagcccaccctcctacgcccgccgcsccttccacctctggtccgcctggggctgggatatgggtcccacgctgccccctgctggcttctctacccaactacctctagcgctcccccgctccggcggggtaagctcactaagctaatcgcccctgagggcccactaccgttcttgcccccccagccctgcctctccgggtctggacagcccggagccctcctccccttcctgcgaaggactgggaggggtctctcctgatggtactcgggcatagggcggggacgcgtcagcctggggtggccggcggcccctagcccggcggctgt

SEQ ID NO: 38349 - DNA, 601 bp, Human
tctgcgcaaagtctgccagccgggaaacctgaacatactagtgtcaaaagcctcagggaagccgggagagtgctgtgacctctatgagtgcaaaccaggtatgcacgagctctgtctcagcagccttgttcctttgcatcagagggtagcagatccctcctcagccacccctggcctctcctttcacacgaagatgggccttctcaccggtgtcctgtgaatctgccactttgggctaatggcagcttgacttctggccttctagtcagagaaccagagtgatcatccactggtacataarcgccttcggagagcgagcgtgtcttttcctcttttcttctttttttccttcaaagtatgcttgactggggaggtagggttaaaatttatggtactatggcaatctgcttcatttccccagagaaggtcagagaccttatttgcagctatatctgccactttgaattattacatttaaaaacaatcatcatacgtaaaacagaaagttatttttagatgaatacatgcatcaaaacgccagaagtttcataatgcaacactcagccccaatctttctctttgccaattcccccgcatctgc

SEQ ID NO: 38350 - DNA, 601 bp, Human
ccactttgggctaatggcagcttgacttctggccttctagtcagagaaccagagtgatcatccactggtacataagcgccttcggagagcgagcgtgtcttttcctcttttcttctttttttccttcaaagtatgcttgactggggaggtagggttaaaatttatggtactatggcaatctgcttcatttccccagagaaggtcagagaccttatttgcagctatatctgccactttgaattattacatttaaaaacaatcatcatacgtaaaacagaaagttatttttagatgaatacaygcatcaaaacgccagaagtttcataatgcaacactcagccccaatctttctctttgccaattcccccgcatctgccctctttactttatagcatgtgccaagtcatctttgactgtttactcaccctctttgccaacatttgatgtactgttgtatcccagctgtttcttgctttatattatttctaacatccttgctcttgtggcagcatttccgatgtggtctgtgaacacttctgagttatagcgatttcctctttgcaagtttctaatcatcggccagttgtttttttgtttgggt

SEQ ID NO: 38351 - DNA, 601 bp, Human
gtgttttattttattttgttttgcttcactttattgttttctgttacatgaacttacattgagttgagtaaatttccatcaacttataacctcctattagaaattttctagaggctgtttgaaaaacatcaaaggacacaactaaaaaatgactacaaatatgccttgtttgttttaactcttttcagatacaaagccagcctgcgtatttaacaatgtggaatattatgatggagacatgtttcgaatggacaactgtcggttctgtcgatgccaagggggcgttgccatctgcttcacygcccagtgtggtgagataaactgcgagaggtactacgtgcccgaaggagagtgctgcccagtgtgtgaaggtaagaaaaggtgctaattacagattaacaggagcatacatggtatagagttctaaaatcaaaatcgtcctaattcagtctcatccaaaagtaaaggaatattgaagttccttttttagccttttttaagacaccatggtctgtcttttagcatgttaaagccaggtagagtgtgtggaaacacttccctaagggaagctatgcctgggtgtagacaatgggtcacctct

SEQ ID NO: 38352 - DNA, 601 bp, Human
actgcttctctgaaaatatgtggtggttcacatggggtcgtggtatcaggtcaccacctggtgacaccaactcaaggcccagccaggtgtcaggtgtgactctcaggaatctgctttgtctggattccccttttctctccaagaagtaatatgttcatgttccttcaacaggctgcatcttcccatcactgatgttcataaacaataagcatttcaaaacagttgctctgaatatcactccctgcaacccacacattttacagattaggatgttgaagttcagaagagaaaagtcacttgyctgtaaagtcactttacactgcagccagtaacaataaccccgtgcctgactgtgtctatagtgttcttctgacaacacaacactgtttccccagaaaggaaggtcttgtgagccttcctgtcctaaccaggccccagatcttcaatctgaagtcgcatgtgttaatcttatgcctgatctctgcacacaaagtgggagggcacagtgtcatgccactttccatacttcctcattttcataaaattttctccttttgatatttgagcaatatttacaacataatattgaagatctgaaaat

SEQ ID NO: 38353 - DNA, 601 bp, Human
aatattgaagatctgaaaatgtttaaagtataaaaattgcattcctaacatagttcataacagtgagttcttttccctactagaggttattttacccaacataggagaaaagtagtttattttttaggtgatgttgacaattaaaaagaattacttcaaatttttaacctttctaattgttttgttccctacctgcccccagtctgcaatagttctgaaactgtgcagcagttgatgctgtaaaaatgtagatacgaacctctgtgtagtcatcatactgagttgtctgggcatggatccrgttatgtctcacttcctggaattcagatccaggctcaacgtagaaaaatatgtattctaatactttttacacaggaatttaaaaaatcttctcttgctcaggtccattggccgcctccctctctggcagactgccttcctaacgctgtgatggcattattttaaatgctgaccttctaactgactttattataatgtcccactatgtccttagaataatgatgaccaaactctatgaactgtctggattcctctctcagcacagcagtagttgtttgttgaagccagttttttatgtatt

SEQ ID NO: 38354 - DNA, 601 bp, Human
ctttctaattgttttgttccctacctgcccccagtctgcaatagttctgaaactgtgcagcagttgatgctgtaaaaatgtagatacgaacctctgtgtagtcatcatactgagttgtctgggcatggatccagttatgtctcacttcctggaattcagatccaggctcaacgtagaaaaatatgtattctaatactttttacacaggaatttaaaaaatcttctcttgctcaggtccattggccgcctccctctctggcagactgccttcctaacgctgtgatggcattattttaaatgytgaccttctaactgactttattataatgtcccactatgtccttagaataatgatgaccaaactctatgaactgtctggattcctctctcagcacagcagtagttgtttgttgaagccagttttttatgtatttctgagaaagaaaattgagtaatttatctggttgctctcaatagagggataagagagggtttcatatgcagtatttatatacttgtcagtaacctcagaaacttttttttttttacagtagctttggctacttctgtctcccacctggggctgcagcttagcttccca

SEQ ID NO: 38355 - DNA, 601 bp, Human
ttatgtatttctgagaaagaaaattgagtaatttatctggttgctctcaatagagggataagagagggtttcatatgcagtatttatatacttgtcagtaacctcagaaacttttttttttttacagtagctttggctacttctgtctcccacctggggctgcagcttagcttcccaacttatgggagaaaaaatggcctaagttcacagcgctcctccaaggcacagtgacccatggtatgtctagactagccttgtcatgaacaagtccacagcaagaccactgttgcccacatggtcstgcaggtacatgagatagagttttagaagtaacaatatcactctgacttagggcattgttgcttccgctttacagttagggaagttgaggtttgataaacatttatgtctacaactgcgaagacattgtcagagcctaaaatggagtcatgttttctaattaccaacccacagctcttgccacaaagctttccaactttacagagtgataacacctgcacattggtttttagactacagatcctcttctctgggactgctgtgtcaggatgagtagacataaattcagtgtgacagcttc

SEQ ID NO: 38356 - DNA, 601 bp, Human
tttttacagtagctttggctacttctgtctcccacctggggctgcagcttagcttcccaacttatgggagaaaaaatggcctaagttcacagcgctcctccaaggcacagtgacccatggtatgtctagactagccttgtcatgaacaagtccacagcaagaccactgttgcccacatggtcgtgcaggtacatgagatagagttttagaagtaacaatatcactctgacttagggcattgttgcttccgctttacagttagggaagttgaggtttgataaacatttatgtctacaactgygaagacattgtcagagcctaaaatggagtcatgttttctaattaccaacccacagctcttgccacaaagctttccaactttacagagtgataacacctgcacattggtttttagactacagatcctcttctctgggactgctgtgtcaggatgagtagacataaattcagtgtgacagcttcttttgcatgcacccccagagactcctcatgcaaccctgcgcttctgttgatcacagtgggaatagaactgctgatgactagaacccagggaaaaaatgtctctgggtactgacagaga

SEQ ID NO: 38357 - DNA, 601 bp, Human
attaattgtaatagttatcagcctgctgttcactcagagcctaccagatttgagtacactttagaaatctatgcatttcaaagttggactttattttgtttattattaccaaaacatggagtcatgtgataaccatgaaatagcacagtctatgctttttaatgataaccagtgccatggtagagctgagaaattgagatctgtggaagagtggaggattcagggaccgtatttcagcatcgaagtgttctgctctgttcatctttggaagaaacatgccgtctctgtgtcttcacagccraggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgtacgtatttgttaattcagaaaagctattatgaagtgcaacttggtgaaatgtttctacacattttgttttatatgttgtttgtgaattaatctatggtatattgagcccagaatgtctatacttgttttgttaggtgattcaga

SEQ ID NO: 38358 - DNA, 601 bp, Human
gactcctactttaaagaatatttttctcccctcttcattccaagatcagctgtttttcttcttgggatacatgagtatctcccgaactcttctaatgaatatttactaaatgatagtgtctctcagattttctgtcttccatacactctacatttgagtttctcttttgtctccatgtctctggcccctcttgtgttttgccttgaggcatatcgtacggcaaaaaggtgagccagaaagcatacctgcaaacacgcacgtcagatttcttctgaccacttccgtacatgtcagcatttarcaaggcagtaattgtcagtcctctctaagccctttttgaaagcaataagggaggcttttgctatattcatttatcgatactctttgggactttttgtttctctgtaaaccacagatgcacatttaccatcttgttcagcacagttttcattgtaattctcttcctctctgttgttcttatactggaaagttggttacagttgcttgtgaatgtaagcattgattgatgagtatcagttttctgtgatactgtccctgggtctaagttccagccttttgtaattcccttgagataaagctg

SEQ ID NO: 38359 - DNA, 601 bp, Human
ctgttgacagacttaaaccacttgaacctcacgtcctaatattagctcttttgccattgtcttctgtttccatgcatggaatattttcttcactattctcttaataagaatagagcgagatgctcttcacagttcatctcttctatcccttaaagcaaacagcaccaggctttcaagagttggaaagattgcagatgaataatgtgttctgattttgtgtcatttcccagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacaggtaagcgacaccatgccttgtgggtgcttggtggggaaggatgcagctctgggtgttgtcattctgtgggacccacagggcaggatcagccccatatgggagtgtgccaaacccagtatcccatcaggaacagctggcagcctgcttcctgcatg

SEQ ID NO: 38360 - DNA, 601 bp, Human
ttccttaaccctgcatctcaaactcgaggcgtatacctaagtagagaaagtcccaccgcaccaaattaaccaaaagattctgttactgtgaaaagtcatctttatgtaacaaatgagaagaatagttatttataaataatgtaaacaaaattctttgtaaataaaattctttgaaatataagggtggcgaagagactttgaaatatgcataatgccaccccctccaagttgggatgattagtaagttaatgccaaaaagcattaagtgactagcactgcacatgtataaggagtgctattrttttctactttttatttctcagataatctgaccttagcaggtaaatgtatggccatgaaacttgttagaaggaaatttgtcaagatgttaatcataagttactggttttatataactttagtagtacttttaattaatactagatgtgactttttcaaaagatatttaaatataaaattatcaagttgacaggactagttttgttttgttgttgttgcttcttattcccatatttcaacttaaatcaataaccatttactttctaaacatattcttagagcatttctgctcagcaaaaca

SEQ ID NO: 38361 - DNA, 601 bp, Human
aatccctcatgatgcttccatctgtagggtgccttgtcatttcctctcttcagctttccctcttctctggcctggtttaaagcaaggtctggtgaggaaatgaggaaagattgcacatcactgcaagtgaagctacttcaccagcatacaaaagggagagggtaaaatagcacttgtttctttccataagtttaaaattttctttcctttatttttagagttggaaaaaagcatggcagagaagagcgagggaggtagaaaataaaaagaaaaaaggaaacactgaaaacagtgaaaacaytggtaaagatcaaataaaggagtaaacgtttggaaacagaagtgtaaagaaaagggtctagagcaggaaaaatgagaaaagaggcccaaagaagggagatgctgtgggtaagattccaaatgacattgtcggtcagggttgggccaggagcctcctgcctggtggaaggaaacctgcagactctacctcggctccagccctcacaccgtcactgccagcgtatcctgatgtcctctgggttatttccaggcctcagtgagagccctgcagattccaggctgttcgtttcactgtcattcc

SEQ ID NO: 38362 - DNA, 601 bp, Human
tcagtgagagccctgcagattccaggctgttcgtttcactgtcattccatagcttcagcacggctgtcccttcttcttcttttcagtttttagacagaggttgggcaatgcttgcatgagctaagttaacgtaagtcacaaaaacctcatggagatttgcagggcctagtgtgaacaagagggtgttgtccttatttctagccaaagcaaaagttagcactggtcagtctcttagagaagaaattatccctcgacgtagataaccacgaaaaggtcattgagaaagtcatcccatcttacyatctctaacctatgtgggtgggatctgtggaatcatatctgtaataggacctagagtaccatggagccgtggaaccaatggctgttcttcaacttatgcctgctgcctttgggactagtcataggagatacagttactcagtttaaaggagagggtatgggccaatcccattatgctggctttcctgtccctcagagaaggtccacaatgaagtaactgccttggtcctcaaaaaggcccttcttgtcacatcctgcttactggctgtggggtatattcatgaggtggatagaaggaaaa

SEQ ID NO: 38363 - DNA, 601 bp, Human
gtggaagacctgcatttaaagaatatagttctggttcattctttttttacttcatcagttccagccagtacccataccatccacgcagccttctcccaagccctcagctgaactgcccatctctttccacacttaacgcaaccactgagtgtaccccagctggctgttgtgaatccccatgcctacatctttccccacgccccactctttgtgtctgctgcattatccctctcatagtttcaaacctaagtccttctcagctgcccagagcctcacctagcccttctcctagtttccatgyctgcatctcctgccaaacaattcctctttcccctgcgtctaatcccagaaatgtaagacctgagccctctccctggggactgacccctagacacacagatttcccggtggtatagaccacacagacccaagtgaaggctcactctaagatctcattgaggtcctcagcgagtcaggagcttttctgtcttacctcgattctcatgttttctcgcagcattatattagagaaccttgttgtattcaatacagggagctgggaaccatgccaattcacaagtgcatctgtactatgcagttg

SEQ ID NO: 38364 - DNA, 601 bp, Human
gcccatctctttccacacttaacgcaaccactgagtgtaccccagctggctgttgtgaatccccatgcctacatctttccccacgccccactctttgtgtctgctgcattatccctctcatagtttcaaacctaagtccttctcagctgcccagagcctcacctagcccttctcctagtttccatgcctgcatctcctgccaaacaattcctctttcccctgcgtctaatcccagaaatgtaagacctgagccctctccctggggactgacccctagacacacagatttcccggtggtatrgaccacacagacccaagtgaaggctcactctaagatctcattgaggtcctcagcgagtcaggagcttttctgtcttacctcgattctcatgttttctcgcagcattatattagagaaccttgttgtattcaatacagggagctgggaaccatgccaattcacaagtgcatctgtactatgcagttgtaagatagggcagttgttaaacccaaagagtttaagtgagctctgcacatgttggccttttgtttaggcgttgtgcagactagccccaattgagcatttctaaaaatgtccatt

SEQ ID NO: 38365 - DNA, 601 bp, Human
tggctgttgtgaatccccatgcctacatctttccccacgccccactctttgtgtctgctgcattatccctctcatagtttcaaacctaagtccttctcagctgcccagagcctcacctagcccttctcctagtttccatgcctgcatctcctgccaaacaattcctctttcccctgcgtctaatcccagaaatgtaagacctgagccctctccctggggactgacccctagacacacagatttcccggtggtatagaccacacagacccaagtgaaggctcactctaagatctcattgaggtcctcagcgagtcaggagcttttctgtcttacctcgattctcatgttttctcgcagcattatattagagaaccttgttgtattcaatacagggagctgggaaccatgccaattcacaagtgcatctgtactatgcagttgtaagatagggcagttgttaaacccaaagagtttaagtgagctctgcacatgttggccttttgtttaggcgttgtgcagactagccccaattgagcatttctaaaaatgtccatttatctcctaaaaaggataggatgttctgcaaggtaagggggtggaa

SEQ ID NO: 38366 - DNA, 601 bp, Human
gtgaatccccatgcctacatctttccccacgccccactctttgtgtctgctgcattatccctctcatagtttcaaacctaagtccttctcagctgcccagagcctcacctagcccttctcctagtttccatgcctgcatctcctgccaaacaattcctctttcccctgcgtctaatcccagaaatgtaagacctgagccctctccctggggactgacccctagacacacagatttcccggtggtatagaccacacagacccaagtgaaggctcactctaagatctcattgaggtcctcagcgagtcaggagcttttctgtcttacctcgattctcatgttttctcgcagcattatattagagaaccttgttgtattcaatacagggagctgggaaccatgccaattcacaagtgcatctgtactatgcagttgtaagatagggcagttgttaaacccaaagagtttaagtgagctctgcacatgttggccttttgtttaggcgttgtgcagactagccccaattgagcatttctaaaaatgtccatttatctcctaaaaaggataggatgttctgcaaggtaagggggtggaaccattttt

SEQ ID NO: 38367 - DNA, 601 bp, Human
gcatctgctgtattcctgatgaaacatttttctatctttaagcaaatactgcaatcagttgagcttttgccaccttctgtttgatccagtatgggctgccaggaaggctgtattcctgtcccattcttgcatcggttcattgtgtgatcttagtcaagactcaccaccaaagtttcacgcttccatttctcatctggatagcacatgccacctcccagaaatgctgtgaggattataccatctcagaaatgatggtgtgggagcacttcccggtctgtccagcaaacaagaaccttgcttyttcctttagacatagcaactaacattctgaatatcctctttctttacaaaacagtttcacctttaccatctttggatatgagtacagaacctatgagctgttaggtgattagcacctgtctctttacagaagaaactgaggctcaggaaaggtaagagggttatccgaagtcatggagctggttagcagaggatgagacccctgctcctaaattgacctcaggttccatctcccaaaaaaatgctgacctcagcttgtaagcaccaagcacctcgccccgtattccagaagaggacattt

SEQ ID NO: 38368 - DNA, 601 bp, Human
catctgctgtattcctgatgaaacatttttctatctttaagcaaatactgcaatcagttgagcttttgccaccttctgtttgatccagtatgggctgccaggaaggctgtattcctgtcccattcttgcatcggttcattgtgtgatcttagtcaagactcaccaccaaagtttcacgcttccatttctcatctggatagcacatgccacctcccagaaatgctgtgaggattataccatctcagaaatgatggtgtgggagcacttcccggtctgtccagcaaacaagaaccttgcttcktcctttagacatagcaactaacattctgaatatcctctttctttacaaaacagtttcacctttaccatctttggatatgagtacagaacctatgagctgttaggtgattagcacctgtctctttacagaagaaactgaggctcaggaaaggtaagagggttatccgaagtcatggagctggttagcagaggatgagacccctgctcctaaattgacctcaggttccatctcccaaaaaaatgctgacctcagcttgtaagcaccaagcacctcgccccgtattccagaagaggacatttt

SEQ ID NO: 38369 - DNA, 601 bp, Human
gtattcctgatgaaacatttttctatctttaagcaaatactgcaatcagttgagcttttgccaccttctgtttgatccagtatgggctgccaggaaggctgtattcctgtcccattcttgcatcggttcattgtgtgatcttagtcaagactcaccaccaaagtttcacgcttccatttctcatctggatagcacatgccacctcccagaaatgctgtgaggattataccatctcagaaatgatggtgtgggagcacttcccggtctgtccagcaaacaagaaccttgcttcttcctttasacatagcaactaacattctgaatatcctctttctttacaaaacagtttcacctttaccatctttggatatgagtacagaacctatgagctgttaggtgattagcacctgtctctttacagaagaaactgaggctcaggaaaggtaagagggttatccgaagtcatggagctggttagcagaggatgagacccctgctcctaaattgacctcaggttccatctcccaaaaaaatgctgacctcagcttgtaagcaccaagcacctcgccccgtattccagaagaggacattttaaggaagg

SEQ ID NO: 38370 - DNA, 601 bp, Human
agaagaaactgaggctcaggaaaggtaagagggttatccgaagtcatggagctggttagcagaggatgagacccctgctcctaaattgacctcaggttccatctcccaaaaaaatgctgacctcagcttgtaagcaccaagcacctcgccccgtattccagaagaggacattttaaggaaggcaactcttagagatgaccagatgcctctgaaagtaaaatatatccccagtaaattatcttgagttcctccaaagcgcaggtcaagtatgagcacaggagcgattgtgaccgtgtgcccrtgatcttcgtggtagggctggatgtagctttgtgtaaatctccctggcactgtccatctgtaatgccaacagctgtaaagggctcttctagtaaataccagaagggttatattttagagtcttgggttgaaggcggtctttggccatagaaggcggcctgggtctaggcgtggaaacaaatagcattcccacttctttttgtttcaacaagcagttttttaactgaaagaattgttctttttggcaaaactgctcagaggcagcttcccttttatgttcaaattaaagggaaatgactct

SEQ ID NO: 38371 - DNA, 601 bp, Human
tattccagaagaggacattttaaggaaggcaactcttagagatgaccagatgcctctgaaagtaaaatatatccccagtaaattatcttgagttcctccaaagcgcaggtcaagtatgagcacaggagcgattgtgaccgtgtgcccgtgatcttcgtggtagggctggatgtagctttgtgtaaatctccctggcactgtccatctgtaatgccaacagctgtaaagggctcttctagtaaataccagaagggttatattttagagtcttgggttgaaggcggtctttggccatagaagrcggcctgggtctaggcgtggaaacaaatagcattcccacttctttttgtttcaacaagcagttttttaactgaaagaattgttctttttggcaaaactgctcagaggcagcttcccttttatgttcaaattaaagggaaatgactctcttcccttggacttgaggactgtgaactggagctgtgcgtgttctgtgataaagaaggaggtgtgggtggattttaatcagagctgaactgagtggtggagtgagctaatacacaggacaggttatgagctgctggaagtaagaagtggctgt

SEQ ID NO: 38372 - DNA, 601 bp, Human
attccagaagaggacattttaaggaaggcaactcttagagatgaccagatgcctctgaaagtaaaatatatccccagtaaattatcttgagttcctccaaagcgcaggtcaagtatgagcacaggagcgattgtgaccgtgtgcccgtgatcttcgtggtagggctggatgtagctttgtgtaaatctccctggcactgtccatctgtaatgccaacagctgtaaagggctcttctagtaaataccagaagggttatattttagagtcttgggttgaaggcggtctttggccatagaaggmggcctgggtctaggcgtggaaacaaatagcattcccacttctttttgtttcaacaagcagttttttaactgaaagaattgttctttttggcaaaactgctcagaggcagcttcccttttatgttcaaattaaagggaaatgactctcttcccttggacttgaggactgtgaactggagctgtgcgtgttctgtgataaagaaggaggtgtgggtggattttaatcagagctgaactgagtggtggagtgagctaatacacaggacaggttatgagctgctggaagtaagaagtggctgtc

SEQ ID NO: 38373 - DNA, 601 bp, Human
tggcgacatggcttttctgcccatattcacccaggaaattcataccacacatgagagtttttcagtgggtgcattaaataccatccccctgcacacacctcccggaatcacctagtccagacctaccgaatcaggacctgtgagagtcagcacattttctaagctctttgggtaattctgatatgatttttaaaaatttgagagtcactggtttgtgctcaggcccctgcacctgcaaatggtaatgttttcagtaacttctatttttaattctcgagtttgcagggatgcactgaacctrtagaaactataattgttcccagttctttttatgtttaaaggttttataatataactaagaaagcagaagactattcttggaggcaacaagataacttgggctttggaatcacagaactgcatttgaatcccagctctaccacttactagatgcatgattttgagcgatttaacttaacctctctgggtttctttccctggctgggtacccagttaactcatgggggaagcttagcaagtactctcttctctatcactttcctcttctctcaaagtcatcttaaggtttacttctcaaaag

SEQ ID NO: 38374 - DNA, 601 bp, Human
cgttatgcttggatcaaaccagatgaccagaaagtcaaattcctggacctagtgtttttggctctctgtataattgttctgagtgtgctttagcattatgcttacattcattcagtcagtaaatattagtgcctgctgtatgccagaccctgttctagaggctagacttcaacatactgtaagtacgactattcttatgactgaagacctgtgcattgcatagtatctatgttataaagcccctaaagagaaattttctcatgcatcaatagcaagaaaatgtatgcttctcctaggcaaytgatttgttttaacctaaaagacattgtgaatcgtattaaagactgatagttgtttccgtttttggctttggctgctacaaagctcaaagctaactttgatggcttggttttagcacagaaacagaactggaagactgaattttgtaaacagacctcacttgcagcttcatttttctttcaccaagaccttccttaatttatatcttattcttcttgtatgacacatattcctaaaactgctttctatttgatttggaatatgggaaagtaaaattcattcttttattcattgtatattt

SEQ ID NO: 38375 - DNA, 601 bp, Human
tttggctgctacaaagctcaaagctaactttgatggcttggttttagcacagaaacagaactggaagactgaattttgtaaacagacctcacttgcagcttcatttttctttcaccaagaccttccttaatttatatcttattcttcttgtatgacacatattcctaaaactgctttctatttgatttggaatatgggaaagtaaaattcattcttttattcattgtatatttaaaatctgaattcatcaataaaatgttactctttgacatttttcttgatgctggaaaatatgtttctrtaaagttttattgccatctgcactggctaaaatgattaggaatgttttctacctcccattcctccctgctcccaccacccctccagaacacacacagaagcatatcatttaaaatctgagttttaaaccacagtgttacataccacaaagctctgtcacttcatgagctgaatttccagaacaatttaagagtaactccttttgatactgtgtgtcatgtgtctttaactaaattgatttttaatgcatttagaaaacctgactacaatgatttatttgaaacaaaacagaatataaaaa

SEQ ID NO: 38376 - DNA, 601 bp, Human
gaatatgggaaagtaaaattcattcttttattcattgtatatttaaaatctgaattcatcaataaaatgttactctttgacatttttcttgatgctggaaaatatgtttctataaagttttattgccatctgcactggctaaaatgattaggaatgttttctacctcccattcctccctgctcccaccacccctccagaacacacacagaagcatatcatttaaaatctgagttttaaaccacagtgttacataccacaaagctctgtcacttcatgagctgaatttccagaacaatttargagtaactccttttgatactgtgtgtcatgtgtctttaactaaattgatttttaatgcatttagaaaacctgactacaatgatttatttgaaacaaaacagaatataaaaataaggaaactttagggagtgccccctattggtatgtgtttaaccttatttttgtctgcaacattcattgtaagagagatattttaaaagaacataaaggtcatcattcataagtgcaaaactaaatgtagtcacctatgcaatataattcattaaggcagaaaaatgatctaataggcctaagcaagat

SEQ ID NO: 38377 - DNA, 601 bp, Human
agaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgtttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaacta

SEQ ID NO: 38378 - DNA, 601 bp, Human
gaccttactgggatgggctctgtctacagcaatgtgcagaacaagcattcccacttttcctcaagataactgaccaagtgtttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcastggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcag

SEQ ID NO: 38379 - DNA, 601 bp, Human
cagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtattta

SEQ ID NO: 38380 - DNA, 601 bp, Human
actaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggrgcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaa

SEQ ID NO: 38381 - DNA, 601 bp, Human
tcaatattttttttgtccttgcttgactttacagattgccctcctgagagcaaattcttgcccatgtctttttctgtgggtatctaggtctaaacaggttggggtaagatttttgtaaagcgcggtcagttaagactagaattttccaccacccattgatgagaaaatgttaaacttatcaaggaaatgaacgtcaagttgcacccctccctgctgcagaatagcaatcccgctgtgggcgaagtgaaactggacttcagtgagttcccagaacgaattttgcagacttcggtgcactccygggcctgataaccgatctgcccgtggagctgctaacacattcccccacttcttaggccagtccaaaaccgcaagactgtgccaccacattgctgttaatttcacagaagggttggcattctgtagtcttgacttaaaaggaagcaaggaagcactttgctggaaaactgactaaatgtcttgtgagtttgaggaggattttatgccaaactttggcctcatttagcttggaaggagacagaacgcttaagatatcatgaaggggattttatttttgtatcaactttatgcctttacaggc

SEQ ID NO: 38382 - DNA, 601 bp, Human
ttcctatgtatcacataatattgaaaccaagtctaagactttatattgtgactgataagcttacatgtttcagagtgaggcaactggttgcaaaatcgttttcttccacaactaacgtattaaatattctcagtttcgccatatttagacgtcccaaggttcaaaacaaatgcattgtggcactgcaattctctacattgtctaacaatttcttcaatattttttttgtccttgcttgactttacagattgccctcctgagagcaaattcttgcccatgtctttttctgtgggtatctagrtctaaacaggttggggtaagatttttgtaaagcgcggtcagttaagactagaattttccaccacccattgatgagaaaatgttaaacttatcaaggaaatgaacgtcaagttgcacccctccctgctgcagaatagcaatcccgctgtgggcgaagtgaaactggacttcagtgagttcccagaacgaattttgcagacttcggtgcactcctgggcctgataaccgatctgcccgtggagctgctaacacattcccccacttcttaggccagtccaaaaccgcaagactgtgccaccac

SEQ ID NO: 38383 - DNA, 601 bp, Human
tctgaaatgttgttggtgagtttcagtttgtggaaagtgacgactttggacatccactgttccccagtagcggggctgtccgggtgaatgtacatcctctttggcatttcggggtcggccttaccagccaccatccaccgagaattgtgaaatttataacgacagtcatcagcagctataatgtccatcaataaaatgtatttggcttttttatccagcccagaacatctcactttaaatggaggaaacattcgcctataaaacgaaagaatagaaaagaaaaagaaagataaaccacccrtaatcttgggtttgatttcctatgtatcacataatattgaaaccaagtctaagactttatattgtgactgataagcttacatgtttcagagtgaggcaactggttgcaaaatcgttttcttccacaactaacgtattaaatattctcagtttcgccatatttagacgtcccaaggttcaaaacaaatgcattgtggcactgcaattctctacattgtctaacaatttcttcaatattttttttgtccttgcttgactttacagattgccctcctgagagcaaattcttgcccatgtcttt

SEQ ID NO: 38384 - DNA, 601 bp, Human
tcgattaatatgaccctgtgatcagggtaggtttttccaaccacacgcatgcatgcacacacatgcacacacacacacacatcataacacagcagcataaaaggtaataaaaaccagaccagctactcaggatttctggctaggggagaaaagctggtctctactaggattctcctcccaggatcccaaatggcttttgccttaaatttttagctggttccttttgaatgtgacttcttgatccttcttccccaaggggaagaagatgaaccttaaaacagacaggacaaagcccaagagkgggggaggagtgggtggcatcaatgacagcagttctaggagtttctctgtggcaaaattagtatggcgtttttttgctcagcattgttcctacctagtcaaggtgtttttctgtctcctcgaggtgtcattgtcctttccccccaaatgctccacaaatcacaaaagacaactcaagactctcgtctccactctcttgtaactttctcatcctgacttaaagcagcttttaaggggaaggcaaaatatcaccattaaaaaggaaagccccttgagtttaccttatcattctggtatgcag

SEQ ID NO: 38385 - DNA, 601 bp, Human
attaggtggagaaggcccatggcctttttgtctgatcaaaaatgctacattttattattacattaacaacttcatttcacaggattctgggtctagagggcacatgcattttgcactttgagaaaaatgctatagtgtgtaatctttcaaatcccttccccttggtgggaagaagaagttatatacacagagttactcagaggtggaaagggggacccttggttggattcatgttcttggaataaattgctctattgaagacttcaggtttcacagggagagaagatcatgttttggtatwcacactaaagaaatttagctggaacatccccatcatgaagtccacagaggacccaaggacagtgacaatgacagtgagttcaaaatgaagtgtgttgtcaggtaaaatggactctctttgaagtccaggattgcagagcaggggtcttcagtccctcctcccaccccataactgctaacagccaatctgggaactggtgaatcagcagtaagggtcactttttctgtgcccatgaccttcaggccaccatagctctagatatcaggtgctttcccttttggggatccttctaacctccag

SEQ ID NO: 38386 - DNA, 601 bp, Human
gaattgataatggcagaacggacacctgtccttcaacaccagtactcagttgaaccgtttgtatttgccccagtccctgcagagagagatgagtgtcggacagatggctcacagcccggggacgatcatagattcttttttcgcttttaccacaccctctgtgggtgttccaccagaagaaaagaaaaagggatcctattttatgtttaaagcttaaatggattgaagacataaaggacttgcattttatttcactaaaaaacaggtttcttcccgttgagagtgtgtgtgtgtgtgtgtrtgtgtgtgtgtgtgtgtgtgtgtctttccaaataaatactgcttgctctttaaacacaggtaactgaggggggatttgagccatcttgtccactcctcacccacctcccccagctctacccccaccgcagatccccagtgctccacctcctctcccaggtcaattgttgctttatagctggatgttttctaggccaccttctcggttccaggtggcagagtcccttgcttcccccccacccagtccaacacattgtaacctagagttcaaagacagtgaaaagtcagcagttggagcctc

SEQ ID NO: 38387 - DNA, 601 bp, Human
gggctgtagcgcagccgcgggcgcatggtgttcagattgaggaaggggtggcggtgcaccgagctggaggctgccgcagaggaggcggccgccgctgcggccatgtacgtgtaggggtaagggaacaggcttccgaaaggggacatggccaggccctggggtgagaaaagagacacacagcgagtcagccgggtgggaggagcttatctcatccctctcctctcttctccccctccaacattgggcaagccatgaatccctggtatgttctgttgttgttgttgttgtgtttttttttttggggggggagataggtgggggcaggagagaagtcaacactcagaaatctctaggtacaaatcttagctgtgtcaccctaggccaagagactttgattaacttgtgcctcagcttccttataggaagaaaaaacagggaaatcataagtaattcatatacttattgaggactttgtagatattaaatgagtgaaagcctgcaatatgctgcacacagtgtgtgcagcccccaggaaatctccttgcacctgttaaatggggatacagattcagtttaccccacagaggtaaccaaggggaag

SEQ ID NO: 38388 - DNA, 601 bp, Human
gatggagtaggggctgtagcgcagccgcgggcgcatggtgttcagattgaggaaggggtggcggtgcaccgagctggaggctgccgcagaggaggcggccgccgctgcggccatgtacgtgtaggggtaagggaacaggcttccgaaaggggacatggccaggccctggggtgagaaaagagacacacagcgagtcagccgggtgggaggagcttatctcatccctctcctctcttctccccctccaacattgggcaagccatgaatccctggtatgttctgttgttgttgttgttgtgtktttttttttggggggggagataggtgggggcaggagagaagtcaacactcagaaatctctaggtacaaatcttagctgtgtcaccctaggccaagagactttgattaacttgtgcctcagcttccttataggaagaaaaaacagggaaatcataagtaattcatatacttattgaggactttgtagatattaaatgagtgaaagcctgcaatatgctgcacacagtgtgtgcagcccccaggaaatctccttgcacctgttaaatggggatacagattcagtttaccccacagaggtaac

SEQ ID NO: 38389 - DNA, 601 bp, Human
agggcaaaggattgggaaaagggtagggggctatattgttttctctctaaaagcaagcgttcaaaataaaaaccacaaatacattactgtggacatgcaagaagagacctacagcggctctgaaaacatcacaagaatattaaaaagacacagattttcttaatatagactaaacaaggatggtagggacttccctccccaaacaaagctgctcagtaatttattgagaaccgataatgcaagtccctataaagtttttaatctgcacaaacagaatcatgttaatgtgttcacttgtccsgattttttttttgaaagattttgtttttgtttccacttgacacagtgaaggaaaaatatatatataaatccgcactgagggagatgtctttgaacacctccccgcctggtgggcagagacccagaccagccttgctggaagttgctctggacataaatgttggaactcctacccccagtagctcaatgcaaccgacgtttctgagcccccagaatctgatccagatcccggacatataaaccacgccaagaagacaggggctgtctctagcacattctctcgagggagtccggggcccct

SEQ ID NO: 38390 - DNA, 601 bp, Human
agaacacaaaacctgacagttgcaattctatttacacagagctatgtacaatgtcaataaattaaagtttaattttccaagcattcatattccacctatttacaagagttatcaaataattacataaatactttgtctaatagtctcacttctttattatttttttaaaaccttgttattgcatatacaggaaagagaaagaactgtcaaagaacgacatgaatcctgctacagagcttagatataataaattcattttatgtgttttgcccactccttccctttaaatccccccctcccytgggtcactgatttgagggcaaaggattgggaaaagggtagggggctatattgttttctctctaaaagcaagcgttcaaaataaaaaccacaaatacattactgtggacatgcaagaagagacctacagcggctctgaaaacatcacaagaatattaaaaagacacagattttcttaatatagactaaacaaggatggtagggacttccctccccaaacaaagctgctcagtaatttattgagaaccgataatgcaagtccctataaagtttttaatctgcacaaacagaatcatgttaa

SEQ ID NO: 38391 - DNA, 601 bp, Human
ggaaaacaagaacacaaaacctgacagttgcaattctatttacacagagctatgtacaatgtcaataaattaaagtttaattttccaagcattcatattccacctatttacaagagttatcaaataattacataaatactttgtctaatagtctcacttctttattatttttttaaaaccttgttattgcatatacaggaaagagaaagaactgtcaaagaacgacatgaatcctgctacagagcttagatataataaattcattttatgtgttttgcccactccttccctttaaatcccyccctcccttgggtcactgatttgagggcaaaggattgggaaaagggtagggggctatattgttttctctctaaaagcaagcgttcaaaataaaaaccacaaatacattactgtggacatgcaagaagagacctacagcggctctgaaaacatcacaagaatattaaaaagacacagattttcttaatatagactaaacaaggatggtagggacttccctccccaaacaaagctgctcagtaatttattgagaaccgataatgcaagtccctataaagtttttaatctgcacaaacagaat

SEQ ID NO: 38392 - DNA, 601 bp, Human
agcaatctcagttatattttaaggaatttgaagtggagctggaaagtggcactccttccccaattttggtgaaaataggaaatagcactttcccccacttttggacattaaaaaagaaaacaaaaatgttgcagacaactcttttgaaagggtattggtgttggtgcaggaagtgtgttttctagtgttaacagcaattctgtgacctggaaataaacccaactaaaggaaaacaagaacacaaaacctgacagttgcaattctatttacacagagctatgtacaatgtcaataaattaargtttaattttccaagcattcatattccacctatttacaagagttatcaaataattacataaatactttgtctaatagtctcacttctttattatttttttaaaaccttgttattgcatatacaggaaagagaaagaactgtcaaagaacgacatgaatcctgctacagagcttagatataataaattcattttatgtgttttgcccactccttccctttaaatccccccctcccttgggtcactgatttgagggcaaaggattgggaaaagggtagggggctatattgttttctctctaa

SEQ ID NO: 38393 - DNA, 601 bp, Human
atataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatragcctaaggaccattctagatttattacgtgttttttgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttattt

SEQ ID NO: 38394 - DNA, 601 bp, Human
taccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtcatttgaaatatattaactttcaagactttattattaycagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaatttaatactctgagtttgctgtatgaaaaaatgtcttctaa

SEQ ID NO: 38395 - DNA, 601 bp, Human
ggagaattgtcgagggctacacataaaatagacttaataccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtmatttgaaatatattaactttcaagactttattattaccagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaattta

SEQ ID NO: 38396 - DNA, 601 bp, Human
gaattatgaattgaatgggagatttacgtttgcctgttttatccttcagtattcttagtttaaattaagtatgtgtcgtaagtcccttctttattaagcccatgaaacatgaaaaattatttttacccatcaaaacattaggaaatgaatgggctcctccctcttctcccaaaacttaaggccactagcatgattatagcgtacttcccatgtgcagtgtaacaggtaatgtaaaagacttttttttgttttgttttgagatggagtctcaccctgttgcccaggctggagtgcagtggcrtgatctcagctcactgcaacctctgccttccgagttgaggcgattttcctgcctcagcctcctgagtagctgggactacaggcgcctgccactatgcccggctaatttttgtattttagcagagaccgggtttcaccatgttggtcaggctgatcccaaactcctgacctcaagtgatccacctgccttggcctcccaaagtgctgggattacaggtgtgagccaccgtgccaggccaaagaagactttaatgaaaataatactacagagcagagacttttattgtcctctacccagtaa

SEQ ID NO: 38397 - DNA, 601 bp, Human
ggataggtggagatcaatttcctgagcacgctggagatggagcatatgatagtcgaatgattgggcttcacctatctgttatctcctacttcccctgctcttcacatttaattcatagcagtttgggaattatgaattgaatgggagatttacgtttgcctgttttatccttcagtattcttagtttaaattaagtatgtgtcgtaagtcccttctttattaagcccatgaaacatgaaaaattatttttacccatcaaaacattaggaaatgaatgggctcctccctcttctcccaaaasttaaggccactagcatgattatagcgtacttcccatgtgcagtgtaacaggtaatgtaaaagacttttttttgttttgttttgagatggagtctcaccctgttgcccaggctggagtgcagtggcgtgatctcagctcactgcaacctctgccttccgagttgaggcgattttcctgcctcagcctcctgagtagctgggactacaggcgcctgccactatgcccggctaatttttgtattttagcagagaccgggtttcaccatgttggtcaggctgatcccaaactcctgacctcaag

SEQ ID NO: 38398 - DNA, 601 bp, Human
tacactaattagaataatctgcattattttcctccacacagagggtgctaaaaacattgaagctttacaatatagactagtgggtctcatacaggattacatataatctaggctttatactaggtttattatatccttatacctaagaagtagaacctgggcatgttttaagctctctggttccttgtgttctttgatatggattgctctcattattcttgataatgttattcacaaaatgtgaataacttgaacatgcaacaattacatactttaacgcttggggtttgttgtgcttatstgctttgattcttcccccttacaccacaaagctccataggcagtgacaattaaaaatggataggtggagatcaatttcctgagcacgctggagatggagcatatgatagtcgaatgattgggcttcacctatctgttatctcctacttcccctgctcttcacatttaattcatagcagtttgggaattatgaattgaatgggagatttacgtttgcctgttttatccttcagtattcttagtttaaattaagtatgtgtcgtaagtcccttctttattaagcccatgaaacatgaaaaat

SEQ ID NO: 38399 - DNA, 601 bp, Human
tggaatatttcctgaagtggaagggatttacagagtaagaaactttagtgcatctttactatatgtttaactgcagctaagtggttttagaatttgtttttaacctggctcttttacctgctttcctgtaggtgtctttaaatgtaaagacactttgaattttaggtgtctcatttgaggtctatttcaaaagaaccaagactttattgtacagttgaaggtgagcagactagagactagtttattaccctggggagtcaaatttataaaattatggagtgtagtttactatgtaatataytttaatgtggttagatattacactaattagaataatctgcattattttcctccacacagagggtgctaaaaacattgaagctttacaatatagactagtgggtctcatacaggattacatataatctaggctttatactaggtttattatatccttatacctaagaagtagaacctgggcatgttttaagctctctggttccttgtgttctttgatatggattgctctcattattcttgataatgttattcacaaaatgtgaataacttgaacatgcaacaattacatactttaacgctt

SEQ ID NO: 38400 - DNA, 601 bp, Human
aatgggaaagtggaatatttcctgaagtggaagggatttacagagtaagaaactttagtgcatctttactatatgtttaactgcagctaagtggttttagaatttgtttttaacctggctcttttacctgctttcctgtaggtgtctttaaatgtaaagacactttgaattttaggtgtctcatttgaggtctatttcaaaagaaccaagactttattgtacagttgaaggtgagcagactagagactagtttattaccctggggagtcaaatttataaaattatggagtgtagtttactrtgtaatatattttaatgtggttagatattacactaattagaataatctgcattattttcctccacacagagggtgctaaaaacattgaagctttacaatatagactagtgggtctcatacaggattacatataatctaggctttatactaggtttattatatccttatacctaagaagtagaacctgggcatgttttaagctctctggttccttgtgttctttgatatggattgctctcattattcttgataatgttattcacaaaatgtgaataacttgaacatgcaacaattacatac

SEQ ID NO: 38401 - DNA, 601 bp, Human
tcacttcaggtcaggagtttgagaccagcctggtcaacatggtgaaaccctgtttctaataaaaacacaaaaaaaattagcccggcatggtggcatccgcctataatcccagctactctggaggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattattttggtggtgggtygtaagtttgaactaaatgaacaagataaagcattcttttattttattgtctgttgacttttaatctttccagaaggtgtctgccctgggatatagaagtaaaaatttatgtcgaatgtgataataatataagcaattgagccttgaaaatgtgctcaaaattcaagaggaatatttcttaatttctcttttgttttattttagcaaaaaatgggaaaaaaacagaatggaaagagtaaaaaagttgaagaggcagagcctgaagaatttgtcgtggaaaaagtactagatcgacgtgtag

SEQ ID NO: 38402 - DNA, 601 bp, Human
gtatttgggttttttgtttttgtgtttttttgagacagagtttttctcttgttgtccaggctagagtgcaatggcgtgatcttggctcaccgcaacttaagcctcctgggttcaagcagttctcctgcctcagcctcccaagtagctgggattacaggcatgcaccactatgcctggctaattttgtatttttagtagaaacggggtttctccatgttggtcaggctggtctcaaactcctgacctcagatgatctgcccacctcggcctcccaaagtgctgggattacaggcatgagccwctgcccccggcaatagcatttgctttaagatgaaatgttaagatggattccttctcagcccataggatcttctgattaaccatttcagggttttttttcccccatttttaatcctctcataaaaattttccccatttttagtcctctcataggaaatcttgagccattggaaagagctggttcacgttggtttcctgcttctcttaaatagtgtcataccaaagaaaatgcctgtttaaagtgaatttggttaccagtatagactttctcttgagaaaccaggaaggaaggatttttttc

SEQ ID NO: 38403 - DNA, 601 bp, Human
cttgaaatgcccttttgcagtcttgaggcctttcttacatatctgtctgcacacttcatatgcctgcatagcttgaaatgtccttctgtagccttgaggtgttcttaacttttttctgcttgctgctttacttgtgggatggctttaatgattgagcaattaaggtttatcttttttaaatagtatttgggttttttgtttttgtgtttttttgagacagagtttttctcttgttgtccaggctagagtgcaatggcgtgatcttggctcaccgcaacttaagcctcctgggttcaagcarttctcctgcctcagcctcccaagtagctgggattacaggcatgcaccactatgcctggctaattttgtatttttagtagaaacggggtttctccatgttggtcaggctggtctcaaactcctgacctcagatgatctgcccacctcggcctcccaaagtgctgggattacaggcatgagccactgcccccggcaatagcatttgctttaagatgaaatgttaagatggattccttctcagcccataggatcttctgattaaccatttcagggttttttttcccccatttttaatcctctc

SEQ ID NO: 38404 - DNA, 601 bp, Human
caattgatagcctttggggtctgttattgtatttagtttattttgtgaaggatcacaggttggccactttaaaagttcttaactttccattttaaaaattcattagtgttgtgagatatgtgtgctgttaatttcacttaaataatgggaaatttattttgactcatccacttttggaaaaaagtgctgggttaaggcaaatatatactataaaagaaaatagtgagcatttgaaactagcttatgaatgccatagtagtgaatgaatactgtatggcattttgtctgcctttttttttttgtaaaccttagtgtgtatccttttcattttctgtatttattgttgactttattttgttagccttctccctttgtggcagtagctgttttgtttttcatgtagtataggtatctgatacacttctgtctattacagtttgtctttgctcctcccaccattattcctaccttcttgtactgtacagtggcagaaagctgtttgggcccagtactcaagtatcttgactaatgagaatcataacacctgacttagaaatggtatccaaaaacgtcaggtgtttgctgcatgtttttgtatttc

SEQ ID NO: 38405 - DNA, 601 bp, Human
tggcataatttttcttaaatccccagaattctggagaagtattttcattaaagcccaatttaaagaacaaggtaccttgtgcacctaggttggagcaaaagtcattgaatctttcaaattactttggtcactttatcttgttttaacttactctaaaacatagaagaatattaagtttaattcattgcagtgttttgttttttaaacaaaatgatcgaaatcgcaaatatgagccagaagggagaaaaggctagattttttttttatcttattcagccatgtcatgttacaagtttttttraaccctggaatattcacataaaaatcatgaaattcaaagttacagttttcacaatatttaacattgcattaatcttaaacacgtaaaggtgaatgttaatgtctcctaggtaaaataaagcatttgtttttggcttgtatgtgctctctctgggtttcacactaaaaagggcacgttagtgatttttaatttgtgccatcattagattctgcattaagtctgtttaccctgcattagattctgcattagattctgtttaccctggaaaacagaagttgtttttgcacgcaattgatagcc

SEQ ID NO: 38406 - DNA, 601 bp, Human
ttgttggttggcataatttttcttaaatccccagaattctggagaagtattttcattaaagcccaatttaaagaacaaggtaccttgtgcacctaggttggagcaaaagtcattgaatctttcaaattactttggtcactttatcttgttttaacttactctaaaacatagaagaatattaagtttaattcattgcagtgttttgttttttaaacaaaatgatcgaaatcgcaaatatgagccagaagggagaaaaggctagattttttttttatcttattcagccatgtcatgttacaaktttttttaaaccctggaatattcacataaaaatcatgaaattcaaagttacagttttcacaatatttaacattgcattaatcttaaacacgtaaaggtgaatgttaatgtctcctaggtaaaataaagcatttgtttttggcttgtatgtgctctctctgggtttcacactaaaaagggcacgttagtgatttttaatttgtgccatcattagattctgcattaagtctgtttaccctgcattagattctgcattagattctgtttaccctggaaaacagaagttgtttttgcacgcaat

SEQ ID NO: 38407 - DNA, 601 bp, Human
gagatactggcttggcttaatagtgtcttaactagttcaaagaaggctaatctttgaaggacagtgcaatgtggattttgctgaggatttttatcttcaaatagaaatacacacatttttgcagcgttgaaaaatgttacataaaatggtaaagcccttgttggttggcataatttttcttaaatccccagaattctggagaagtattttcattaaagcccaatttaaagaacaaggtaccttgtgcacctaggttggagcaaaagtcattgaatctttcaaattactttggtcactttaycttgttttaacttactctaaaacatagaagaatattaagtttaattcattgcagtgttttgttttttaaacaaaatgatcgaaatcgcaaatatgagccagaagggagaaaaggctagattttttttttatcttattcagccatgtcatgttacaagtttttttaaaccctggaatattcacataaaaatcatgaaattcaaagttacagttttcacaatatttaacattgcattaatcttaaacacgtaaaggtgaatgttaatgtctcctaggtaaaataaagcatttgtttttggct

SEQ ID NO: 38408 - DNA, 601 bp, Human
caggcgccgggccagctccactgcccgcctggaggggccgggcggggggctcctggggagctgtcgtcactgcgggcaaaaccagggatgctggggtcactgagctggcctgacacccacaccctcctcctctatcccctacacacccaaagatccataaagcccccagctgcactgtccacagacatccctctggctggacacacccagtccccctcctatctccagccttccccttacctccgctgcccggccctcagcccctgtctgggactaccgggtgaggaaagagaggagggcwccgagaagggaaaggaaggcgagtgggaggccgaaagagagcctaagcctgcctagggggaagcggggcgagcgaggaaatgtgtggagcttggtgggggtgcggggagctggccctcgaggaggaggctgagggggctcggaggcgtccgaagggaaacccggaggagaggccggacagcgcaaggcggggacaggggaatggtgggtccctgctcgcccgctgcggctgtgacagcatctccgcggcttctccgtcccctctcgcctcgccctgcttcctggctggccctccagggtg

SEQ ID NO: 38409 - DNA, 601 bp, Human
acatggtgaaaccccatctctactaaaaacacaaaatttagccgggtgtggtgatgaatccctgtaataccagctgcttgggaggctgaggcaggagaatcacttgagtctgggaggcggaggttgctgtgagctgagatcacaccactgcactccagcctgggtgacacagggagactccgtctcaaaaaaaaaggcatttgcagtttaactgtaattcatgtttaaatgagagtcttggattttgtgtggcaatctagaccggtgagtgagacctgtgcaaatgtaacatagcccatgygctatggccattcattcattcattcattcatttccccctcatcccaccaccatcacaccctgaaggagacattataggtgcacagtcctgtgccaggctctccaggaaaacaaatgaccccacagttgccctattgaaaacacagagacctggtccccagcctctgtcccacagcctcccactgcacccgtcctcagggatactgatctgaaagcagcactggcacagggcctcactggcacacagctagcgccaggggtgatgggtgacagctgaaggggctgcggcccacccacgcac

SEQ ID NO: 38410 - DNA, 601 bp, Human
gcatctgcctcccagattttttgtgaacgtgcaacaaagtaagcactgactgttgagtaagttcccaagcagtgaccacaccctgtgtttccagctttccaaccccaccactcccattgcacctatggaagctgaatttgagtccctttccttagaaaatctcaagaaagctagggactttctctccaggaaggtttatatgccacaaaattttgctcccaatttttaggaggtttatacgcacacacaaaaacacacacatcccacccctgaggaagcccaagccaaaccctgtgctgcwgtgtaaatcatattgattgagcacctctcaataagtattattattattttaaggctagtcaagtgaagcagtgggagtggagaagggaccaagaaatctgtaactggttgtgatcaattagttgtaaacactactgtattcggaccagccaatacatattattaaatgaatgtaatgtccctatttgggtgtctccccctctcgccagcatgcaggtcccatgggcagggactattttgagagtgcttgccctaggtgagaggaagtcagagagactcttccccaagcagcagtgtcaag

SEQ ID NO: 38411 - DNA, 601 bp, Human
gcgcgctgtcactgtgccagtccagctggcagcctgagccgtgaggccgcccatctgcacggagagggaaagcagccctcgactagaggtctagaccccctccgcgaccccccgggaacctgccccttcaccagcagggatcaaaccccaaccctcttttctgcctggtcctccagcctcagccagccccaaggatggaagggctcctccactgggtgctcccagcagggtggcaaaatacaaatcgcctggctaaatgtgaatttcagagaaacaacaaataaaattttagtataaatayatctcgtgcaatatttgggacatgctttttttttttttttttttttcttctttttttgagacaagtctagctctgtcatcccggctggggtgcagtggtgtgatttcagctcactgcaacctctgcctccccggttcaagcgattctcctgcctcagccctccaagtagcttggattacaggcgcccgccaccacgtccaggtaatttttgtatttttagtagagacggggtttcactgtgttggccaggctggtctcgaactcctgacctcgtgatccacccgcctcagcctcccaaaa

SEQ ID NO: 38412 - DNA, 601 bp, Human
gcggggccgcacgggcttcctggggggatttgggcggcggcgacctctcggcgcgcggggcagcgggcagccgcgctcgctctgcgtatccgaggactcgtcgatgaaggccaggttctcgctgggataatccagggccgaggccgtgggcggggaaggcggctgagccttctcggggggcgaaggggatcggggcctgcccagcggctgcgctggacagggcggtggaggcagcagtggctgctccttctccggcggcggggcggcgggcccggctcgctgggtcacgcgcgctgtcacygtgccagtccagctggcagcctgagccgtgaggccgcccatctgcacggagagggaaagcagccctcgactagaggtctagaccccctccgcgaccccccgggaacctgccccttcaccagcagggatcaaaccccaaccctcttttctgcctggtcctccagcctcagccagccccaaggatggaagggctcctccactgggtgctcccagcagggtggcaaaatacaaatcgcctggctaaatgtgaatttcagagaaacaacaaataaaattttagtataaatatatctcgtgcaat

SEQ ID NO: 38413 - DNA, 601 bp, Human
aaagggcgaaagattggcgcgggcgcctctcccagagaatcctagaaacttggatcccatcagcttccccccattttacagctccagaaattgagtccctggccagcttattgccctgcgggtgcccacggcctggcgaggccacactgaccggcctcgatctgggatgcagtgtccttctcccccagattgatttccatggagctgccgcggtgcaactccagctccaccagcgcgtgctcgtccagttcctccggcttgtggctggccttgtacccctcgtccaacgagccccgccccrggctgtgccacccgcgggtcttgctaatgttgcggccctcctcgtcgaagccctcgcagacctcggacagcggcatgttcagctgtgcctgggacagcgtggtcgtggtccacaggtcccgagtgtcgctatgcacgctctcctcgtccgagccttggcggtcggaagacttgagcgacacctgtgggccacatacaaggagggagccaagggtcgcggatggctggagcgggaaggaagagcgggctggggaactgagccgggccgggttggggatcccgtagaacgtggggttgggtg

SEQ ID NO: 38414 - DNA, 601 bp, Human
cagctcttggccgggcacggtggctcatgcctgtaatcctagcactttgggaggccaatgtgggcggatcacaaggtcaggagttcgagaccaacctggccaacatggtgaaacccccgtctctactaaaaatacaaaaattagccgggcttgctggcaagtgcctgtaatcccagctactcgggaggctgaggcaggagaatcacttgaaccagggaggcggagcttgcactgagccgagatcgtacatctgcactccagcctgggtgaagaagtgagactctgtctcaaaaaaaaactaaaaaaaaaaaaaaaaaaagaacagctcttggctcttggccaagtggtggctcacgcctgtaatccaggcacttcgggaggccaaggtgggcagatcacaagatcaggagttcaagaccagcctggccaatatggtgaaacaccgtctctactaaaaatacaaaaattagccaggcatagtggcaggcacctgtaatcccagctactcaggaggctgaggcaggagaattgcttgaaccagggaggcggaagttgcagtgagccaagatcgcaccattgcactccagcatgggcaacagag

SEQ ID NO: 38415 - DNA, 601 bp, Human
agaggcttaggcgtccaggtacttcatctctgcccacagctgaaatgcccccacctcctccctgtggcccccaaacccccaaccagcctgcctgcccctccaccctgccaaccacccccaactttcatatcctatcaacccccaatttgcctatcccctaccccaccgaaacgcccagtctccccagcccctccaaccctgctctgctgctctgcccagtaggctcgatggggcatgtgcttcgcaatattgagtgatgacattgaggaagacttttctgggagaagagaaaaaagggttrgtcatccgcagactcctgggccttccctggagcacaggagatgggtaggcaccttgtgagagggaatggccttcagagaccagctcctggtgcagccttggggtcagcatgggacagaggttacaaccctgggctttagagccccacccacatggttccagtaatgactgccccacagtgtgacacttaggaccagtgactgacactctctgaccctcaagttcttcatcagtaaaatggggtaataagaacagctcttggccgggcacggtggctcatgcctgtaatcctagcactttg

SEQ ID NO: 38416 - DNA, 601 bp, Human
gatgccgcaggagagagaagttcaccagtaagtgtgccctggcctgcccagccctgtcagcactcgaccttttctctgctgctgacgaccccacctcttatcttgcagcccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctcygaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccacta

SEQ ID NO: 38417 - DNA, 601 bp, Human
gatttgcagctgagcctgtctatctggtgtgggaagaagatggggagttacttgtcagtcccggcttacttcacctccagagacctgtttcggtgagttggtctccgagttcccctctccatctctcctggcccctggtcctgagaggagggtggtctccctaaatctccttctcacttagtcctttaccatcggttctgccgggcagaagccagcggaggttatacccaaggagaatcggccttgtgaggtacccccattatgtcctggaagtggtgaggggagggatatacccagaagraacttcttagggagctccagctccccttctatcccagacaaacctgaaggagcctccaaaagatgccactgacctgcccattgtagatgttactgcttccggggggaatagcccaaatagagtgctgtttccagctctcacatgtcttacctgcgggccatgctgcctgcccaggaatttgtcccaacaagcaggatgggcaggttttgccaaactgtggaaactggcaagtcctgggtgtgggtagcctggtacacagtaggcaccttataaacgtttgttctcttaatggcaggcaca

SEQ ID NO: 38418 - DNA, 601 bp, Human
tggggaaagacctgggcgagtgcttctaagactggagcaatgggctttagagtgttcctgagctgctgggccagcccccacacctcctcagtccctaggcctaagtacctccacgagcctctctctgtggggcttctcagagggagatgtggaaactctacctctaacctggctttctttgctcattgccccactccacctcccatagaaactccccagggggtttctggccctctgggtcccttctgaatggagccattccaggctagggtggggtttgttttcattctttgggagcagsctgttgttccaaaaaggctgcctccccctcaccagtggtcctggtcgacttttcccttctggcttctctaagctaggtccagtgcccagatcttgctgccgggatactagtcaggtggccaggccctgggcagaaaagcagtgtaccatgtggttttgtggaatgaccggaccctggtagattgctgggaagtgtctggacagggggaagggggaagggaactggtcctcaatgctgactctaccaagcgccctgctagacactttatcctttaatctctcaacagcctaaagagattat

SEQ ID NO: 38419 - DNA, 601 bp, Human
agatgtggaaactctacctctaacctggctttctttgctcattgccccactccacctcccatagaaactccccagggggtttctggccctctgggtcccttctgaatggagccattccaggctagggtggggtttgttttcattctttgggagcagcctgttgttccaaaaaggctgcctccccctcaccagtggtcctggtcgacttttcccttctggcttctctaagctaggtccagtgcccagatcttgctgccgggatactagtcaggtggccaggccctgggcagaaaagcagtgyaccatgtggttttgtggaatgaccggaccctggtagattgctgggaagtgtctggacagggggaagggggaagggaactggtcctcaatgctgactctaccaagcgccctgctagacactttatcctttaatctctcaacagcctaaagagattatatatccccattttacagatgaggcaaccagtttcaacagagttaacatatggagcctcactgggcagctttttctgtcttcctgactttctctcatccttcagggggctgcaggtttgttttcttctcctagtggagaggaaat

SEQ ID NO: 38420 - DNA, 601 bp, Human
aagtagaagctagacttcttgggctcctgaacagggtccttgctggattctgtgaaacaaattaagttcttgaccctaggcctctgggggagtacaaagtctatgggagttctggggctgtggttgcaaggaaagtgacgcaaccagattccatggggacatgatcaggcgtgacatgtgagggaggaagagggagcaagggaatgaagaatacaacttctgtgtcccatacacccctgcctgacaggccatacatactcagcagagaatgcactgtctttcctaccacactagcgtgagragtgagctgcaattaccactgtgcttccaagtaagaaaatacctcaaattggaatttacaaaagaggtaaattagggagtggcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactctt

SEQ ID NO: 38421 - DNA, 601 bp, Human
aatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacaacaataacatattccataataattacagcttaattggcagactgtttcagtctataggatctgcaggaaggaggagtaataaagggatttttgactgagctcttatggaacagagtctctctaggcccctgtcatatctgcccttctgggccctggggaaaagttggcatccccagttgtggtgctctccaggtgccctcaggctgtggtggagggagcttcccattctctccttcagcccactcaat

SEQ ID NO: 38422 - DNA, 601 bp, Human
ggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggcyaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaagttgatttctatttggatagataaataattcattttaggacctttctt

SEQ ID NO: 38423 - DNA, 601 bp, Human
accccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccmtgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaagttgatttctatttggatagataaataattcattttaggacctttctttttcacttacagaaatctgtttcattctgggctgagaagcaggtccatattgctaggcatag

SEQ ID NO: 38424 - DNA, 601 bp, Human
cagctgggcttggtggctccttcctgtaatcccagcactttgggaggccaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaagttgatttctatttggatagataaataattcattttaggacctttctttttcacttacagaaatctgtttcattctgggctgagaagcaggtccatattgctaggcataggagaaaaaggggtctgtctgcatttgcccttggtggtctcaaattggggagggaaagaaatgaacacttactggctaccttctgtgagccaggcatcatgcaagacatctgtacataatttaattctcataaccccataagatattattagcaatgtacaagtgaggaaactgaggctcagagtcatgaa

SEQ ID NO: 38425 - DNA, 601 bp, Human
gcagtggtgcaattttgggtcaccacaacctccgcttcccaggttcaagcgattctcctgcctcagcctcctgagtagctgggactaccagtgcacgccaccacgcccggctaatttttgtatttttagtagagacagggtttcaccatgttggccaggctggtcttgaactcctgaccttgtgatctgcccgcctcagcctcccaaagtgctgggattacaggtgtgagccaccgcgccctgcctatattaggacttttatataagctatctctagctagctagctagctagctataatkttttttgagacagagtctgactctgtcacccaggctggagtgcagtggcgtgatctcgactcactgcaacctccacctcctgggttccagtgattctcctgcctcagcctcccgagtagctgggattataggtgcatgccaccacgcccagctaattttttgtatttttagtagaccaggtttcaccatgttggccaggctggtctcgaactcctgacttcaagtgatccacccgcctcggcctcccaaagtgctgggattataagcataagccactgtgcccagctgctctctatattt

SEQ ID NO: 38426 - DNA, 601 bp, Human
ctgacttcaagtgatccacccgcctcggcctcccaaagtgctgggattataagcataagccactgtgcccagctgctctctatatttttaatacatattatttccattaattttcacagcagttcattttatagatgaggaaactaggccagagaagtaaaatatcttgcccaagatgatgtaactagtaagtggcaggatcaagattcaaaccaagcaatgttcaaacctcttggaagcaagaatgtggccactgtggaaggtgcaaggccttgacaacaagaatagggaaaagaaggarctagaaggaaagagatggcatgggctcagcaggccagggagctcttagctgtgtgtgttgggaagctcagaagggaggaagaggttgtctgtgcaggtaagtcctgagaacacaccagacttttgagaggtggagcttcatagccaggtcattaggggagaagggagctatagattttttttttttttttttttttttttttttttttagagacggggtcttactatgttgcccaggctggtcttgaactcctgggctcaagtgatcctcccacctcagcctcccaaagtgctgggatta

SEQ ID NO: 38427 - DNA, 601 bp, Human; identical to SEQ ID NO: 32594

SEQ ID NO: 38428 - DNA, 601 bp, Human; identical to SEQ ID NO: 32595

SEQ ID NO: 38429 - DNA, 601 bp, Human; identical to SEQ ID NO: 32596

SEQ ID NO: 38430 - DNA, 601 bp, Human; identical to SEQ ID NO: 32597

SEQ ID NO: 38431 - DNA, 601 bp, Human; identical to SEQ ID NO: 32598

SEQ ID NO: 38432 - DNA, 601 bp, Human; identical to SEQ ID NO: 32599

SEQ ID NO: 38433 - DNA, 601 bp, Human; identical to SEQ ID NO: 32600

SEQ ID NO: 38434 - DNA, 601 bp, Human; identical to SEQ ID NO: 32601

SEQ ID NO: 38435 - DNA, 601 bp, Human; identical to SEQ ID NO: 32602

SEQ ID NO: 38436 - DNA, 601 bp, Human; identical to SEQ ID NO: 32603

SEQ ID NO: 38437 - DNA, 601 bp, Human; identical to SEQ ID NO: 32604

SEQ ID NO: 38438 - DNA, 601 bp, Human; identical to SEQ ID NO: 32605

SEQ ID NO: 38439 - DNA, 601 bp, Human; identical to SEQ ID NO: 32606

SEQ ID NO: 38440 - DNA, 601 bp, Human; identical to SEQ ID NO: 32607

SEQ ID NO: 38441 - DNA, 601 bp, Human; identical to SEQ ID NO: 32608

SEQ ID NO: 38442 - DNA, 601 bp, Human; identical to SEQ ID NO: 32609

SEQ ID NO: 38443 - DNA, 601 bp, Human; identical to SEQ ID NO: 32610

SEQ ID NO: 38444 - DNA, 601 bp, Human; identical to SEQ ID NO: 32611

SEQ ID NO: 38445 - DNA, 601 bp, Human; identical to SEQ ID NO: 32612

SEQ ID NO: 38446 - DNA, 601 bp, Human; identical to SEQ ID NO: 32613

SEQ ID NO: 38447 - DNA, 601 bp, Human; identical to SEQ ID NO: 32614

SEQ ID NO: 38448 - DNA, 601 bp, Human; identical to SEQ ID NO: 32615

SEQ ID NO: 38449 - DNA, 601 bp, Human; identical to SEQ ID NO: 32616

SEQ ID NO: 38450 - DNA, 601 bp, Human; identical to SEQ ID NO: 32617

SEQ ID NO: 38451 - DNA, 601 bp, Human; identical to SEQ ID NO: 32618

SEQ ID NO: 38452 - DNA, 601 bp, Human; identical to SEQ ID NO: 32619

SEQ ID NO: 38453 - DNA, 601 bp, Human; identical to SEQ ID NO: 32620

SEQ ID NO: 38454 - DNA, 601 bp, Human; identical to SEQ ID NO: 32621

SEQ ID NO: 38455 - DNA, 601 bp, Human; identical to SEQ ID NO: 24073

SEQ ID NO: 38456 - DNA, 601 bp, Human; identical to SEQ ID NO: 24074

SEQ ID NO: 38457 - DNA, 601 bp, Human; identical to SEQ ID NO: 24075

SEQ ID NO: 38458 - DNA, 601 bp, Human; identical to SEQ ID NO: 24076

SEQ ID NO: 38459 - DNA, 601 bp, Human; identical to SEQ ID NO: 24077

SEQ ID NO: 38460 - DNA, 601 bp, Human
tactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttgcctgctttttaatgggatgggttgttttctttgctgttgagttgttcacrttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaatccatttttagttaattttttat

SEQ ID NO: 38461 - DNA, 601 bp, Human
aaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccrgtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactc

SEQ ID NO: 38462 - DNA, 601 bp, Human
taccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctmatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtg

SEQ ID NO: 38463 - DNA, 601 bp, Human
aggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaraggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctggg

SEQ ID NO: 38464 - DNA, 601 bp, Human
ccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcargtgctggccgcaggtgggacagtttgacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaatacca

SEQ ID NO: 38465 - DNA, 601 bp, Human
agttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagggggtgccagacagctctgtgcaacctctaggccatgagtgggatagataccactgctgctttaaaaaatgggagaccatagaccctcaggagagaagaatcccttctaccctggactcgctctcttckctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagaggatgaggcagacatctgggaaaagtccagctggggcaagcatttga

SEQ ID NO: 38466 - DNA, 601 bp, Human
tgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcaygcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagt

SEQ ID NO: 38467 - DNA, 601 bp, Human
ccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagagratgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaaccta

SEQ ID NO: 38468 - DNA, 601 bp, Human
gaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaargaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaatttt

SEQ ID NO: 38469 - DNA, 601 bp, Human
cctttaaccgagtgattttggggccccaagatttattttcctttcacaacttatatggaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctatt

SEQ ID NO: 38470 - DNA, 601 bp, Human
gaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaa

SEQ ID NO: 38471 - DNA, 601 bp, Human
acaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaaaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtacca

SEQ ID NO: 38472 - DNA, 601 bp, Human
acttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaraaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtaccagttt

SEQ ID NO: 38473 - DNA, 601 bp, Human
tcctactactcacttatgcctgccagctgtacagtcagactagaaactagattccagggccattaggatgctcagggttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggkaaagctgcacattccaaattattataagctcctttttctgcaaggaaacacagggtcactttctgagaaaagcaacctacaggggaattggtaacttgctttttgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatct

SEQ ID NO: 38474 - DNA, 601 bp, Human
gttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgctttttgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggc

SEQ ID NO: 38475 - DNA, 601 bp, Human
gggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgcttttygttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggcttagagtaaacacaccataaacgttagc

SEQ ID NO: 38476 - DNA, 601 bp, Human
ttccctgctatatagaaccctaactttagtctgtcagggagaaggatttgagactgatctcccatctcctcagctgcagcacctgattaaagccttcttcttggcaacacttgtttccgccattggctttctatgtggtgagcagcaggacctagactgaacccctggtgtttcagtaacagtaatcaatcaataaatgtgtttattttatttttatttttattttgagacaaagtctcactctgtcacccaggctggagtgcagtggtgcaattatggcccagtgcaacatccacctctyggggtcaaggagttcgcatgccttagcctcctgagtagctgggattacaggcacctgccaccacgcccagctaatttttgtatttttagtacagacggggtttcatcatgttggccaggctggtctcaaactcctggcctcaggtgatccgcctgcctcagactcccaaagtgctgggattacaggcatgagccaccgtgcctggctaaataaatgtgtttataaacagtggaactcagctagcaagaatggaaacccattgattaaaccagcccctgtccccagacctccagggccctg

SEQ ID NO: 38477 - DNA, 601 bp, Human
taaaccagcccctgtccccagacctccagggccctgctgccaccttgcctgcctcctcaaagtccctgtaccctgacattctgaagtaaaatattcacaggatggactcaatgacagaatatattgcatgtaaaatataaactttcctttcttccagatgtatgctaactatgccaacacaaacaattttttaaagaacccacttgctccctactaatttggataattccctttctcgtttataattccatctcttgtccctccattaggttctgctgatcttgtcttgggttaacaccayactgttttcattacagtcagtttagactacactttattatctaatgggccaagtcacccttccctactatgttttatgtaaaggtacctgtcctctgaccgattaagcaagagtcgtgtgctatcaaactataactgaccttcattgtagagcaaccctggctctctaaaaccaggttacataaataacaacgttccaatttctgtttcacatcaggcttaaatgataatcccagcccctggatctatcgagagctcaaaagatccttggataagacaaatgccagtcctggtgagtttg

SEQ ID NO: 38478 - DNA, 601 bp, Human
tccaactgtctatatatggttatcattcatttcctttttatcgagataattgacatccagtaaagtgcaacaatcttaggtatacagctcaacgcattttttacaatcttaccagcaacacccaaatcaacatagggaacgtttcgtgtaccccagaaggtgcctcaagcccattgtccccctagtaatcctcccaaacaaacccctattctaacatctattaccaccgcagattagttttgcttgattttaaacaaacaatgtaagtgggattatatggtacatacttcatgtctgcctyctttggctcaacgggatgtctgagagactcattcatatggttgcagggtcttgctctgctgcccaggctggagtgcagtggtgggatcttggctcactgcaacctgtctcctgggctcaagcaatcctcccatctcagcctcccaagtagctggaactacaggagtgtgccaccatacctggctaatttttgtattttttgtagagatgaggtttcaccatgttgcccaggctggtcttgaactcctgggctcaagctatgtgcccacctcagcctcccaaagtgttgggattacagaca

SEQ ID NO: 38479 - DNA, 601 bp, Human
ctcagcctcccaaagtgttgggattacagacatgagccatggcacccagccatagtagcactttttttcattgttttcccatattcaattgtattaatgtaacacacatttatccattctgctgctttgggtcattttcaaattggggcaattttcaaatagatgattgggtcattttcaaattggggcaattatgaattaggttactatgggtatttccctacatgtctttttgtgaatgtaagcattcatttctcttggataaatatgtagcagtagaattgctgggctatccagtgcmcatatatgaatgttgtgtacatatatgcgtgtaaatatataaaatatatatgtagtttgtttttttgtttaaccatagcaaatcttgccgaatcatttccaaaatcttaccaaattatactcccatcagcaagatgtgagtttcaggcatattctcaaacccaactggggatctgcccacccagcgcagcaaagccaaacagactttgggattgcagtgagagagtgaagcatttattgcagggagccaagcagggagaattgggcagctcatgtttaagagccgaactccccgatggct

SEQ ID NO: 38480 - DNA, 601 bp, Human
ccatcccagttgttccacatctttgtcaagacttggtattgtcagtccactgaactgtaggcattctagcaaaggacaatgacttcctgtagacctctggtttcttgatttcagatccctgacatggtaagaactagatccccaaatgagctgctaccctttccttatcccacagtgccagaaaaaaatcaaggatttaccctcgctgtctccgtatgccctggagctgcttacggtgtatgcctgggaacaggggtgcagaaaagacaactttgacattgctgaaggcgtcagaaccgtwctggagctgatcaaatgccaggagaagctgtgtatctattggatggtcaactacaactttgaagatgagaccatcaggaacatcctgctgcaccagctccaatcagcgaggtgccaagcttctcacaccctatccctgtacctcatcatccgcatgccaggcatacctctttggaatgagatctcagccttgccctatcaagccagtgctggaccagaagaatggcagccaccatgggtggggaggcagatgggtctgtctgaaagaggggaggtccagccagtgcttttcacattccaa

SEQ ID NO: 38481 - DNA, 601 bp, Human
aactggacccagaaggatcaggacgctctgagcagtcacccctgtgcccaccctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttayagttgtttttaatctttttttaagagatggggctataactcgctacattggccaggctggtctcaaactcctgggctcaagtgatcctcccacctggcctcccaaagttctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatat

SEQ ID NO: 38482 - DNA, 601 bp, Human
ctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttatagttgtttttaatctttttttaagagatggggctataactcgctacattggccaggctggtctcaaactcctgggctcaagtgatcctcccacctggcctcccaaagttctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagg

SEQ ID NO: 38483 - DNA, 601 bp, Human
gcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttatagttgtttttaatctttttttaagagatggggctataactcgctacattggccaggctggtctcaaactcctgggctcaagtgatcctcccacctggcctcccaaagytctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagggcctttataggacattcttttccaacccagaagcacatgtggcatttagttccaaa

SEQ ID NO: 38484 - DNA, 601 bp, Human
tatacatatatacacatatatacacatatatatacacatctatacacatatatatatacacatatatatatatacatatatatgcttcctcaccttttcaagctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcaygcctgtaattacagcactttgagaggctgaggtgggaggattgcttaagaccaggagtttgagaccagcctggggaacctagtgagactcccatctctacaaaaaaaaaaaaaaaaaaaaaaatagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggtt

SEQ ID NO: 38485 - DNA, 601 bp, Human
gctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaggagtttgagaccagcctggggaacctagtgagactcccatctctacaaaaaaaaaaaaaaaaaaaaaaatagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctattgggttctatgctcactacctaggtgatgggatcattcatacaccaagcctcagcgacatgcaatttacccatgtaaaaccccacac

SEQ ID NO: 38486 - DNA, 601 bp, Human
atggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaggagtttgagaccagcctggggaacctagtgagactcccatctctacaaaaaaaaaaaaaaaaaaaaaaatagctaggygtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctattgggttctatgctcactacctaggtgatgggatcattcatacaccaagcctcagcgacatgcaatttacccatgtaaaaccccacacatgtacctccttgaacctaaagtaaaagtgg

SEQ ID NO: 38487 - DNA, 601 bp, Human
acgagcaggagggcagttgggagaggcagggtagggggcccagtacaggcaggaaaagaagccttgggtgggcttacaggtgccactcacacttggggtcttccttccttccccagcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccgggtgagcactggccyttctcatgtcttgttggaatgatgtaatattgggcattcctggaagggaggtaagtgggcattgtagctctccaggatccatctaccttcagaaacttgaggaagggaagccaggagttaagggaactaggacactagttttcaggggggttgtggatagactgcctaggtcattaacaacacaactttgattctgtattgtttttcttggagctgttggccgtccttggggctcttgggcctggagacacatcactcccgtctctgcctctgtcatcaccttttcttctgtgtcctccc

SEQ ID NO: 38488 - DNA, 601 bp, Human
gagcctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatggggstgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaa

SEQ ID NO: 38489 - DNA, 601 bp, Human
cctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatgggggtgygtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataa

SEQ ID NO: 38490 - DNA, 601 bp, Human
catgggggtgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaacaacaacaacaaaaaaaaaaaaaaaaaaaaaaaaaaacaagaagcagcgcaccagatttagcccagggggcggtagttcacaaagtccagatca

SEQ ID NO: 38491 - DNA, 601 bp, Human
atccaggagttcgagaccagcctgggcaacatagtgagacttcatcccaaaaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaacaacaacaacaaaaaaaaaaaaaaaaaaaaaaaaaamcaagaagcagcgcaccagatttagcccagggggcggtagttcacaaagtccagatcagtgtcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacccgtgtagaccacataatttttacatatctcatt

SEQ ID NO: 38492 - DNA, 601 bp, Human
tcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacccgtgtagaccacataatttttacatatctcattattctggagatgctccctgtgtcttagacatcagtcttttaaatatgctaatactattcasagtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtc

SEQ ID NO: 38493 - DNA, 601 bp, Human
agtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtcyttgttctgaccatggggttattatttttaccagtaagccatgaacattaagccctgttgcccacaatctcccatgctgagggctgagccactttggagaatctgcccactggatatctttacgacgttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgcca

SEQ ID NO: 38494 - DNA, 601 bp, Human
cagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtccttgttctgaccatggggttattatttttaccagtaagccatgaacattaagccctgttgcccacaatctcccatgctgagggctgagccactttggagaatctgcccactggatatctttacgaygttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccc

SEQ ID NO: 38495 - DNA, 601 bp, Human
ttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccctragcccctactacaagtgatcctcaggcaggtaaccccagattcatgcactgtagggtgctgagcagcatccctagtctctacccagtttcccctcacttgcacacaaagtagcttctgaacatcctcatgacagtaaacatcaagcacgatatcagctcttcctgagatgcctcctttctgtgtccagctccctgaaatgtgaaaccaagaccaaactctgtagttttcatcccagaaaatcagagagctggcatggcgtgtcagaagacttggggctgtggcgtgaccttgagtgagtc

SEQ ID NO: 38496 - DNA, 601 bp, Human
cctaggctaaccagttcgtctgatgttcccactcttacctagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggtgccttcaccctagccccrtacttttcttaacctgattcccttgaacactgtctcagcaacctggattttcctctgctggggtcacgattcattccttgcatgacgggggaaagtgctagccaacagaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttatt

SEQ ID NO: 38497 - DNA, 601 bp, Human
ataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcrttgaaaaagaatagaggagaagtaagagagaaggagacccccggtgggttgcctaccctgggttcttggcaacattgtatttgattaaattatgtatcatattttagctgacatagcaaggaggagatatttagactatgccttcattatgccttcatgagtatagcaattaacagctttcaaaacgcttttggcaaatacaatttaattctaggaagttgctttggttttggcttttgtttttgtttttgagacagagcctcactctgtcacccaggctggagtgcagtggcacaatct

SEQ ID NO: 38498 - DNA, 601 bp, Human
tttggcttttgtttttgtttttgagacagagcctcactctgtcacccaggctggagtgcagtggcacaatctcagctcactgcaacctctgcctcccgggttcaagctggttctcctgcctcagcctccgaagtagctgggactacaggtgcgcaccaccacgcccagctaatttttgtatttttagtagagatggggtttctgcatgttggccaggatgttctcgaactcctggccctcaagtgatcctcccacttcagcctcccaaagtgctgggattacaggcatgagccactgcacrcggcctctagaaagttactttgaaccctactagtaaatttgagttgctgacatctaagctgtaagaacacattgtcttattgctgaaagtattataggatggaccccaaattctgaagtcactgggatttggaatctcctaatgccttctaacctctcattcaggcctgtgatcttggacccagccgaacccacaggtgacgtgggtggaggggaccgttggtgttggcatcttctggcaaaagaagcaaaggaatggttatcctctccctgcttcaaggatgggactggaaacccaata

SEQ ID NO: 38499 - DNA, 601 bp, Human
tcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaaga

SEQ ID NO: 38500 - DNA, 601 bp, Human
gtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggytacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgc

SEQ ID NO: 38501 - DNA, 601 bp, Human
ttcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatmttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagacttttccttgggctttagccttaaagatacttgaaggtctaggtgctttaacctcac

SEQ ID NO: 38502 - DNA, 601 bp, Human
cggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagaytgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgct

SEQ ID NO: 38503 - DNA, 601 bp, Human
tctgaaccccaactctcacttgggcacattatttagcatctctgtactaaagtttcttcatctgtgaagtagaataataatagcacctacctatgctattattggagttgtcatgagggttgaagaaaggaatatacatactgcacctagcacagtgtttggcacacaggaagtatatgtaaaattcaagctggtatcagccaggcgcagtggctcacacctggctaacacagtgaaaccccgtctccagcctgggcaacagagcgagactctgtctcaaaaaaaaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaatcccaacactttgggaggtcgaggcaggcagatcatctgaggtcaggagttcaaga

SEQ ID NO: 38504 - DNA, 601 bp, Human
aaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaatcccaacactttgggaggtcgaggcaggcagatcatctgmggtcaggagttcaagaccagcctggccaacatggtgaaaccccatctctactaaaaatacgaaaattagtcaggcgtgatggcaggcacctgtcccagctactccggagggtgaggcaggagaattgcttgaacccgggagcaggaggctccagtgaaccaagatcagaccacagcactccagcctgggttacagagcgagactccatctcaaaacaaacaaaaagaaacctgggtcaggcacggtggctcacacctgtaatcccaacactttgggaggctgaggcaggtggatcacctg

SEQ ID NO: 38505 - DNA, 601 bp, Human
ggcaggtacctgtaatcccagctactcaggaggctgaggcgggagaatcatttgaacctgggaagcagaggttgcagtgagctgagatcatgccattgcactccagcctgggcgacagggcgacagggcgagactccgtctcaaaaaaaaaaaaaaaacctggccgggcgtggtggctcacacccgtaatcccagcattttgggaggccgaggcgggtggatcacgaggtcaggagatcaagaccatcctgcctaatacggtgaaaccccgtctctactaaaaatacaaaaaaaattagcmgggtgtggtggtgggcgcctgtagtcccagctacttgggaggctgaggcaggagaatggcgtgaacccgggaggcgaagcttgcagtgagccgagatcgtgccactgcactccagcctgggcgacagagtgagactctgtctcaacaaaaaaaaaaagaaacctgttcttgagtctcagctcctggcttagttagtcataaggcctcaagaaagtcattcacctcttccggcttctcttagcttgtttgtagaatgggaataacagtttctatctagaagggctttgggagtgaataaag

SEQ ID NO: 38506 - DNA, 601 bp, Human
cacacccgtaatcccagcattttgggaggccgaggcgggtggatcacgaggtcaggagatcaagaccatcctgcctaatacggtgaaaccccgtctctactaaaaatacaaaaaaaattagccgggtgtggtggtgggcgcctgtagtcccagctacttgggaggctgaggcaggagaatggcgtgaacccgggaggcgaagcttgcagtgagccgagatcgtgccactgcactccagcctgggcgacagagtgagactctgtctcaacaaaaaaaaaaagaaacctgttcttgagtctcrgctcctggcttagttagtcataaggcctcaagaaagtcattcacctcttccggcttctcttagcttgtttgtagaatgggaataacagtttctatctagaagggctttgggagtgaataaagcaatcatgaggcagtgtagtgtaatgggttaagagcacggcgttagccaggtggggtagctcatgctggtaatttcagcacttttgggagcccaaggtgggaggatggcttgagcccaggagtttgagaccagcctgggcaacatagtgagacctcatctctacaaaaaataaacaaa

SEQ ID NO: 38507 - DNA, 601 bp, Human
caggagaatggcgtgaacccgggaggcgaagcttgcagtgagccgagatcgtgccactgcactccagcctgggcgacagagtgagactctgtctcaacaaaaaaaaaaagaaacctgttcttgagtctcagctcctggcttagttagtcataaggcctcaagaaagtcattcacctcttccggcttctcttagcttgtttgtagaatgggaataacagtttctatctagaagggctttgggagtgaataaagcaatcatgaggcagtgtagtgtaatgggttaagagcacggcgttagccrggtggggtagctcatgctggtaatttcagcacttttgggagcccaaggtgggaggatggcttgagcccaggagtttgagaccagcctgggcaacatagtgagacctcatctctacaaaaaataaacaaaattagccaggcatggtgacacaagcctgtagtctcagctactcaggaggctgaggtgggaggatcgcttgagccttaggaggtcaaggctgtagtgaactgagattgtgccactgcattccagcctgggtgacagagcaagaccctgtgtcaaaaaaagaaaaagcacagg

SEQ ID NO: 38508 - DNA, 601 bp, Human
aaaacacaaaaattagccacacgtggtggcacatgcctgtaatcccagctacttgggaggctgaggtaggagaattgcttgaacctgggagagccaggattgcaccagtgcactccagcctaggcaacagagcgagactccatctcaaaaacaaacaaaaaaaaagtgtattcatagatagtatctgttgattgagaatatagaacaacagtaaccccagagtgaaggagaaagcagccggctttggggctataagcaagatgctggccacatgctgcccttcttccacaagggctcattstgtgtctgtcaaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggtgaggaaagtgggctgcaggggctggcagtgggctgggatggtagaaacttctctctctcttagtcacctctccctcagaccctacttctgttgatgggtcacagaaggggtcagataacttagtctcatcact

SEQ ID NO: 38509 - DNA, 601 bp, Human
gggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatsccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatag

SEQ ID NO: 38510 - DNA, 601 bp, Human
ttgattgataagagcaatactctcttctggtattaattatatcaattgctcgggagtcttttatcctgtgcctcaggcaacctctaggcctagcactttccctttagaatccttttcaacgtagggctgctcagcatcagtgaagtggaatgcattaagatgaaagcatagacaaaagcttcccagacccataaccaacatctcttatcaaatagagtacctataatggtgatgagtatggttagaaagtaagaggtaaacacaataaataagacggcaagggacctcagggcagtgaagygcgctttcatgcttggattgcagtgaccagtgctatgatgttgtatctgcttggtcagtgatgccatgagaaagatggtggaggccaggaacaggatgaaaggaataaccaatgcaactgtatgagcctggaactgatactgatgaaaattttcaagtttgtcagttacagtgctgtttcttggtagatgctccatggtgagtaactgaatttgaatgtaattcccaatagctgaagggatgattgttacacaagtaatcatcagagaacccagtaatatccagggaaacaacctcaaaa

SEQ ID NO: 38511 - DNA, 601 bp, Human; identical to SEQ ID NO: 30766

SEQ ID NO: 38512 - DNA, 601 bp, Human; identical to SEQ ID NO: 30767

SEQ ID NO: 38513 - DNA, 601 bp, Human; identical to SEQ ID NO: 30768

SEQ ID NO: 38514 - DNA, 601 bp, Human; identical to SEQ ID NO: 30769

SEQ ID NO: 38515 - DNA, 601 bp, Human; identical to SEQ ID NO: 30770

SEQ ID NO: 38516 - DNA, 601 bp, Human; identical to SEQ ID NO: 30771

SEQ ID NO: 38517 - DNA, 601 bp, Human; identical to SEQ ID NO: 30772

SEQ ID NO: 38518 - DNA, 601 bp, Human; identical to SEQ ID NO: 30773

SEQ ID NO: 38519 - DNA, 601 bp, Human; identical to SEQ ID NO: 30774

SEQ ID NO: 38520 - DNA, 601 bp, Human
ttttttgtatttttagtaaagacggggtttcaccgtgttagccaggagggtctcgatctcctgacctcttgatccgcccaccttggcctcccaaagtgctgggattacaggcgtgagccactgcgcccagccgataatacaattctttaaaaagaaaagcattaggccgggcacagtggctcacgcctgtaatcccaacactttgggaggccaaggtgggtggatcacctcatgtcaggagttcgagaccagcctgaccaacacggtgaaaccctgtctctactaaaaatacaaaattagscaggtgtggtggcacacgcctgtaatcccagctacttgggaggctgaggcaggagaactgcttgaacccaggaggccgaggtgagccaacatggcgccattgcactccaacctgggcaacaagagcgaaactccgtttcagaaagaaagaaaagaaaagcattatacaaatccagtgtggtgagtttaaaaccattcactgagctttgtacaacttcaataatttccttatgcttccatttcctcatcctcaaagtaggttaacttgtctactaattactacctcagagatatggtacag

SEQ ID NO: 38521 - DNA, 601 bp, Human
accatgttggtcaggctggtctttaactcctggcctcaagtgatccgcctgtcttggcctcaacaaagtgctgggattatagacatgagccaccgtgcccagccagaaaaacatttttaataagtaatttttaaaccggattaacacaacttataatgcagtagctatacttttgtttaatcaacatatcagtctccttcataataagtgatatttccaaacaagatgtgtctgggaaaaaaaaaaaaaaaaagaaggaaagaagtcatcccaattctggagaagcctccttttcagatcrtcacaaacatttcactaaatgtctccccttgcaagtcctttggtaaatctgatgtaagatggatatacagatacaaaggagcactcctgtgcctcgctgttataaagcaatagcaattctaaaatatattcactcaatagtctacaaaaacttattaagcatctattacatgtgaacccataaatggcagattgcacattcttaaatgctggaaaggatctgtgtgttaaactcttcctcaaagacacaagacgacatctttcagcaatcacatgtaaatctattattctgttctcttta

SEQ ID NO: 38522 - DNA, 601 bp, Human
caccacacctggctaattattttgtgtttttagtagaaatggggtttcaccatgttggtcaggctggtctttaactcctggcctcaagtgatccgcctgtcttggcctcaacaaagtgctgggattatagacatgagccaccgtgcccagccagaaaaacatttttaataagtaatttttaaaccggattaacacaacttataatgcagtagctatacttttgtttaatcaacatatcagtctccttcataataagtgatatttccaaacaagatgtgtctgggaaaaaaaaaaaaaaaaagaaggaaagaagtcatcccaattctggagaagcctccttttcagatcgtcacaaacatttcactaaatgtctccccttgcaagtcctttggtaaatctgatgtaagatggatatacagatacaaaggagcactcctgtgcctcgctgttataaagcaatagcaattctaaaatatattcactcaatagtctacaaaaacttattaagcatctattacatgtgaacccataaatggcagattgcacattcttaaatgctggaaaggatctgtgtgttaaactcttcctcaaagacacaaga

SEQ ID NO: 38523 - DNA, 601 bp, Human
aactcaaggaacaaattaagtttttcattactgatatagatatagttcatagcagccttcaaggaactgtggaactttggaaatagaacttctgtgtaaattctaaacctgttgctcaacagtactgtcctgaagactaagtccttaaatgcaaataagtcttttcctttaaacctgtctttaaggattgttttccaccaggtaaattaaggacttgagagatcaaaatgttttgttagagtcttcttagagacaaacactattttatacacagtaaaattaggttgagaagtttgaaacrcaaagattcttcagatctcgctggtgctggaaaacacctcttactgtgaattgtgttgtgctgccattttcctgcctttctgcctcccacacagatgaggacctttcatctcctggttctttccctatttgaagggctttagacaccagatcaacaaaacatactcatcttaggctcaagccctaattttacatagcatacataagcaccataatacaagctgcaaaatgatagagttataggtgtttcttttaaaagattccttaattccatgtcctcctggttcttaagattggcttg

SEQ ID NO: 38524 - DNA, 601 bp, Human
gagaagtgatgtgagtaacaaagaccatactagagaatttatactattaaaagcaaaagtggagatgaagaagacaggaatggattttagactggcaattttactggtgtggttgggtgggggagcactggagcttgtttacttcatattgtaaattaagagaataatgaaggcattacttctaaatacattaaatttcttcacgagacaaaaataaggacagttgtgttcattttcatggccatcctttaaaagctgaaaatgtttttaatgagtcaaagtacttaaaaataaccagtggcaacaaagaacagaaatgacaggtctctcaggaaatagccaaccaatgcagaaaccagcaaaccaactaattagaagttctattataaagaaacagttactttaattttttttaagtatcaaaatgatttttaaagctggtcctcaagaaagagatgaatgaccagagcaattaagctacttgaggagtcctaacacattctctcttactgagagcaaaaaggactgcaaaactcaaaagaaactcaagcgaaatgtgactctggatagcagaggcataagtattaccttattcaacaaa

SEQ ID NO: 38525 - DNA, 601 bp, Human
ttcagtgctatgaagtctaaagttctacctaaaagttgtaagggaaagaaaataaaaaggtaaattatagaggagatatgtaattgccaatattcagtcaaaatggtgtcacctactgacttatgaaaatagctccatttagcatgtagctatgttgatttattcgaaatatgtttctccttggtatacagtaagtttcttggccttgtgactttcccacagtgttttttaagtgatttacaatacctgtgtgctctgcatattcattatacaaagagaatcagtagggtataatatttaytggtgagtattaagaattgcaaactatagcttacattcaaaaatgcaaatttgaaagtatggagaggtttccatagtaattggggcacagtaaggtttctttctggtctcaaaattacaagaaactgaaagcaaactaggtttatcataccaggaacaggtgaatgtgaacactgcttcctcttaaggaccaaggctcagactgacaaccttagggccttaagttgacagaaggaaggtaggatacttctgctgtttctttttctttatggtgatgagagatgtattgttttcctaaaag

SEQ ID NO: 38526 - DNA, 601 bp, Human; identical to SEQ ID NO: 30766

SEQ ID NO: 38527 - DNA, 601 bp, Human; identical to SEQ ID NO: 30767

SEQ ID NO: 38528 - DNA, 601 bp, Human; identical to SEQ ID NO: 30768

SEQ ID NO: 38529 - DNA, 601 bp, Human; identical to SEQ ID NO: 30769

SEQ ID NO: 38530 - DNA, 601 bp, Human; identical to SEQ ID NO: 30770

SEQ ID NO: 38531 - DNA, 601 bp, Human; identical to SEQ ID NO: 30771

SEQ ID NO: 38532 - DNA, 601 bp, Human; identical to SEQ ID NO: 30772

SEQ ID NO: 38533 - DNA, 601 bp, Human; identical to SEQ ID NO: 30773

SEQ ID NO: 38534 - DNA, 601 bp, Human; identical to SEQ ID NO: 30774

SEQ ID NO: 38535 - DNA, 601 bp, Human; identical to SEQ ID NO: 30766

SEQ ID NO: 38536 - DNA, 601 bp, Human; identical to SEQ ID NO: 30767

SEQ ID NO: 38537 - DNA, 601 bp, Human; identical to SEQ ID NO: 30768

SEQ ID NO: 38538 - DNA, 601 bp, Human; identical to SEQ ID NO: 30769

SEQ ID NO: 38539 - DNA, 601 bp, Human; identical to SEQ ID NO: 30770

SEQ ID NO: 38540 - DNA, 601 bp, Human; identical to SEQ ID NO: 30771

SEQ ID NO: 38541 - DNA, 601 bp, Human; identical to SEQ ID NO: 30772

SEQ ID NO: 38542 - DNA, 601 bp, Human; identical to SEQ ID NO: 30773

SEQ ID NO: 38543 - DNA, 601 bp, Human; identical to SEQ ID NO: 30774

SEQ ID NO: 38544 - DNA, 601 bp, Human; identical to SEQ ID NO: 31192

SEQ ID NO: 38545 - DNA, 601 bp, Human; identical to SEQ ID NO: 31193

SEQ ID NO: 38546 - DNA, 601 bp, Human; identical to SEQ ID NO: 31194

SEQ ID NO: 38547 - DNA, 601 bp, Human; identical to SEQ ID NO: 31195

SEQ ID NO: 38548 - DNA, 601 bp, Human; identical to SEQ ID NO: 31196

SEQ ID NO: 38549 - DNA, 601 bp, Human; identical to SEQ ID NO: 31197

SEQ ID NO: 38550 - DNA, 601 bp, Human; identical to SEQ ID NO: 31198

SEQ ID NO: 38551 - DNA, 601 bp, Human; identical to SEQ ID NO: 31199

SEQ ID NO: 38552 - DNA, 601 bp, Human; identical to SEQ ID NO: 31200

SEQ ID NO: 38553 - DNA, 601 bp, Human; identical to SEQ ID NO: 31201

SEQ ID NO: 38554 - DNA, 601 bp, Human; identical to SEQ ID NO: 31202

SEQ ID NO: 38555 - DNA, 601 bp, Human; identical to SEQ ID NO: 31203

SEQ ID NO: 38556 - DNA, 601 bp, Human; identical to SEQ ID NO: 31204

SEQ ID NO: 38557 - DNA, 601 bp, Human; identical to SEQ ID NO: 31205

SEQ ID NO: 38558 - DNA, 601 bp, Human; identical to SEQ ID NO: 31206

SEQ ID NO: 38559 - DNA, 601 bp, Human; identical to SEQ ID NO: 31207

SEQ ID NO: 38560 - DNA, 601 bp, Human; identical to SEQ ID NO: 31208

SEQ ID NO: 38561 - DNA, 601 bp, Human; identical to SEQ ID NO: 31209

SEQ ID NO: 38562 - DNA, 601 bp, Human; identical to SEQ ID NO: 24966

SEQ ID NO: 38563 - DNA, 601 bp, Human; identical to SEQ ID NO: 24967

SEQ ID NO: 38564 - DNA, 601 bp, Human; identical to SEQ ID NO: 24968

SEQ ID NO: 38565 - DNA, 601 bp, Human; identical to SEQ ID NO: 24969

SEQ ID NO: 38566 - DNA, 601 bp, Human; identical to SEQ ID NO: 24970

SEQ ID NO: 38567 - DNA, 601 bp, Human; identical to SEQ ID NO: 24971

SEQ ID NO: 38568 - DNA, 601 bp, Human
aacatcatactaaaagtacatgtctccacatgaacaattagcaggattccattagttttgattctccattagcagggttccattaaatgttttgattctgtggaggagtccttgaaaaccactgacgtcaatcacagttggcaagagctggaaggaccttagcagtcaatagaatccagcctcctcgtttactgatgaggaaactaaggcctagaaaggttcagggtcattcagtgtcatagtggtgggtgataagtggcggtactgggacatgagtcctgttccgctaaatgcagttttkttaattccacttgcaacacactgtatttcaagatacataaaggctaactggcttgacccaggcaaatagaatcagtgaaaagcctggattggcacctagaaatatcgacttccagataaacacaccttgattttatcatgcggtctctctgatatatctttatgggttaagttggagtagtagttcacattaaatattacatatgatggctgcattctttctgtagttctaacaacatgtgaaagagaagtttcattaagttttgtttgattaagtggcctgaaaagtcaaaattttatg

SEQ ID NO: 38569 - DNA, 601 bp, Human
ccttaacatcatactaaaagtacatgtctccacatgaacaattagcaggattccattagttttgattctccattagcagggttccattaaatgttttgattctgtggaggagtccttgaaaaccactgacgtcaatcacagttggcaagagctggaaggaccttagcagtcaatagaatccagcctcctcgtttactgatgaggaaactaaggcctagaaaggttcagggtcattcagtgtcatagtggtgggtgataagtggcggtactgggacatgagtcctgttccgctaaatgcagktttgttaattccacttgcaacacactgtatttcaagatacataaaggctaactggcttgacccaggcaaatagaatcagtgaaaagcctggattggcacctagaaatatcgacttccagataaacacaccttgattttatcatgcggtctctctgatatatctttatgggttaagttggagtagtagttcacattaaatattacatatgatggctgcattctttctgtagttctaacaacatgtgaaagagaagtttcattaagttttgtttgattaagtggcctgaaaagtcaaaattt

SEQ ID NO: 38570 - DNA, 601 bp, Human
ccctactgacaaattaattatgagaaaataaaataagtcctgctgtcctgatggcaaggacagggtgagtggccagaataaaagaaggtgacctctgtggagcagaagtgtcttggttgccaatgacaatgacagcaatgatggcgacaacagcaatagccaccaccttctgtaggctttccagagtcttgatcttttgtcatcagcattaactttccctcaacttaaaatgttagctatggaatttccacatactctattttcaaaatcagtcttatctgtaaaagtgtcctgatgacaytgtgaaacttagacatattttcaggggatatatattggaacatttaatgtcaggttttttttctttgaagaagaaatgttatttatattacattatattttgtttctgtgtttgtttttacaccaggcaacttgaattaacaacacactaccacgtggaggttactataatgcagtgtatccaggaaacacagaaagatgattgctacccttcccatctcctgtcttattatagattaattgtttcccaacttggggatcaagcccccatagagcctcaggttgttgcagggggttcttg

SEQ ID NO: 38571 - DNA, 601 bp, Human
tgagaaatgtggaggaatcaacattcaatcagcaacatttgtgatgctccaagcatgttcagaattttttctttttcttgctacttttcttttctttcttatttccaacttccccctcttaacatcgtgatgatacaaagaaatggacaataactgtttccactggctttacaatataaatgaacctgtcttaaaaactcaaatacagatctttatgcaaattttcctctcatcccaaattattaaaattggatgtcagatttactaaaattgaatgtagacagatacacctgttctttcmggacataagtccagatctaatcattacaaataaacacctagttaactgacaggtattaggtaagtaaaggaaaaaataactacaatgaaagctgaatatccaacatataattttgccctaagttaaaattaaaatctcctttattagttttgaaattgtttgaaagtcagaagtagtatctaaaccaaaaacaactttaaaagattcttggagaaaaggaacttcttaatttttaataaaattttatagtgattgtatgtgttgatctgtatttctctttgtttttagttggatttcaac

SEQ ID NO: 38572 - DNA, 601 bp, Human
gagatggagaagatatggggtggggcctcctggcgctttttgcctcggtaggctgtcaccacctcagggttgtacaccggcagccacttgtaggggttgacggtgacacagaagaggcccgagtaggtctgtgggaaaggacggggttcctcgatcagcaatcaccttgtttatctatcttggaaatactgtttaagggcaagtagagcaggacctaagtactgtgttagttctcataaagtttcattcatttgttgcctccttccatcattgctgctgcacaaaatgcttcagtttttcytttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccgg

SEQ ID NO: 38573 - DNA, 601 bp, Human
tgcttagggagtagagagggatatatcattggcccacagaggtttattcaaaataaggcttatgtttacatgtgactgtagaagaacagtgggagttccatgtttagttgtaataatattgcagctccttcccagaatcttgggtgtgaggtgtggcataaaatagcagagaaacattaatattggagcataaatatcaaccaaaaatgactaataagaaagatagaatgaaaggagcctactagctaaggaatactaaagacccaacatttattacaggcagtgaaagctttttaacacmtgtagggggagggtattgaaatatcctacaatttttttccaaaagtaagaaagcccaaagggttgtattacctatttatagtctttctgccactgctttccaccctaatagaggagagtgttgtacactggaaaatgaatttactttttactactttgtacctattacttacatctgtggccatcagctcttcctggtcatcaatgctgggcacagtaatttccccttggctgacaaatgcgaagtcatatgggttggtggtgatcagaagcatttctgaacacatggaaaagaacagta

SEQ ID NO: 38574 - DNA, 601 bp, Human
acagataaaaataatttgagaaaccctaacctagaggagtagtgacagaaatattcagatctctgtttctttcagtgcctgtgggcacacagattatcctgaaataaaatatgttttagtcaaatagcaaatatgagcttatgaaaagccaatgaataatggaatgagcagaaatcacaaatctgctaaataatgtaaaacgtcaggcagtgtgtaatttccttctcgtaatacttttgcccttcacgagctaggtcagagaaagtaaaaacacggtccctgcctctgaaaagttcactaygtcagctttgtcaagtggaagataccaacagggggtggtaccttccgtgccatctggctctgcctgctcttccctttgcttttgcttgaatttcatgttcccataatgcatcacggctccagtgagcttgtaaatggccaccttttcatcagcagtgaaacccaggatgtccacagcactctgtcaaaagagttgaatttgctcatccccaattagcaccatggaagaatccctcagaacaccggggctgtctcccacttttttctcatcacgccttgccttatatttgactagcacttt

SEQ ID NO: 38575 - DNA, 601 bp, Human
tgtttaacgattgcttgatgagtgttaacatatctagatctgatgtaactattgcttcacccccttagtaatggggaattcagggcccattttctaggtaagtgatacagaggtttggtgtttattcagtagttatcatgaacggggaaagacttaatgactgcaacagttgaaggactaaccttccaatctttaagacgtgttgacatagcctgccttgttacacatgagggatgatgataaatgcacaatacactgtcatgggtacaccagggttaattacacaacccagaggaatagytgtaatttcatccctttctcccatatgcatgaaatagtgtaggaagaaaagtgagggagaattaagtttttagagggataaatgcgaatccatatgtgtgtgagtgataaacatttttctacaaactgctctacttattaataacagatcacttggaacatacctcacaaccaatcagaatatacgagtgtgtcaggaaacagcactgcttgttctttgagaacagggagtgtgattaagcacagggaggcaagcaatttggttttcatgttttgaaagctagaaaagtcatatgaacct

SEQ ID NO: 38576 - DNA, 601 bp, Human
cttaatgtatttgataggaaagactgaaagaaaattcaacattgatgatttaacaaattcacaaattgtacccctaagactattttggtgatacagaaactgaaatactagagaataaaataaatgccttttctgaagaccataaagttttcatgaatagtagagatattatatcaccagattaacgtatcttttccccaaattgtgcagacctagtctgcttttaaactcttatctttcatatttttgtgaattttaacctgagtattttaagttttcctaggtggcaattgcatttackcttcctttcccactgcttagggtagggttcacacatacactttattgatatcaataagtatatgacaagctcccaagatacttttggaagtgtttaacgattgcttgatgagtgttaacatatctagatctgatgtaactattgcttcacccccttagtaatggggaattcagggcccattttctaggtaagtgatacagaggtttggtgtttattcagtagttatcatgaacggggaaagacttaatgactgcaacagttgaaggactaaccttccaatctttaagacgtgttgacata

SEQ ID NO: 38577 - DNA, 601 bp, Human
cttcctttacctcgaatctagaggtgacagaagtatgaagggaagagagattatgtgtaaggactaaaaatgatccattcctaggaggaaattgcatcttatattgtatcattaaaattctgtactttaacctatattctctaccactgtggagttaagtgatagtaatttggttttgctttctaagagtttggcttttttcttaatgtatttgataggaaagactgaaagaaaattcaacattgatgatttaacaaattcacaaattgtacccctaagactattttggtgatacagaaastgaaatactagagaataaaataaatgccttttctgaagaccataaagttttcatgaatagtagagatattatatcaccagattaacgtatcttttccccaaattgtgcagacctagtctgcttttaaactcttatctttcatatttttgtgaattttaacctgagtattttaagttttcctaggtggcaattgcatttacgcttcctttcccactgcttagggtagggttcacacatacactttattgatatcaataagtatatgacaagctcccaagatacttttggaagtgtttaacg

SEQ ID NO: 38578 - DNA, 601 bp, Human
agatgttgttcatacagcttgttcttgaaggaggtgtctgttgccttggggaacatgcactcctcttctaggatggagaagatgcccataggctaagaataggaaaaaagggatgataatgatgagtccctcagaaagttatgctccatgtaattgatggaaaactgaaaatacaatgtttcaaaagaagactttgaatgataaattaaataggcatgacatgtgaagcagtcattatgtacccagaacatatgggaaatatacttgctagaaagactcagttaaaaaaaatacatctgawctatttggcacactttatgttcagtgtataaaatcagattctgaaaacatcacttcaaaattgaattctttattccataaatgtatatatctgactactttctttcctactgacaatataacttcctttacctcgaatctagaggtgacagaagtatgaagggaagagagattatgtgtaaggactaaaaatgatccattcctaggaggaaattgcatcttatattgtatcattaaaattctgtactttaacctatattctctaccactgtggagttaagtgatagtaatttggttttgc

SEQ ID NO: 38579 - DNA, 601 bp, Human
cacttagctctgaaagtctgtgactgtaagactgtatcacagttattaaatacactttctttcattaggcatgtattggccagtgtttttgtgtcaggttttgctgtaactacatttgtctctgttgaacagtgtatatctattttgtgactcttgtaacatattagtgctattaaacatgacctgcttcagcagtttgtgccccagagaagaggaaagccagagtcttcattgcagacttctggtacagccccaccacagtctcattcagggggtccttgtttttgtccagccagccggygatgttgtagtccacggtgccggcatagtgcaccagtgagaagtgagcctcaggcttgcctttggcaggcttgggcttctggaagttgttggattttccaagatgttgttcatacagcttgttcttgaaggaggtgtctgttgccttggggaacatgcactcctcttctaggatggagaagatgcccataggctaagaataggaaaaaagggatgataatgatgagtccctcagaaagttatgctccatgtaattgatggaaaactgaaaatacaatgtttcaaaagaagactttgaatg

SEQ ID NO: 38580 - DNA, 601 bp, Human
ttgaatacagtggttatttttaaaagagcatttgatttcatgtgaaatttgtacaataccagatctcttggatgtagggctcaggggcaatggttcacgtatcataaagattgatgtgaagagatatgtagtttgtttttttgtgctaattttttttcctaagccatttaaaaagtttacaaaacctttagtagtatactaaaaagtatactgtactactttattcactttcaccataaatatcttttaaaaaattttctgttttgatggtttagttttttaatgaaagtatttatctgtrattcaagaatatactgtaccctgaaaagagctgacactgtctggaaagaagaacccttctttttgccacctttctttccaccaccaccctctaaaaaacaaaatgggaaaaataaagttatttgcaactgccttttaagtactatccataaacatcaggactgccaaaattccctttagaatttaaatttgcactcattcacttgcatcattcctattctttccatatctctcctccctcaattgtagattaagaaagtctaagatttggctgactttatagtcattcatgaaaaaacca

SEQ ID NO: 38581 - DNA, 601 bp, Human
ctccttctcaaccttggccagtgtcagctcaaggtcatcaatgtctttcttgagctctgaacattcatcctccagtttcctcttcttggctgtcagctcagcattgatctcttcctcatcctcagctctttcagttacctctttgattttggcctcaagttggattttggttttaatcaactgatcacatctttcctctgcatcagccaaggcatctgcttcctaaagggagaaattaagcattttcatttgtctgagctatatctataagcacacaataatttattataaggtggaaatktcagtgactacctgtttggtcaacatgtataccagttgctaacttttaaaatgaaacagacaaaatgttaatactgttatctactgatcaagtataataacaaatttccttcagatattcatgtgtggcaggccaaatcaggaaaactagccctttggcaaaaatctgccactttactaacctttgcaactttggaaaaatcgcttgttcattgtaggactcagttttctcacatttaagaggggattaacttagccatttctctgccctgataaaaacaacataacttctattttatgc

SEQ ID NO: 38582 - DNA, 601 bp, Human
taggtcaccctccagttttctcttggctctttctaagtccatgcaaagtttcttttcttgttccagagatccttcaagctaaatttatgatgcattttatttatttcagctcttaagcactgaaccctatgctagtagccttcaaagatacataagaaaaaaatttaaagatacaacaaatagcacaagaactttattcacagaccaagcgttaaaggcttatgactatcagtgctggtttcatgtcacaattgtttatttcattgcaaggggaaacattttctttttcacacttacatcrtccacttgctgttctagcttggttttagctttggtcagggtgttgactttgtcctcctccatctgcaggtcatccagggtctgctggtgggcctcctggagagccttcttctccttggtcagcttagcaatggtttcatccagacctgccatctcttctgtgaggtttttcacctttagattagaacagatgaccagaatgtcaatgacaacgtattatcttgatgaaaaacatgatgctgtagtatcttaggataatgtcagcgtaagatggaaaatgagaaccaggagctaacccagg

SEQ ID NO: 38583 - DNA, 601 bp, Human
attttctggaactcagcctcccgcttcttgttcatctcaatctgggctgaagtggccccaccggcttcttccagcctctcactgatctcctccagctcccgggagaggtcagagcgctgcttctctgctttggcccgggaggcccgctctgcctcgatttcctcctccagctcctcaatgcgggcctggttgtgatatgtcaacattaatgtgaatttatgtcagttttgtttcctgtaatgcccagaaaaggtggaggttataacttacctgtaattctttgatcttcttttgtagctgyattgcaagggcttgttcatcttcaatcttgccttgcagattgctcatttcaaactctttcctattagaagagcaacacattagcttataatcacttctcttaccaatcttcttttctatgtataatctaagactttttttatactgctggtgttgaaggagtgagtagtacaatgttttacagattaataattgtattagtttaattaaataaaaaggtcaaagatgtcattatttttttccatatgtcatgatgtaacattttggagatctttttagcgtatgtttcatttgcattgac

SEQ ID NO: 38584 - DNA, 601 bp, Human
taaagtgttttctacaaagaagttaagagaacttaagtgattcaatacaataatgtgtactaggagtaagtttaagcttcagatgccatctaatgtttgtgtaatttggctaaaaatagtcatatataaacttggtcattttgaattgttgcaaataaagatgaaaagggcacaagttaatgaagaccttggctttggagacagtctccatgttactagcaaggtcattgatctccatcttcagctcactcttttccttctccagcttctgcttgacccgctgaaggctgtcaatctgctycccaagctcagccacactatctgcgtgcttcttccgaagagcagctgccgtggcttcgtgctgcagggtggactcttccaggtccctgcgcattttctggaactcagcctcccgcttcttgttcatctcaatctgggctgaagtggccccaccggcttcttccagcctctcactgatctcctccagctcccgggagaggtcagagcgctgcttctctgctttggcccgggaggcccgctctgcctcgatttcctcctccagctcctcaatgcgggcctggttgtgatatgtcaacattaa

SEQ ID NO: 38585 - DNA, 601 bp, Human
aagctggccctctatagtgtggcacattttcttgaactttgcctggggtgagaagtagaaaacaggaagagacagtacatttctcttttgaaacctgggatttagagatctgtaactacttgtggaaaagggctgagttttatttactttgaggaagaaatggcaaccatgaacaggaagcatatcaccaaggaatggtagcattgagtagtatctttaagcattttctagtatggttctgtttattttgcaaatgaggaaactgcggcccagagtgatatgttcaaggtcatacaatgartcagtaactttctggatttggtggcctttgataataaatattactgcattattgcatttcccaaatttcctctaaaatcttgtctactactcttcaccaacctatgtaattcatgacctttcccagcccacactcttatctagaactctctctggaaatgcttgctacaaactctttcatcctgtttaattctaacaactactgagataaattaaatttagaaaggcttctttcactaggagtataatgctttttttccttctatgtgtaaatctgtaaatctcatgacttgtagtccgc

SEQ ID NO: 38586 - DNA, 601 bp, Human
atgttcttctgcatcctgcagacgctgggctagcttcttcctgaaaattgggtcagtatgagtgaccaagagcagactcagagtcaccacagtgccctttataaagctgctgactaggaaagcatatttccccaagagttgtctacaagttgttgaatttttctaaacattttcactctcttagaattctgttttccctgttgagttcttatttttatccatctcaggtattgccaaacatatttacgaagcacgtgtgtgtgtgtatgtgtgtgtatgagagaaagagaatataagttascactagagctgagtgagcaatgtgaaaatttgctcctctttctttgtttttatttcactaagctggccctctatagtgtggcacattttcttgaactttgcctggggtgagaagtagaaaacaggaagagacagtacatttctcttttgaaacctgggatttagagatctgtaactacttgtggaaaagggctgagttttatttactttgaggaagaaatggcaaccatgaacaggaagcatatcaccaaggaatggtagcattgagtagtatctttaagcattttctagtatggttctg

SEQ ID NO: 38587 - DNA, 601 bp, Human
agctcatttaaaatgaatcagtaatttttagctattaactcatgttggttgactccatatttataaatgcataaatagttgtcttgttggctgggcgcagtggctcatgcctgtaatcccagcactttgggaggccgaggtgggcagatcacggggtcaggagatcgagaccatcctggctaacacggtgaaaccccgtctctactaaaaatacaaaaaattagtcgagtgtggtggtgggcgcctgtagtcccagctactcgggaggctgaggcaggagaatggcgtgaacatgggagtyggagcttgctgtgagccgagatcgcaccactgcactccagcctgggtgacagagtgagaccccttctcaaaaaaaaaaaaaaaaaaaaaaaaaatagtagtcttgttgggataaaaatgagccaagaatcccttctgtttttggcaagttgatggtgtttggaatagtcaacttcagatactgttaataagaaaaatgttgcatattaatttgattttaaaattatataaagcatgcaattttaacacttctataatagttatgtttatatagtgcaactttctgaagtatacagtacta

SEQ ID NO: 38588 - DNA, 601 bp, Human
agcaggcagcatgcatgtgtcagtaagacaaatgctcatcttgcttacatcagtgatggccttcttggccttctcctctgcattgcgggcttcctggacgatgtcctccatctctccctggatttgggaaatgtctgtttccagcttcttcttggtgttgatcaggctggtgttctgtttcaaattaatgaaagagaagagaagcacatttacttataacaactcacattgtcattttacctagtgtacacaggcaaaaattattgatcataagaaatgtttagaataaaaaccaaattaraagataattctaagtttatgccttttctcctttctatatatagctctttaatcaaacttctaaatttaatttttgatgtcaaacatattcaactattaccattgccatttgtaagcatgaaacacagcccacaaaactcaaagtgctgtaccatggagcaccacaccacagctcatttaaaatgaatcagtaatttttagctattaactcatgttggttgactccatatttataaatgcataaatagttgtcttgttggctgggcgcagtggctcatgcctgtaatcccagcactttggg

SEQ ID NO: 38589 - DNA, 601 bp, Human
tattctgattgttgtttatcctgatgcacctttttaaaaagcgaagggaaacgaagacatgatgacagacactttagcaggagaatcacattatgcacatactgttccaatacacatagctcccacctcatcccctcagcctccttcccctcagcctcctccaccctccactcttacaagtaagacatcatcaacttttgatacagtggctcagaatgtatgttgcatcactaagtcacaaaattagttatctttcatggcaaagacaagttagaaattgtttaatctacctcacataagkggctttgctctgttgtttccagccacagtgtcatctactatgtctcctcctttcaattccacgttcaaacaaataaactcgagcccataaaacttttgttacttatatgcagaaaacaagatcactccattttcctaggagctggctggttgcttggtgattgcttccctttgccatcccacatactagctctcacctgaaggcttgccctttagaagggcaatcagagtgccagtgacttctgtatgtttcaaacaagatcgtcatcagcttttctgcaaagtcttctatttgctgttt

SEQ ID NO: 38590 - DNA, 601 bp, Human
cactcaacaacctcgataggttattggaaactaattttaagctaaatgacatatagcaggtctttgaataacatagtttggttataagactgaggaaaaaaatggctttgtcatacatcattttacttaaagtcactgtttccaagaaactatcaatgacacacatagtttaaaaaactagggacaaaacatttgccagaaatatgtcaaggggttaaaatcgttctggcatataaagaacctacaataatacattagaacttcaaataatgaatggctgaataagagaaaatttgtaggrcagtaggtgctaaaacatttgggcacatggaaagttttaatgtttaatttcactaatactgtattatatatgcatatcatgttaatcaaattatctgttttttaaatgagaatagccaattctagaaaaaaatggcaaagttggcacttttacatacagctggtgagactacaaataaatacaactttctacatggtgtttcggctgcatattaaaaaccagtaaaatgttcatactctgcgacccagtagttctgtgcttgagaatcaaatctcaagaaacaacctaaaattcaggcat

SEQ ID NO: 38591 - DNA, 601 bp, Human
gaagacctttctaaaaataaaaatagaattaagggcaaatactgtaaatcctcactcaacaacctcgataggttattggaaactaattttaagctaaatgacatatagcaggtctttgaataacatagtttggttataagactgaggaaaaaaatggctttgtcatacatcattttacttaaagtcactgtttccaagaaactatcaatgacacacatagtttaaaaaactagggacaaaacatttgccagaaatatgtcaaggggttaaaatcgttctggcatataaagaacctacaatmatacattagaacttcaaataatgaatggctgaataagagaaaatttgtagggcagtaggtgctaaaacatttgggcacatggaaagttttaatgtttaatttcactaatactgtattatatatgcatatcatgttaatcaaattatctgttttttaaatgagaatagccaattctagaaaaaaatggcaaagttggcacttttacatacagctggtgagactacaaataaatacaactttctacatggtgtttcggctgcatattaaaaaccagtaaaatgttcatactctgcgacccag

SEQ ID NO: 38592 - DNA, 601 bp, Human
tggctcaaatctctctagtctagtcaagttctatttagaaaagtagtaaattgattgtcatatttagcataaatattaaatatgcagttactctttccattttcctgtatactaagcctacttaccctgttgcaatttaaattaatgccccaatgcatttacttctcatcaatttggctgatgccacgtagctgagatgcatgagaattttttagcaaaaggataggtttggttttgttttttattcttttcaggctccagaaatcaccctgaagatttcttctcatcttcctgccatggragcccaaggcagtgccttccaaggtgccttcttctaccaggtgctgcaaattcattcccagatgtgggttataaaattctggggtccagtatagataaatgaaagcaaaaagaacaaattttataattttttcctaaaatcctgacatattttattccctcctggaaataagtcatttagctaaggcataataaatgtcacagtgtaagagctttctctaatcagtaaaatgaatatgttctggcttgtgcccagagaagcataatagcttggtgccctttaatagatctctgtcattat

SEQ ID NO: 38593 - DNA, 601 bp, Human
tgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcrcttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagca

SEQ ID NO: 38594 - DNA, 601 bp, Human
ctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaatraaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgagga

SEQ ID NO: 38595 - DNA, 601 bp, Human
ttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgartgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcga

SEQ ID NO: 38596 - DNA, 601 bp, Human
tcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaata

SEQ ID NO: 38597 - DNA, 601 bp, Human
gcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattyatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatccca

SEQ ID NO: 38598 - DNA, 601 bp, Human
atgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacaggrttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatact

SEQ ID NO: 38599 - DNA, 601 bp, Human
cactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgarccactgaaagtgagtgatggcttttatggtactggagagacctttgtttttacattctgtccggagtttgaggtaagaaccactatttcaatattttatttataaagaggtgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaag

SEQ ID NO: 38600 - DNA, 601 bp, Human
tataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgrgcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacat

SEQ ID NO: 38601 - DNA, 601 bp, Human
cagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcrccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaaca

SEQ ID NO: 38602 - DNA, 601 bp, Human
atacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattrgagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaa

SEQ ID NO: 38603 - DNA, 601 bp, Human
atatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcrgagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttga

SEQ ID NO: 38604 - DNA, 601 bp, Human
tggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccayccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggata

SEQ ID NO: 38605 - DNA, 601 bp, Human
ttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttctttctttttttttttttttttttgagacagagtttcactcttgtcgcgcaggctggagtgcaatggtgcaatcttggctcattgcaacctccgcctcctgggttcaagtgcttctcctgcctctgcctcccgagtagc

SEQ ID NO: 38606 - DNA, 601 bp, Human
ggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttctttctttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccacca

SEQ ID NO: 38607 - DNA, 601 bp, Human
aatacccaaagaaaaactcataataccaggcaaaaaattacagcgtagtacctgtctcaaaagctaatcctatataaagttcattatagaggacactgttcctggtctgtatcataaataatttttttcttttcttttctttctttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccrcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaa

SEQ ID NO: 38608 - DNA, 601 bp, Human
gttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattrgtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggat

SEQ ID NO: 38609 - DNA, 601 bp, Human
aacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtmtcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctg

SEQ ID NO: 38610 - DNA, 601 bp, Human
ttaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagktataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggca

SEQ ID NO: 38611 - DNA, 601 bp, Human
aggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatmatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatctta

SEQ ID NO: 38612 - DNA, 601 bp, Human
ccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactakggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataata

SEQ ID NO: 38613 - DNA, 601 bp, Human
aacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtac

SEQ ID NO: 38614 - DNA, 601 bp, Human
cctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacat

SEQ ID NO: 38615 - DNA, 601 bp, Human
tgtggtggcacgtgcctgtaatctcaactactcgggaggttgaggcaggaaaattgcttgaacccaggtggcggaagttgcagtgagctgtgatcgtgccactgcactccagcctgggtgacagagcaagctccatctcaaaaaaagaaaaagaaaaaaaagtcagaaagaataggaagaatcaacagagtctaaagtgagttgctagaaaggtcgcagaaaagccagaagagtgaagggtcctagaacccaagtgaaaaaaaaaaagtatttcaagggaggggaaaagatcaactgtgtyagatgcttctggtacatcaggtaagatgggggctgagaaatgacactggatttagcatgggtgtcattggtggctttgacaagagttataagcacatatctcctttgaagtggacttaagggaggagaagtcaataagtataaacaagttatttccaggggttgtgctataaaggaaaggagaaaaattgggaccttaactggaagtgggatggagtttttttcttttcattttgttttgtgttaagagaattaatatcatacgtatatgctgattggactgatcctgtagagagaaaag

SEQ ID NO: 38616 - DNA, 601 bp, Human
gttgctagaaaggtcgcagaaaagccagaagagtgaagggtcctagaacccaagtgaaaaaaaaaaagtatttcaagggaggggaaaagatcaactgtgtcagatgcttctggtacatcaggtaagatgggggctgagaaatgacactggatttagcatgggtgtcattggtggctttgacaagagttataagcacatatctcctttgaagtggacttaagggaggagaagtcaataagtataaacaagttatttccaggggttgtgctataaaggaaaggagaaaaattgggaccttaastggaagtgggatggagtttttttcttttcattttgttttgtgttaagagaattaatatcatacgtatatgctgattggactgatcctgtagagagaaaagaattggtattgccagaaaggacagaattgctgaaaatctgcccctgagtaggcaagagggtgtgagatcaagggtgcaaatagaagggttgtgggctttagctaggaacatggataatttattcatggtaacaaaagatcccccttttttccagtcttcatccaacttgtcatcaagaaggcatgtgatgcctttggcca

SEQ ID NO: 38617 - DNA, 601 bp, Human
atcattttcttgtgtgtctgtccacacacacacacacacacacacaccctgtttttactttgattaatattaagtacataatcatcaattggaaacctcagaattatctttgactcttcctttctttcactattaaagtcaatcagtcattaagttctctccattctacctcttttttctttttctttttctttttcttttttttttttttttttgagactgagtcttactctgtcacccaggttggagtgcagtggcatgatcttagttcactgcaacctccccttcccaggttcaagcrgttctcctgcctcagccttctgagtagctaggattacaggcactgccatcatggccagctaatttttttatttttagtagagacggggtttcaccatgttggccaggctggctttgaactcctgacctcaagtgatccacctgccttggcctcccaaagtgctgggattacaggcgtgaggcaccacacctagccattctgcctcttaagtatctcttaactgtccttctgctcagaatcctgcctgcctttgtgtctcacttaatctattacagtaacctcttgatagtctccctttct

SEQ ID NO: 38618 - DNA, 601 bp, Human
ttttttttttgagactgagtcttactctgtcacccaggttggagtgcagtggcatgatcttagttcactgcaacctccccttcccaggttcaagcggttctcctgcctcagccttctgagtagctaggattacaggcactgccatcatggccagctaatttttttatttttagtagagacggggtttcaccatgttggccaggctggctttgaactcctgacctcaagtgatccacctgccttggcctcccaaagtgctgggattacaggcgtgaggcaccacacctagccattctgcctsttaagtatctcttaactgtccttctgctcagaatcctgcctgcctttgtgtctcacttaatctattacagtaacctcttgatagtctccctttctccttttataccaagttctttctatctggaatcgtgttgtttaccttgatgaatacgtactcatcttttaggacctcctctataaattctttcttaacatccctccatacatataaaattcatcataccctctaccatacctctatggtacttttaacaagccattattttagtacttacgttgcattgtaattattccctataat

SEQ ID NO: 38619 - DNA, 601 bp, Human
caggttcaagcggttctcctgcctcagccttctgagtagctaggattacaggcactgccatcatggccagctaatttttttatttttagtagagacggggtttcaccatgttggccaggctggctttgaactcctgacctcaagtgatccacctgccttggcctcccaaagtgctgggattacaggcgtgaggcaccacacctagccattctgcctcttaagtatctcttaactgtccttctgctcagaatcctgcctgcctttgtgtctcacttaatctattacagtaacctcttgatartctccctttctccttttataccaagttctttctatctggaatcgtgttgtttaccttgatgaatacgtactcatcttttaggacctcctctataaattctttcttaacatccctccatacatataaaattcatcataccctctaccatacctctatggtacttttaacaagccattattttagtacttacgttgcattgtaattattccctataatactatgggttgtgcattctttcagaataatgactgaatattactctattatccatctttctaccgctcttgacttcccaactcc

SEQ ID NO: 38620 - DNA, 601 bp, Human
acctcttttgtgatagttggcaaactgcctctacaactcccattgctattcacttttttcattaatagtgttttccctttacattggagatacatgaaaggtagcatgtaaaagtcagattctactgcatattcagagctaaaacatgaagtctgtgttgagaggagatcatctttttggaagaagattatagttgtttttggtaggagatgtcttcatggaactgacctggtttaatcaagcactgaaaccagtttttttaaaacgccctgtaacgtctgtgaatacgttgtttacattwatacagattattgggggaattaattcaaggactggcatgtgcttttgctggcagggaaatttatctagaaccttagtaaataggtggagtttttgtgttgttgatacttctgcctattattcaggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggtaagctgaagtatctccttctgttcct

SEQ ID NO: 38621 - DNA, 601 bp, Human
atcttttgatttacctggtaactcaacatataaagacctctgactataaaatgtacatctaggccgggtgcagtggatcacgcctataatcccagcactttgggaggctgaggctggtggatcacctgaggtcaggagttcgagaccagcctgatcaacatggcaaaaccccatctctactgaaaatacaaaaattagctgggtgtggtggcacatgcctgtaatcccagctacttggaagactaaggcaggagaatcacttgaacctgggaggcggaggttgcggtgagccgagatagcrccattgcactacagcctgggcaagaagagcaaaactctacctcaaaaaaaaaattaaaataaaatgtacatctaaaggaacaaattgtcaagccaaagagctcgtcttcatttcagatatattatacttactaaaatttttctgagacttagatattaatttagtatctatctgctatgctatgctatctgctatctgctatgagaaataagctagtctttgaaagttatcaatgagcaactcccattgtgagttatttttaatttctgctacaacttgtttcttcttttgcctggtgca

SEQ ID NO: 38622 - DNA, 601 bp, Human
tgaatatcatccattgttttggcgctactgtataaaaggatagtgggctgtacatactatgctattcttttcttttttttctttattttaaaattaatatgtgctcattattctcttttcagagaatacagaaatgtataaacaaaaatgtaaaaataacagtgcttatttcttgggataaccactattacgtaggacaaaggttttgtgtttgtttttgtttttttaactttttttggaaataatttcaaatacacaaaaagttacaaacataaaaataatacaaagaacatcccaacaytctttacccagattcacctattgttaacacattttattccatttctccatttgcatatgcacttatatgctcagtctttcttatacttttgcatgctcagtctttctctctctctctctctctctctgtcacacacacacacacacacacacacacacttgcatgtgtacacccagacacacacaaaattttgttttaatcatgtgaggataaattatatacattgtagccctttacccccaggatatttcagtgtgtatgtcaaagaatattttcttatataaccatagtgtagtcatc

SEQ ID NO: 38623 - DNA, 601 bp, Human
gtagtttgttgtgggtgatggagtgtcataaagccaactgttaagagtggtaactataaaagatgtgtttctgttttttctccactatccagtattcacttacaagcattatcttgaaattttattaaaatcacattgctctcatttagaaatttcaactgggtttccgtgtctattatcaatgattttgacttgtcctccgagacccctgttagttgcctgcccttcttttcctgattcccagtttaggcatttctctgcctgtaagcaagcctatctacaaaattatatcagtaacttscctttaacacttctaagcctttcatgtgtcatttttgaagcaccatccacaactagcctatttttccttagccattgcatcttctctatacttgggcatctagcctgctaaaattatagatgttgtataagtagtctttggtttgtgtcttctgtccactcttccacccttttctccctaaagttaagaactgtgtctgctgtttctcttatgcctaattatgaattctgtaggcatggggttcccttacttttgttggctgaccgattaataaagccttaaggaaaaatatcatatgtt

SEQ ID NO: 38624 - DNA, 601 bp, Human
caccatccacaactagcctatttttccttagccattgcatcttctctatacttgggcatctagcctgctaaaattatagatgttgtataagtagtctttggtttgtgtcttctgtccactcttccacccttttctccctaaagttaagaactgtgtctgctgtttctcttatgcctaattatgaattctgtaggcatggggttcccttacttttgttggctgaccgattaataaagccttaaggaaaaatatcatatgttatgagaatctacatatacaagcaggttttatagtttggcasagtcgtatacttgggttttgttattgctttctttttaaatgtaatgttctcttattcttttatatttttagatgcagcccggcaggccactcatgatcatgaggtaattagccatctgtctacatatcatatatatgtatttataataatgttgctttttgaaatgctattggatttttttttttttaatgaatggcaaagtatttcctatctcgtaattcagattaaatgagatactttagcttgggggttcttagcatatggcagacacttacgttgtgtgtctgtcattgaactaca

SEQ ID NO: 38625 - DNA, 601 bp, Human
gcaaagtatttcctatctcgtaattcagattaaatgagatactttagcttgggggttcttagcatatggcagacacttacgttgtgtgtctgtcattgaactacagcccctaacctcaatcctttcctgtgatctgagaattttattggctttaaatgccaaagatggctggaatttggaatgaagtatagaaatgagggctagctgaaagctataacatgaccatagtttatcatcaccaaatacttaaatctgactctcagaaaagttgttatttaaagaatccagcatttgcttaaarcgaactgttcaactacaatgtcgatagagcacaagcgacagtatctcaggtttgttttttgttttgttttgttttttgtttttttgagatagagtctcactctgtcgcccaggctggagtgcagtggcacaatctcagcccactgcaacctccgcctcccgggttcaagcaattctcctgcctcagcctcccgagtagctgggactacaggctcgtgccatcatacccggctaattttctgtatttttagtagagacagggtttcatcatatgagccaggatggtctcgatctcctgacc

SEQ ID NO: 38626 - DNA, 601 bp, Human
tcgtgccatcatacccggctaattttctgtatttttagtagagacagggtttcatcatatgagccaggatggtctcgatctcctgacctcatgatccacccgccttggcctcccaaaatgctgggattacaggcgtgagccaccacgcccggcccagtatctcagttctcacacctcctttcctattccctcacttcactagcacatgtttgtgtactggcttctttcctcccacttggttcagccccattgttaggatttaggcctgtgtttctgtgtgtgtatgggatttaggtgtgtrtgttgtttcaaattctgttttctccttcaaacttttcttgtttcctctaacttcctttaaccctcatggctctctatacttgtgttatgtgcttagctgatctgacctaggggttttgaggtaattcaagggctcacactctttggttgtaatgtctttgtggacatacacagtctagtttccatctttatatccaaccccataccacctatcatgatacctttgccttgagaaggtattccacaaatgattattttatggaatctattcaaagttgacctgaaataactgagaatttga

SEQ ID NO: 38627 - DNA, 601 bp, Human
ctcttttacatgtgtttggttttttactaaatcaaggaaatgttggttaccttaaaacatagagaaaagattcagattcacaggtcaaatagacgttattaccatctatgaattataaagtgagaagcatagtaaatatttacattttattcttcagataaatcctatataaatgtaattatatatgacattctatgctctaattaggatgaaatgttatgttgttttgctggagaaactttgtatgtattctttgtattttaaatcataataatattgtaaacttttcatattagcagacatttgtataattacttctctctttctttgcctgtgtgcccagctatcaatatcatgaaattcctgtgcttctttttttctctattttatagcttctctatccttaacagttaccaaagagaatttggacagtaacctgaaacattagatctcacattttctagtcagtcatctgaataggtgtcagtcatctgactcatttcatcactatgaattttgctggccaaactatatgtagcatttttgtcttcagtaaacttgatagttgcagtcagaaaagatgtagatttagtctgtatca

SEQ ID NO: 38628 - DNA, 601 bp, Human
atctcacattttctagtcagtcatctgaataggtgtcagtcatctgactcatttcatcactatgaattttgctggccaaactatatgtagcatttttgtcttcagtaaacttgatagttgcagtcagaaaagatgtagatttagtctgtatcatagaacctgctgctgattatttgagaagtgaaggtgtttattcagatacattagtgtgatatgaatttctgtaatttctgtgatttgcaaaaagaagtgagtctctgtatttccctgttacaggattagacacatgttaaaccaaacaaaaaaaaggagtgagtagatggagagccagcagttgtttcttaaaaggttatacagtaggttctgtaaatccatgtgttggtatggccacagcaggataaagctcctttagtaagcgtgttgacccaattaatgtcccttacttcatccatttttatttttcactgaataatatgtttcctaaattagataattttagaacaattgcagtataaaagaactgatttgaaagttttaaaactgtttttaaacactgttacccagtaattttcttacatataacttcttagtataatagaag

SEQ ID NO: 38629 - DNA, 601 bp, Human
gaacctgctgctgattatttgagaagtgaaggtgtttattcagatacattagtgtgatatgaatttctgtaatttctgtgatttgcaaaaagaagtgagtctctgtatttccctgttacaggattagacacatgttaaaccaaacaaaaaaaaggagtgagtagatggagagccagcagttgtttcttaaaaggttatacagtaggttctgtaaatccatgtgttggtatggccacagcaggataaagctcctttagtaagcgtgttgacccaattaatgtcccttacttcatccattttgatttttcactgaataatatgtttcctaaattagataattttagaacaattgcagtataaaagaactgatttgaaagttttaaaactgtttttaaacactgttacccagtaattttcttacatataacttcttagtataatagaagttcagaaaaatagcactatgggtgaaaagcagccgcagaaggagcccatggaaaggagtaattgaatcaggacttaaaaatgacctaggttttgtgggcatctcagggtgggtaaaatggcttgagcagaggtatgagtaagtttttaataaaag

SEQ ID NO: 38630 - DNA, 601 bp, Human
acccaattaatgtcccttacttcatccatttttatttttcactgaataatatgtttcctaaattagataattttagaacaattgcagtataaaagaactgatttgaaagttttaaaactgtttttaaacactgttacccagtaattttcttacatataacttcttagtataatagaagttcagaaaaatagcactatgggtgaaaagcagccgcagaaggagcccatggaaaggagtaattgaatcaggacttaaaaatgacctaggttttgtgggcatctcagggtgggtaaaatggctygagcagaggtatgagtaagtttttaataaaagagcaaatatcttgcagtgtctaaagaccatagatcctaaatacatacttatttccctttacttatcctatgaggagtaaaacactgagactcagtgatcctctcaactgaccacctcattttgccagtgaggaaagtgacttgcctaagacagtatatagaatggaaagaatttacccagaatcacttactgaattaaattagaggcagaattgtgacagaaacccaggccttctgtgtcatagtctaacattcttgacagcacagtg

SEQ ID NO: 38631 - DNA, 601 bp, Human
tgaaacttggatccctaagtcattgttaccaaggcaggtactggagagggcatattagagctaaagaaatgctgacctgaaagccattctgcatagcagtggggcacttcaggctggtacacaatgttaagagcatttcccaaagtaaaagtctcttgagagaagcacatatcacactctttgaaattctggccctgagcctagatcacagcaaaataggttcagttcaaaagggcctcttttctcttaacctccactcaatatatagaatggaaaccaaagtgaagaatattcttgctcytctcaaatcgaaagccagcccactagacccaagagttagcgagtattactctcaagaaagtgtctatatctcatgtgaaaactaagatagaaacaataattttgtttctcctttaatttatgagaaatgacagaatgacactcagcttgaacaaattagaccctttcagtgaaagggtaatcagatccttatgattttaatcctttgagctatccttggagcagcttaagtacacccaagcccccaggaggatcctctccatgccgtgaaatgtgctcagtaatggaagagcgctgatgg

SEQ ID NO: 38632 - DNA, 601 bp, Human
aacctccactcaatatatagaatggaaaccaaagtgaagaatattcttgctcctctcaaatcgaaagccagcccactagacccaagagttagcgagtattactctcaagaaagtgtctatatctcatgtgaaaactaagatagaaacaataattttgtttctcctttaatttatgagaaatgacagaatgacactcagcttgaacaaattagaccctttcagtgaaagggtaatcagatccttatgattttaatcctttgagctatccttggagcagcttaagtacacccaagcccccagraggatcctctccatgccgtgaaatgtgctcagtaatggaagagcgctgatggtttttattaccactcttccattaagtagaatttctctgttacctttcagagactgaacagtttcattgaattgctttaatgtttcttattttgtgctctgagaatctgtaccaaggggcagtgtgttaatgcacctatgtggtgctgtcctctgcccttacataattagcttgatttggactgctctggcaaagaagagaaaagattaccagtctgaggagagtcaagactttggaggagagggatct

SEQ ID NO: 38633 - DNA, 601 bp, Human
agaagctggaggtggatgtgatccaggagcggagccgcaacacagtcttacagcagcacctggagaccctgcggcaggtgctgaccagcagctttgccagcatgcccttgcctggtaagtcctcctgcctgagaactgtcagtgacaggggtgtgtgtgttgtgtggagtggggtgctgtttatgttagtactggtgtggagagattgaaatctcctccagaggaaaattaattaaactacattttttcttctctggatataatagaatgtcagtattggctaaaatcgtccaatgtttcmggctctctggtcattcaaatttttgtccatttatattttaatatctattttcccctcttttaagcttaatttgctattcagaacactggaaactgagtagtaaatcttgagagtgtttcttcttatgtatgtttgtttgctttttagttgtttttgttttaacgggaaggaagggagaatgaacactggtatttcttatatactctttcattttgaagatagtcatagcagaaagctgagcgagtctaaccttctgttacatgcagctgctcatatatactatacagcaattatatagcc

SEQ ID NO: 38634 - DNA, 601 bp, Human
tgttttaacgggaaggaagggagaatgaacactggtatttcttatatactctttcattttgaagatagtcatagcagaaagctgagcgagtctaaccttctgttacatgcagctgctcatatatactatacagcaattatatagcccatctgtttatttagagtatgtggactaatttcatttctttgagatctaaaagtctctcctctaaaattaaaagcatgtctgtggagcagaccacattagaatcactgtttctttgaaattgtgttttatggtacaactgaatagggaggatttycttactttcttcttatctcacttcaggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggattacattggatgaacaagttggagacttggttaagattcct

SEQ ID NO: 38635 - DNA, 601 bp, Human
aggctgatgtccccagcactcatgatgcaattaattactctgacaagagtttggcaaagttttcatccactgtcaggagccagtgagtgaagggaagctaatggtctacaagtttcagaggagcatattagggacctttagaaatctaacattttatatatgaagaaactgaatcccagagaggagaaacatcttgcttgaaaatatctgcgtagatgagtacagaatccaagactagaaccacagatatctaaactctctcattcactgggtttctaaaacattgctctaaggaagaggkggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgata

SEQ ID NO: 38636 - DNA, 601 bp, Human
caggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcrcataatacatctctatacatgcagatatccttagttaacacttgaagaaaattggttttgattgaccatacattcttcagactaaagtagggtactcattttccctcctcaggtttgtccctgatagttgcttttctgtgtttagctgatgattttcctacctcccattgttgctgaactggaacagggccatgtttctcattgaaatgttatgtaaaacatctcaatgaggttgcctgcttacagctttatgagttcttcagtttacatacaccctgcactcactttaacgcttatgaa

SEQ ID NO: 38637 - DNA, 601 bp, Human
ctaaagtagggtactcattttccctcctcaggtttgtccctgatagttgcttttctgtgtttagctgatgattttcctacctcccattgttgctgaactggaacagggccatgtttctcattgaaatgttatgtaaaacatctcaatgaggttgcctgcttacagctttatgagttcttcagtttacatacaccctgcactcactttaacgcttatgaaaccaaagcatttttaaaatccatagcgctaaccccttccattcaatacttactttcttggtgttattttccttgtttgtttctgtttttgttttgttttgttttcctgattctacaggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttcc

SEQ ID NO: 38638 - DNA, 601 bp, Human
ttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttsctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttatttttgtttttgttttgacactgcagagcacaaggctaaaggttacagctgagatctttggaaccaaaggcagagcaagcagagcccgttgtctgggccccacaccactgcaggcaggtggatag

SEQ ID NO: 38639 - DNA, 601 bp, Human
taggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctmcaactcttgggctcaagcatcacgcctagcagtttctggttcctttaacagcaaaaggaaagagaggttctgattcttacctcagggttttttggttgttcattgtttttatttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgtt

SEQ ID NO: 38640 - DNA, 601 bp, Human
gaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttrtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatca

SEQ ID NO: 38641 - DNA, 601 bp, Human
ggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaaytcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaact

SEQ ID NO: 38642 - DNA, 601 bp, Human
aaagggcctggtgcaggaagggcgggtgacgggggtgtcctggagctggagaacagcagccagccctgtttatgtgtcacttgtaaaggtgtccctgagggtctgagggcttggggcccaggaaggcactgcagggttcagacattgagggagaggccagaattgctggagggtggtgaggtgccactgggagggctgtgcatggtgacaccaagttttggaaggtacagcaagtgcatcaagagctttttgtgggtagggaatgggcactgccctttaagagcaggaatatcatcttaasagcctgttgcccccatcccgcccctgctggttcatggcgcaggtggcctccaccagcactgaggttgggtttagactacttcattgtcttccacccaggagaggcgtggagtgggtgcgagtcccttggtcaccaacccaagtctctgcttccctgtaccccttcacagaagccccttcagtggcttcaagtggcagtgctggctggagctgactccgccttcctgaacagcccacgtccctggaacaggccacctgcctggaacacactcagggtctggggtctcctgggcagattgct

SEQ ID NO: 38643 - DNA, 601 bp, Human
ttggaaggtacagcaagtgcatcaagagctttttgtgggtagggaatgggcactgccctttaagagcaggaatatcatcttaagagcctgttgcccccatcccgcccctgctggttcatggcgcaggtggcctccaccagcactgaggttgggtttagactacttcattgtcttccacccaggagaggcgtggagtgggtgcgagtcccttggtcaccaacccaagtctctgcttccctgtaccccttcacagaagccccttcagtggcttcaagtggcagtgctggctggagctgactcygccttcctgaacagcccacgtccctggaacaggccacctgcctggaacacactcagggtctggggtctcctgggcagattgctcaggcagccccttcctagcctgggcagggaccccagggtcacttctcccctctagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatct

SEQ ID NO: 38644 - DNA, 601 bp, Human
acgctgagatccgcatccgctggctgcagattgtggtccgcaacgactactatcctgacctccacagggtgcggcgcttcctggagagccaggtgcggtcacctgcccagggggccagcctggaacggcctagccgtgcggactgggagtcccacccgactccctagtctgagcccttggggcaggccaggcacattctggagaatggggcggggaagacgtaggggtctgttgggagtgggggcatgcaccgggtgcaggtaccagagggcagcctggactccaccagttcttggagaarctgtggaagggaccagctgggagcaggagtttagggtccaggccaccacagcctgctgggccctgggccttcagcgtcctggtctgggcagaggggacgtcccagctcctcagagggaggccagagccctcaggcccgtgggccctggctgccctgctccctgtatgtgctccctccagcccaggttccctggagatggggcctccatggttggcctggaagggcagggtggaggtgggaggctaatggtaggcctcctggccaccggagtccaggccacagccctaatgatgaagctgg

SEQ ID NO: 38645 - DNA, 601 bp, Human
ctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctrgggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagag

SEQ ID NO: 38646 - DNA, 601 bp, Human; identical to SEQ ID NO: 30426

SEQ ID NO: 38647 - DNA, 601 bp, Human; identical to SEQ ID NO: 30427

SEQ ID NO: 38648 - DNA, 601 bp, Human; identical to SEQ ID NO: 30428

SEQ ID NO: 38649 - DNA, 601 bp, Human; identical to SEQ ID NO: 30429

SEQ ID NO: 38650 - DNA, 601 bp, Human; identical to SEQ ID NO: 30430

SEQ ID NO: 38651 - DNA, 601 bp, Human; identical to SEQ ID NO: 30431

SEQ ID NO: 38652 - DNA, 601 bp, Human; identical to SEQ ID NO: 30432

SEQ ID NO: 38653 - DNA, 601 bp, Human; identical to SEQ ID NO: 30433

SEQ ID NO: 38654 - DNA, 601 bp, Human; identical to SEQ ID NO: 30434

SEQ ID NO: 38655 - DNA, 601 bp, Human; identical to SEQ ID NO: 30435

SEQ ID NO: 38656 - DNA, 601 bp, Human; identical to SEQ ID NO: 30436

SEQ ID NO: 38657 - DNA, 601 bp, Human; identical to SEQ ID NO: 30437

SEQ ID NO: 38658 - DNA, 601 bp, Human; identical to SEQ ID NO: 30438

SEQ ID NO: 38659 - DNA, 601 bp, Human; identical to SEQ ID NO: 30439

SEQ ID NO: 38660 - DNA, 601 bp, Human; identical to SEQ ID NO: 30440

SEQ ID NO: 38661 - DNA, 601 bp, Human; identical to SEQ ID NO: 30441

SEQ ID NO: 38662 - DNA, 601 bp, Human; identical to SEQ ID NO: 30442

SEQ ID NO: 38663 - DNA, 601 bp, Human; identical to SEQ ID NO: 30443

SEQ ID NO: 38664 - DNA, 601 bp, Human; identical to SEQ ID NO: 30444

SEQ ID NO: 38665 - DNA, 601 bp, Human; identical to SEQ ID NO: 30445

SEQ ID NO: 38666 - DNA, 601 bp, Human; identical to SEQ ID NO: 30446

SEQ ID NO: 38667 - DNA, 601 bp, Human; identical to SEQ ID NO: 30447

SEQ ID NO: 38668 - DNA, 601 bp, Human; identical to SEQ ID NO: 30448

SEQ ID NO: 38669 - DNA, 601 bp, Human
cctgggaaagggtccggtggccgcttgggggctggactgcccattgctccctggacctcggggctgcctgcccttttgagggcccggagccgagcaaccggcctctcctcgacctcagggcagccgcgtggacattcaaactgctccgagtgccgtgtgagccatgtcttcttcagcttggtgtggtggctggggggacaggccctggggccagaggccttgttcacttcctcgctgggttcgctggctccactggcacccccctccaggccctcctggcacttcccacaagggccaagayccccacctttagtgggtgggtaggatgaacagcagccccgctgggtgacaggcggctcaggagaggggcaccttggtgttgctggtggccccagctggtacccaaggttcccatcgcctggcccagcccagacgttgccaagagtatgaacaaggcctgggggacaagcgggccaggaggtccagggcacagtgtctggctgccccaggaagagcgggcaaggattctgctgccggccagctcccatctctccatccctctggtgcagtgaagggcgttcggcctccccggctctctgca

SEQ ID NO: 38670 - DNA, 601 bp, Human
cccattttatagatgaagtaactgaggcccagagaggcgaagcaactcatccgaggtcacacagctaccaatcagcaaagtcagggacgaggcactctggctccagagccatgctctgaactatgtcattatactgccaccaacacaccagggcttgggaggagacagaggtagaagatacttgctggaaggctctggcctggagatgctgaggaactcccagagagccctcgtgatccaggtgggagcctgaccactggttgtggtccactcataaagcctacagaccccgccccatgcraagccccagccccggctgccccctcccacgcagggcctgcagcccctcctggcccccttacctttctgctcatcatgctgtcccgagtccacatccttgttccctatcgatgtgtcccgcacctcctgccaacccccagccccctgttctgcagtgcctgggaaagggtccggtggccgcttgggggctggactgcccattgctccctggacctcggggctgcctgcccttttgagggcccggagccgagcaaccggcctctcctcgacctcagggcagccgcgtggacattcaaactgc

SEQ ID NO: 38671 - DNA, 601 bp, Human
cgaaggggccaacaaattcccagccagggcagaggcctgggcagagggcacagacaggcccatgccaggtgcagggcatttgggcaaggccacggagagagctcatccacacccagccgtccaggaagctgaaaaaaccgaagtgatcccaaagaactaaggctggagccggcagtgccagggtcctccgtggagggcacagtgtagcaagtgactccagggtgcgcccagagccctaacactggcagagtccaaactgagtctccagctccacctggccaagagagcagccattcctggsgcaggacaagggatccttcaggacaagcaatccccaaacagggatttgtggcacacgcagtcatcacggtgaacatttactgagtgttcactgggtgccaggaattcttccaagcccttgctatgaatcattctagcatttaacttttgcagcagtcttcctgaggtaggtgccgtcttcttccccattttatagatgaagtaactgaggcccagagaggcgaagcaactcatccgaggtcacacagctaccaatcagcaaagtcagggacgaggcactctggctccagagccatgctct

SEQ ID NO: 38672 - DNA, 601 bp, Human
tcctctgccacccgatccctagggcttgggctcccagctccctctcccctgtgttggggacacttacgctcaggccaggagaagccctcccagaatgttgtgctgcccaggctgctgggctggggaggtccgagggggctcagcgcctgcacctggcctccaagtgccccaagagcttctgtcccccacaggttgccctgcaatgtcctttggatccctgacaccaacacaggctgtggtgggaaaggaaggaggccatgaggagaatggccagggtgcccgccgtggccaggcaagggcrtgttgtaagggcagtagaacagctcggggacagccctcctgctccccctgagccactgggtctgtctgggcctagggaccaaggccccgaggggcaggtggggtggccagggccgggaggggaggggaggggtgcctcacctggccctgcctccagtgctcctggaagaggtggaagccacgccgagggcaaggctggggctcctgcagccacagcaaagcccctgggggaggcagccggggccgcactggagagaggggcaggcccaggcccttgcgcagacccgggccagctcgaagc

SEQ ID NO: 38673 - DNA, 601 bp, Human
ggggtcaccctgggactcctctgccacccgatccctagggcttgggctcccagctccctctcccctgtgttggggacacttacgctcaggccaggagaagccctcccagaatgttgtgctgcccaggctgctgggctggggaggtccgagggggctcagcgcctgcacctggcctccaagtgccccaagagcttctgtcccccacaggttgccctgcaatgtcctttggatccctgacaccaacacaggctgtggtgggaaaggaaggaggccatgaggagaatggccagggtgcccgccrtggccaggcaagggcgtgttgtaagggcagtagaacagctcggggacagccctcctgctccccctgagccactgggtctgtctgggcctagggaccaaggccccgaggggcaggtggggtggccagggccgggaggggaggggaggggtgcctcacctggccctgcctccagtgctcctggaagaggtggaagccacgccgagggcaaggctggggctcctgcagccacagcaaagcccctgggggaggcagccggggccgcactggagagaggggcaggcccaggcccttgcgcagacc

SEQ ID NO: 38674 - DNA, 601 bp, Human
cccttggtgacatacacacctgctggtgtcctcatcccccaaagctcggtgcagcaggaggacagagccctcgtctgactttgggcgaactacaggaggagacagaacggccattggcctcctcagccctgaagcccctgccccggcggcagcaacacctgcttccagcccctcggggtcaccctgggactcctctgccacccgatccctagggcttgggctcccagctccctctcccctgtgttggggacacttacgctcaggccaggagaagccctcccagaatgttgtgctgcccagkctgctgggctggggaggtccgagggggctcagcgcctgcacctggcctccaagtgccccaagagcttctgtcccccacaggttgccctgcaatgtcctttggatccctgacaccaacacaggctgtggtgggaaaggaaggaggccatgaggagaatggccagggtgcccgccgtggccaggcaagggcgtgttgtaagggcagtagaacagctcggggacagccctcctgctccccctgagccactgggtctgtctgggcctagggaccaaggccccgaggggcaggtggggtggccag

SEQ ID NO: 38675 - DNA, 601 bp, Human
atggcaatagagaaagaacagttagaaatggaatcagagagccaggcgcggttgctcacgcctgtaatcctagcactttgggaggcccaggcgggcagatcacctgaggtcaggagtttgagaccagcctcaacatggagaaaccccctctctactaaaaatagaaaaaattagccgggcgtggtggtgcatgcctgtaatcccagctactcgggaggctgaggcaggagaattgcttgaacctgggaggcggaggttgcggtgagccgagatagtgccattgcactccagcctgggcaayaagagcaaaactccgtctcaacaacaacaaaaaaaaaaaaaaagaaagaaagaaatggaatcagagaagcgcttcaggccccagggccttggcacagacgctcgtgtgccccgagatgacaggcagacaggcatgggagtagagactgggcaggagtggagggacactcaccataggctgcccagagctggggctccagtggacgcagggcaaggcccggtgggaggtaggaagccaggttgagttttccatggagggcgcagtactccggaagtggcagactggcagctaggttctcca

SEQ ID NO: 38676 - DNA, 601 bp, Human
aggaagtctgaggaggaaagagcgctcaggcaggcccagggctggtggcgacaaacactcacctctgtagcttgtccccgctcctgcctctggccgaggacctacctttctgtgcccggtgccaggcaggcagtggtgtgtcggcatgcaccaggatgctgaccaggtcggccacctccacacagaggttcttggtccccaggtgtccccggtgcgggctcacacctgcatggcaatagagaaagaacagttagaaatggaatcagagagccaggcgcggttgctcacgcctgtaatcctrgcactttgggaggcccaggcgggcagatcacctgaggtcaggagtttgagaccagcctcaacatggagaaaccccctctctactaaaaatagaaaaaattagccgggcgtggtggtgcatgcctgtaatcccagctactcgggaggctgaggcaggagaattgcttgaacctgggaggcggaggttgcggtgagccgagatagtgccattgcactccagcctgggcaacaagagcaaaactccgtctcaacaacaacaaaaaaaaaaaaaaagaaagaaagaaatggaatcagagaagcg

SEQ ID NO: 38677 - DNA, 601 bp, Human
cgaggggtgacactaggtggaagtcttttccccaggataatgagggctcagctggacttgggaaccacggggctgccctcgccttacccctggactctctcctcccctgcgcctcaagcttcttgcctccagcccaccccatcaccttccccttccctggctcctcacctgacccatctctccctccacttccctcagcccccttccttgctagcccctccgggagcatctcctccaggcagtctcccctaacaagatgcaaataccaaaaggtgggcagccggacggagtctcagaaggsagaggaggctgcctgcctccaggaagagcatagagtagtgacctggggccatgacagacagaagctcagatcccagccctgccactgagcttcggtgttctcatctgccaatgggaaaggagcagtgcctgcctcatggggcggggggctgagacgggtaacagataattgtgcctaaggccctagcaccacgtccagcctcgggcagctggtgctctcatttcatcatcgggtccaggctctcctgccgcagcccctgccccttctctgagccccacggcagaactccgggtcccctct

SEQ ID NO: 38678 - DNA, 601 bp, Human
atcccagttcataaactgtctaccaggacttcttcatctgaagtctttggaatggccagaattgtgtgctaagtggtggatgaggagagagctgtgtgtccctggggagacaactcaaagtgttcatcagggtctccctaagattccggatgcagaaaagggaaggaccactgcgaggctctgagtgccagcaggtgaacaggctttccggccaggctgaggcctctgcagcagccacagctacggggacctcacaagcctaaccagagcagggagctctctgggcaggcagggactcgcrgaggacagaggtgcccagggaacatgtgcaaaggggacgccagcatcgtgctccaacccaccaccagcccaatccaccccctttggcaaggacctcagccattgcccctgggcttagggctgcaagatggggcgtgggggaagggaaggctggtgaagcaaattggaccctaggggagtcccagctgggtgccaagattcctttgcccttggagattcagctccatcctggagctgagcagtgtttcccaggccacccagggagactgtgcccctcagccctgccccgtgagtcactggg

SEQ ID NO: 38679 - DNA, 601 bp, Human
tggggctggggcagctcaggttggcagaacacacatttggctggaaggagcttagaaggaagggattcaaggccctacagttgggcagactgaatccctgcttttctggggctggaggcctttaacagcctctgtgacctcggcccctctcctccctctctcaatggtacccctttctgcaaatccgagggagacgtcctgcataatcccagttcataaactgtctaccaggacttcttcatctgaagtctttggaatggccagaattgtgtgctaagtggtggatgaggagagagctgtrtgtccctggggagacaactcaaagtgttcatcagggtctccctaagattccggatgcagaaaagggaaggaccactgcgaggctctgagtgccagcaggtgaacaggctttccggccaggctgaggcctctgcagcagccacagctacggggacctcacaagcctaaccagagcagggagctctctgggcaggcagggactcgcagaggacagaggtgcccagggaacatgtgcaaaggggacgccagcatcgtgctccaacccaccaccagcccaatccaccccctttggcaaggacct

SEQ ID NO: 38680 - DNA, 601 bp, Human
atggctgagtttgtttggggctggggcagctcaggttggcagaacacacatttggctggaaggagcttagaaggaagggattcaaggccctacagttgggcagactgaatccctgcttttctggggctggaggcctttaacagcctctgtgacctcggcccctctcctccctctctcaatggtacccctttctgcaaatccgagggagacgtcctgcataatcccagttcataaactgtctaccaggacttcttcatctgaagtctttggaatggccagaattgtgtgctaagtggtggaygaggagagagctgtgtgtccctggggagacaactcaaagtgttcatcagggtctccctaagattccggatgcagaaaagggaaggaccactgcgaggctctgagtgccagcaggtgaacaggctttccggccaggctgaggcctctgcagcagccacagctacggggacctcacaagcctaaccagagcagggagctctctgggcaggcagggactcgcagaggacagaggtgcccagggaacatgtgcaaaggggacgccagcatcgtgctccaacccaccaccagcccaatccacccc

SEQ ID NO: 38681 - DNA, 601 bp, Human
ggggccaaaagtgctggagctgggacttttgagcgtcgcgatccctgtttggattcatttgcatagcgctgcccctcccctcggtctttcccgcaaggcccgcgcggctgcggtggccccctgcgggctttggcggcccagtcccaagctgcgaagggaggtggcactgacgcccgaggaggcagagaggcctcccacaggccaccaggccggggccgagaggacttctaagggacctccctggccccccttgctccccaccgccatccccggaagtaaatctcccagcgctgacctgccmgccttagtgatgatcatctcggtgcccgcctcgtggaacttcttccagagctccttctcatgcagccccaccttgatgttctcgatggtctggggatgggagggagagaaacttgtgtctgccaggcccagggctccacgcggagcctgaggaaagaagaaccagacccgaagagctgtgcggaaccctgcccgcccggagcccatggctccagatttcgtttcacagaacgattttgaactattcgtgaatataaaagaattaatcggtggctaaaacttcctcctttaaagctgcacc

SEQ ID NO: 38682 - DNA, 601 bp, Human
cagcaaaccagccggctttttgtttcctttgaatagtctatcattcgctaagtggttcagcagagctgagttctctaaaaagtagaagaaaatactgagtgggacgccagacacttctctaattattgctaatattattcgctagcacttcttgtgtgcttgcatgtgacaggaacttggtgctttacatacaatgtatgaggcaagacctgttcttttacagatggagtggggagggagcagagaccattaagcaccttgtctgaggttgcacagatgaaagtagctgagttggaactgsagccctcacccaccgtggtctgactccaaattcctggcacttgagccttcatcatcttattccttcaaaatcccaattatgagacacatccaggcaaagggacattttcacacctaatctgtcctcagggacagaaatcaagtgtgtgtatgtgcaggggatagagtgggtggggagggagttcctgaacctgaacttgccagcgtctctgtctacagcaatccaccttcacctgataaccgttctcctccacactcctgcccccaccccaccagccccagcgaatctctcactcacccc

SEQ ID NO: 38683 - DNA, 601 bp, Human
aacaaacaaacaaaaatgccctttgtttaaaatgccaaaggccagacatgcccagagaacatgctggccagttattttcaagagacaaggttatttctgctgcctaaaaatggcagttctgaacctttctctttcttaccttctttccacactagcaggcacaagaaatagccccattccccttcgcacttgatcaagtggattatccatttaccaaccatcatccacgtgattccctggtttgagtttcacagtgatagaaaaggaagggacagcagataggtctacggtcaccatttcyctgacaccactgagctacaaggagactgtgacttgcccaagtacactcagccagaaagaggcagggcctgtgacacctggcttccactgtcctcaatgcctgctccatgtcgcaccctctgccagccccttcatgtgtcttccttccctatctccatccccaaaatacagcaagctcaagccctaaactaaacctactttctctcctgatagaggccctgagtggtgatgccacctccctggctaaggcctgagggtggccaagtgcccagacctccaccctcaacaaaagaaaggaaac

SEQ ID NO: 38684 - DNA, 601 bp, Human
caatacatttaggttaaaaattatatatgtgtgtacacatacacaggcgccttggagctcagagtctgaaaagaaccctacagcagtgaaatggcaggggtccccttaaaaccctttgtttctccaaccctgatgtccgtgggggcttttcaggaggaatcctgggtgtgcggggaagaggccagggcccagcatccaaggctggggttaggagtggggctgctggtgccacctacactgagaccaagccttctgtagccaagtgagttctgattttgaagataataaatcgatttccacrtttcacacacatacatagaggcatacacacacagttttctaattcacccaaagcatatttaagaaatcttttccctgagggaggggcaggggtgagagtgtgtggaatggatgttgttttggaagatcggttgcttctcttagattttttttaaaggcacttccttctgatagacttttgctttcagaaaatactttaaaaagagatcaaagcactctctccccaacccactttcccagtgtcttcaacccttacttctcttatcatccacgccactgggctctgacgctctgtatacag

SEQ ID NO: 38685 - DNA, 601 bp, Human
attctggggcggtggtggtgatgatctatttctttatctggatgaaggttacacgagtgtgtttattttgtgcaagtctgtaaagctgcacccttaagacctgtggactcttctgtaggaatgttccacttcaatacatttaggttaaaaattatatatgtgtgtacacatacacaggcgccttggagctcagagtctgaaaagaaccctacagcagtgaaatggcaggggtccccttaaaaccctttgtttctccaaccctgatgtccgtgggggcttttcaggaggaatcctgggtgtrcggggaagaggccagggcccagcatccaaggctggggttaggagtggggctgctggtgccacctacactgagaccaagccttctgtagccaagtgagttctgattttgaagataataaatcgatttccacatttcacacacatacatagaggcatacacacacagttttctaattcacccaaagcatatttaagaaatcttttccctgagggaggggcaggggtgagagtgtgtggaatggatgttgttttggaagatcggttgcttctcttagattttttttaaaggcacttccttctg

SEQ ID NO: 38686 - DNA, 601 bp, Human
ccagattcctgactgataaggagatgtgggcgtcggcacagggaaggggagtacctcccagcctcgcctcccctgcccaccaattcccctctacctaaggcagcagcgctcagaagccgagggacagggacgtaggatgtctggtctgaatggggagttcaaaagccctctgctgtggcctgaactgcctcagggagttccattgccttcaatgcaacagatgtctaggtcttggcagggtctagttgggggactgcttctgagccatgcagaacccactctggggtggggtggggggccytaagcactaccgtttccctgcctaggtggctccagaaggaggaagggtccacccagcgttgggaaagggctgcctgtgaaagtgaggccccctctgtcccctccattggcttcctgcccaggtcgaggggagaattcaaggccccttgggcatctgcccttgggttcttgaagggactaaagttggtgcctagacgcctgacttgggggtgttccccagcgtggcatgcctcaggcgacagaggccaggctgggtttgggagctgtgacttcctgtgagctctgcctctctcatgaaagg

SEQ ID NO: 38687 - DNA, 601 bp, Human
gaagacacagtgaagacactaagccccactgagctgtgccactgcccggctggtccactctgggacaaccatcaggtggttctctgcctctcactaacccaagacagtacgggaccctggagaagctgtccaagatgccacaaacagctgatcagaggcccctattttgtcaccaggggcaccagcttacctggacagaacagggcttccagaaaggatcaaggcctctataagctggcgggccctaagcccaggcgaggaccccgaccgaggtggagggttcacttccttgccagcccaygccccacccagccccgcctgtgcccctctcttgctggaggagaggcctgtgcaagcactgcagggcggggacgtggggatgtggggtgtgtgtgcccaggcgcatgtgagcggtgtgcaagtgcgcatgtgtggatgtgtgcgtgcctggagggaggagggaagttctagctgcaagtctagggacttataaaccttgtggaagaatttgtctcagatgtcaattgaaagcattttcaaatacccaccccaccccctctccaggaatgggggaagtgaggggctcaggaacccaaccctg

SEQ ID NO: 38688 - DNA, 601 bp, Human
agctaagaaatcccccggacaaaacactaggtgggggcgtggcaagtgggcagttgagggaacgtgggtgatgcggtcagggtccacttaccatttgttgtcacagaacttgtagcgatggtcatcggcagggacaatgtcaatcagcaggatatacttggtcttggggttcatgcctgtgacttttaccttgtagctggggaacatcctcctgggggagccgaggggtgaggcggagcgtgtggacagagcaccaggagagatggaacagagtgagcaagggggcagaaggccgctaacrgatgctgcccttttggccagcgatcctggcattggtcacagctgtgtgacctgcacaactcacttccccctctgcccgagctgcacagtgaaaaggtggcactggctgctgtctctgagcccctgcagctatcagtctgtgtctaggaggagagtttacaccatttcccaaattcacttatcccctcccccataatcccctaagacttggggctagtgcccatgagcagctgaagcacagagaccccagtcaggattgtgggagcagattctgacgccaaccttgctgccttaatttccc

SEQ ID NO: 38689 - DNA, 601 bp, Human
ggtcccatccaccaaccccctggtggagcctcacttcgtctggatggctggaggggcctgaagccaaggagaacatggagaaacaggcgagtgcccccacacagcaggtaatggcttgcccttaaagtccccaagagaactgctcccatcttccccacagtgaagcactgacagtctaaatctggccagtgttaatgatttgtctgtcacctgacagcatagtcaccaagtcctgactacccacggccataaggagagtacagacccttgcgatccaccaaactcccaaacacgcagctgsttttcagcccaaacccagccccacctgaagcaggcatgcagacattcgctgaccacctcagcctccgcacagccagttccaggcagtggactccagcctgcagacctgggcagtcactcaggtagctaagaaatcccccggacaaaacactaggtgggggcgtggcaagtgggcagttgagggaacgtgggtgatgcggtcagggtccacttaccatttgttgtcacagaacttgtagcgatggtcatcggcagggacaatgtcaatcagcaggatatacttggtcttggggttcatgcc

SEQ ID NO: 38690 - DNA, 601 bp, Human
tgccaaagggtcccatccaccaaccccctggtggagcctcacttcgtctggatggctggaggggcctgaagccaaggagaacatggagaaacaggcgagtgcccccacacagcaggtaatggcttgcccttaaagtccccaagagaactgctcccatcttccccacagtgaagcactgacagtctaaatctggccagtgttaatgatttgtctgtcacctgacagcatagtcaccaagtcctgactacccacggccataaggagagtacagacccttgcgatccaccaaactcccaaacaygcagctgcttttcagcccaaacccagccccacctgaagcaggcatgcagacattcgctgaccacctcagcctccgcacagccagttccaggcagtggactccagcctgcagacctgggcagtcactcaggtagctaagaaatcccccggacaaaacactaggtgggggcgtggcaagtgggcagttgagggaacgtgggtgatgcggtcagggtccacttaccatttgttgtcacagaacttgtagcgatggtcatcggcagggacaatgtcaatcagcaggatatacttggtcttgggg

SEQ ID NO: 38691 - DNA, 601 bp, Human
ggccaaaggggtccaggtggttgtttgtcagcttcagcttctggaaggagaccagctgccgcatccagtgggctcctgtggcaggagaatccgggtggacatacagccttcctggcatggctggctcagccttccctgccaccatcctgccaacagagcagataagagcaggtgattactccaggggctggtgaggccagattccccgtcccctcttggagcaaacccccattgaccagaggaaaaaatagctgctggtcccaccacattgtcaaattagtacttcaagggtaggagtgtraggttcagaggagagaatgctgaggaggagagagcagttctgaatctcctttattttactgcagtagaaaagaaaagggaggttacagggaaatgggatcatttaattgaaggactggggctaatcacaaagatattgtgaggagatttaggcacttctatgtatatttacacttatgatttaaaatttttttttctttttaagagacaggttctcactctgtcacccatgctagtggtatgatcatagctccctgcagcctccaattcctgggctcaagcaatccttctgcctcagcct

SEQ ID NO: 38692 - DNA, 601 bp, Human
ccacccctaaaactgccccagacttgcctcctggggccaggcagcccccatgcttacatggccaaaggggtccaggtggttgtttgtcagcttcagcttctggaaggagaccagctgccgcatccagtgggctcctgtggcaggagaatccgggtggacatacagccttcctggcatggctggctcagccttccctgccaccatcctgccaacagagcagataagagcaggtgattactccaggggctggtgaggccagattccccgtcccctcttggagcaaacccccattgaccagagraaaaaatagctgctggtcccaccacattgtcaaattagtacttcaagggtaggagtgtgaggttcagaggagagaatgctgaggaggagagagcagttctgaatctcctttattttactgcagtagaaaagaaaagggaggttacagggaaatgggatcatttaattgaaggactggggctaatcacaaagatattgtgaggagatttaggcacttctatgtatatttacacttatgatttaaaatttttttttctttttaagagacaggttctcactctgtcacccatgctagtggtat

SEQ ID NO: 38693 - DNA, 601 bp, Human
ggagtggattctccctatccccatcctggcctgtcccacccctaaaactgccccagacttgcctcctggggccaggcagcccccatgcttacatggccaaaggggtccaggtggttgtttgtcagcttcagcttctggaaggagaccagctgccgcatccagtgggctcctgtggcaggagaatccgggtggacatacagccttcctggcatggctggctcagccttccctgccaccatcctgccaacagagcagataagagcaggtgattactccaggggctggtgaggccagattcccygtcccctcttggagcaaacccccattgaccagaggaaaaaatagctgctggtcccaccacattgtcaaattagtacttcaagggtaggagtgtgaggttcagaggagagaatgctgaggaggagagagcagttctgaatctcctttattttactgcagtagaaaagaaaagggaggttacagggaaatgggatcatttaattgaaggactggggctaatcacaaagatattgtgaggagatttaggcacttctatgtatatttacacttatgatttaaaatttttttttctttttaagag

SEQ ID NO: 38694 - DNA, 601 bp, Human
tgagctccttccctaaactggtcagtgagcgccaaagcctggagctggatcccggagtggattctccctatccccatcctggcctgtcccacccctaaaactgccccagacttgcctcctggggccaggcagcccccatgcttacatggccaaaggggtccaggtggttgtttgtcagcttcagcttctggaaggagaccagctgccgcatccagtgggctcctgtggcaggagaatccgggtggacatacagccttcctggcatggctggctcagccttccctgccaccatcctgccaayagagcagataagagcaggtgattactccaggggctggtgaggccagattccccgtcccctcttggagcaaacccccattgaccagaggaaaaaatagctgctggtcccaccacattgtcaaattagtacttcaagggtaggagtgtgaggttcagaggagagaatgctgaggaggagagagcagttctgaatctcctttattttactgcagtagaaaagaaaagggaggttacagggaaatgggatcatttaattgaaggactggggctaatcacaaagatattgtgaggagatttaggc

SEQ ID NO: 38695 - DNA, 601 bp, Human
cacacacacactggaataccttcctgtgtttcttggtagagtgcaggccacccacagaggttaatactggagcaacacggtcccggggctatggaggagacgtgagagtcatccgtcagtccagttctccacagtccccattcctgaatggtactgtaaggaagattctcgggacaaggagaaggtttgagagtagagaaactcattggcagcatttagatgtggcgagggtggcttcctctcacacccttgggggaggccgcgctctcttgggaatgaggcgctgggcccccgctctcgracctgagactgggagagctgattgtagacactaaagtgggcatttcctggtggctgggagctctgagcggagagggtgggcagccgcggcatcatggtggtggcggtgaagtgcgtggggaagggctggtacggcacagtctccatcgtctgcacgctatagctggtgtacggcgacactgaagtccacatgttacagctcagcggaggtgggggcaggtcgtccaccccagacaccccggcaatctcgggccctgaacctgagtacatacatgcttctctgggggtcacctcactgcag

SEQ ID NO: 38696 - DNA, 601 bp, Human
gttggcctttctcgctccagaagcgtagattttctgagagcagaacaggccctggagatgccagacatcagctccagtgtggcctcctggggatgatgccagctgaggcgtgtttcataattgcccatcatcataggatgcagatggtatggtgcctgggaggctgactctccacacaccagagtgagagactgtatgttggggacctagggggaagggctctgtactttattacaaaatctgaatgatgacagagatgctactggttgcattttccctcctcttgaagggaaaaaaaaamcctttaaaaatacccctcaggtgacatttagcccatgaccctttccgaacgtcatccctcagacctcagagctccagtcatcaatgtctaggccactcactgagcagccagctgtactatcaaagtacacattgtggcttagctgagcccacctctcaggcagtctcacagactctccagaagtcaaaggagtgggcctcctgctaccaaaaccagattctcagctccccttgcaaagagaaggccaggaactctaaggtgtgcacagagtcctcacaccccagcagcgagaatcttccc

SEQ ID NO: 38697 - DNA, 601 bp, Human
atggaaagatttttattattatataagcttccagaggtttgatcagaaaacaaagatgtaaataggcatggaagaaggctattcttggttcttgttttctgtccgccaccattggcaagactatctactatgcgtaggcatgggaaccagttaaagaaagtgtcgattcactagagcgaagctgagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaaggtaagatcgtgttgtggattaaaagtgttccaagcttgaactaattgcttgtcggctcttttaagctcatcctttttgcatgtatccccgctaatatgcatctttatgatgctttttttggctcagcagtcatgctttatggaggcatgctctatggctgggaataggttttctttctctcatatatctctgggga

SEQ ID NO: 38698 - DNA, 601 bp, Human
ggtttagccataaatgacttacttatgaaacatgttaagcttttctgtttaaaatccctcccctgccttttaaaaaatttcccatgaatcttgaaataatcctgagaattcagatggagtgcgggtattttttctaattgttgctcagaaaatccttgatccagtctgagtgttttgttatcattgagccatatgcagaattacaaaatgaaaatgaaaacaggtcagctaaaattaagaagtcaatgcaaggagtaaaggcacagataataccaaaacatgagtcaggatgatctgtctygttggcctgacaaatatggctcaaaattattttttttaaaaaagattagaagttctgaaagtctacaatctgcaaggtagagaccaaattggctacgcattggcagtgtgaccttcccccaaattactaagcttctctctgcctccttttcaaaagcctttactagtatctatatcttagatattatttaatttcatttgataattgtgtacctgacacacaaggagcacagagtaaatggagacaattattgttagctccattttagagaggagagaaactgatagagagagtgatagg

SEQ ID NO: 38699 - DNA, 601 bp, Human
caggatgatctgtcttgttggcctgacaaatatggctcaaaattattttttttaaaaaagattagaagttctgaaagtctacaatctgcaaggtagagaccaaattggctacgcattggcagtgtgaccttcccccaaattactaagcttctctctgcctccttttcaaaagcctttactagtatctatatcttagatattatttaatttcatttgataattgtgtacctgacacacaaggagcacagagtaaatggagacaattattgttagctccattttagagaggagagaaactgakagagagagtgatagggggttaatagctaagctctcagtaatataccaagtggtgcaattccaaagatacatgttttgctctcaagttaagaaaacacaagccaattgcaattttgtgatgaggaagatgggatacagttgcaatatcaaagctgcctctgacaactaataccagccctgacctgcttctgccatggttttctgacctgcaatatttaatcttcagctttcagacatccacattccaccctggaccttgcctgtctggtaagcccaatctctgcaggtcagccatgcagct

SEQ ID NO: 38700 - DNA, 601 bp, Human
aagaaaacacaagccaattgcaattttgtgatgaggaagatgggatacagttgcaatatcaaagctgcctctgacaactaataccagccctgacctgcttctgccatggttttctgacctgcaatatttaatcttcagctttcagacatccacattccaccctggaccttgcctgtctggtaagcccaatctctgcaggtcagccatgcagctgaggtgagggaaggtatgttgggatgggctggcatgaggagtcatgggggtcgagaagaaagttatggcaagagacattcttttgtgygtgcatagtttaacagagacgaataatgttcattttgatctttattaagaggtggcctcttaataggccacccccttaataggcctcagaatatctgctttaaagtggctttttcctgatggtttcttctaccattgttacagtagctgcctcaaatcagccaaagcagaagttcctattttgcttgagagcttaggcttcaggcaaaaactactgacatttatgagatacctagtattttacaatgctatctggttaaattcttataattgtccttttaaaaagacagagaacacagag

SEQ ID NO: 38701 - DNA, 601 bp, Human
tattaagaggtggcctcttaataggccacccccttaataggcctcagaatatctgctttaaagtggctttttcctgatggtttcttctaccattgttacagtagctgcctcaaatcagccaaagcagaagttcctattttgcttgagagcttaggcttcaggcaaaaactactgacatttatgagatacctagtattttacaatgctatctggttaaattcttataattgtccttttaaaaagacagagaacacagaggtaaaataactgctctgagttcacataggcaaatgttggagaygagattcaaacagaaactagactgactcaaaaatcaaatctaagtgatgaaagtaaaggtactgttttgtttgcatcacttaataattcatctggaatcacaagtcatgataagaacctaataagccatatcatcaaaacctgagcttgggtcaccttcaagatgcaacacacccaacatcacagtagattcaggggcaccctgaaacacaagagtaagaaacagaaacatctatccttagagactacccttgtagccattctgctgagttgtatttttttttcattgttgcttagaaga

SEQ ID NO: 38702 - DNA, 601 bp, Human
aacatcacagtagattcaggggcaccctgaaacacaagagtaagaaacagaaacatctatccttagagactacccttgtagccattctgctgagttgtatttttttttcattgttgcttagaagatccttgatccagtctgagtgttttgttttctttgagccctatgcagaattacagaatgaaaatgaaaacaggtcagctaaaattaagaagtcaatgcaatgagcaaaggcacagacagtaccaaaacatgggtcaggatgatctgtcctgttggcatgacaaatatggctcacaatttttttaaaaaaaaaattagaagactcaagtcttttgactttactgagaagatgaagtctgacactgtttatttccaatcttcttggaaagactttcaccactgtttatctcataaaattggagtgctatttaccagttaataagaaaatggcataacataaaacctttaaatactaatgttaaaagagaacttcagagttttctagttcaaccacctagcaaactcatgaagctcttccttaaattcttcaagttgattatccaaattcagagttaacactcagtagattgcttctgtt

SEQ ID NO: 38703 - DNA, 601 bp, Human
tcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgmtaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgt

SEQ ID NO: 38704 - DNA, 601 bp, Human
ccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagakagagtgcctttctgtttcttttcttttcttttttctttttttgttcttccttcctttcttccctcctccccctcatccttccctttctccttcttttccctttttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaat

SEQ ID NO: 38705 - DNA, 601 bp, Human
ttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctacygctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaactgtgtgcatatacctatattttcagtggtataagttctctttgctgatgtggtcagaattgggtacagtgcaccaa

SEQ ID NO: 38706 - DNA, 601 bp, Human
ggatgcctttgcagaccaagcagctaaggaccagcacatttcatggtgacttgatggtgtgcaaatttggtccctctgatgaatcttctagttgaaataatttatcactgtgaaattaagtcatcaagtataagatgaccagctgacttttagccaggtagacaagctatcgacttggtatgatgaaacatcactgagttcatttttatgcctttgtttcctctctgtctcagctgcaagtgtccactgcttgggaaagtgtgggaagctgacttggaagcttgtcgattgcttatccagwgcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccatt

SEQ ID NO: 38707 - DNA, 601 bp, Human
ttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgrgaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgc

SEQ ID NO: 38708 - DNA, 601 bp, Human
gccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctayggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgta

SEQ ID NO: 38709 - DNA, 601 bp, Human
caggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccrtaactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgat

SEQ ID NO: 38710 - DNA, 601 bp, Human
gacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgcgatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttccc

SEQ ID NO: 38711 - DNA, 601 bp, Human
cttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaa

SEQ ID NO: 38712 - DNA, 601 bp, Human
ttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccacygcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacag

SEQ ID NO: 38713 - DNA, 601 bp, Human
aaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttayttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaattgcacgtgtttactttcagatatcagcaaatcagaaaatcatgaaatatt

SEQ ID NO: 38714 - DNA, 601 bp, Human
cttccgcctccaggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacstaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcgaccattttccttacaggccttcctctctaactcccacttcccagcccaactccc

SEQ ID NO: 38715 - DNA, 601 bp, Human
tatatacatgtgtacatacacaggcacctggagtggtcccacgtgctctgtaggtgaaagccaggaggttgagagtacttctgttagatcaaaattatctgggctataaatcagccagcgctaagaaacatttggccttagcaggaagaactgaggaattgggtcaggcgtggtggcttatacctataatccaagcactttgggaggctgaggtgggaggatcatttgaggccaggagtttgagatcatcttaggcaacagagtgagaccccatctctacaaaaaacaatttttttaattaaaaaaaaaaagaagtgaggaattgtgaatgggggaaggtttggtgtgagtcactgagaggagatggcatggcatcagactgggctgggaaagacagtgtcatggaagtcttgctttttcccagggccatctccagagtggatgctacaacatgatctaatcccgggagacttgagggacctccgagtagaacctgttacaactagtgttgcaacaggggactattcaattttgatgaatgtaagctgggtactccgggcagatggtaagtttgcatccatcagagataaggcccaaagtg

SEQ ID NO: 38716 - DNA, 601 bp, Human
ctgctggggtaggaataactgtaaggaagtatgaggagcacacctgagggagtttcttaacctgcatactggttgcatgagtgtcccgatgcatcaagtggtacacttatgtgtgtacttttctgtgtatgtacttcatggaagaagataaggtaaggcgagagatgattttccccaccccacttcagtttagggaaagcactggcttagatagattacttttccacttcccagatgacgtcacgaagcttttggcatttccccaagattgtgctgcaaggcaccatatgagttctttcastgagctactcctgggatcctaatgcccatccttttggtttccatctgctaaattcagatcggaaaaaagtctacctggtcaagaatccatgagtgccaggcacagagagaggagtcacctacagtctccacccaggaggattcagaggggtaggggaggcagacacaggcacaatgtcaggggagtcccagaagggagctgtgcttcatctgagtgggatagggcgagaggagctggaaagggtctctggtgaggttgctttaggtgagatgtggccataagggtttgggcccttacctg

SEQ ID NO: 38717 - DNA, 601 bp, Human
gtcccagaagggagctgtgcttcatctgagtgggatagggcgagaggagctggaaagggtctctggtgaggttgctttaggtgagatgtggccataagggtttgggcccttacctggcacagagtgagctctttgtcagctgtggttatgggctgtggtgcatgagtgagttgggctttaaaagagtgaaacttgaagaggtagataatgggaggaaaggaccttcagggagaagaatcagcatggataaaggtgcaatcggaacaggtgtggtttggtgatgacagtcttggagggtctytgtgggtctccctgaggccagcctcttcctcttaaaagagacccagaatagtgcagagctatagccacctttgcaggcatcctatgaaattcaagctgacctatgaggaggagggagcttgggctttggaatctgaattcgtatctgctacttgctgatgagttttctaagtttaagcagagctccctgaaacttcctaagcctcacgaaccccatctgtaaactggagacagtggtgcctacctttcagtactattgtgaatatgaaccgagacataaaataaagcatgctagtaaagc

SEQ ID NO: 38718 - DNA, 601 bp, Human
gtcagctgtggttatgggctgtggtgcatgagtgagttgggctttaaaagagtgaaacttgaagaggtagataatgggaggaaaggaccttcagggagaagaatcagcatggataaaggtgcaatcggaacaggtgtggtttggtgatgacagtcttggagggtctttgtgggtctccctgaggccagcctcttcctcttaaaagagacccagaatagtgcagagctatagccacctttgcaggcatcctatgaaattcaagctgacctatgaggaggagggagcttgggctttggaatckgaattcgtatctgctacttgctgatgagttttctaagtttaagcagagctccctgaaacttcctaagcctcacgaaccccatctgtaaactggagacagtggtgcctacctttcagtactattgtgaatatgaaccgagacataaaataaagcatgctagtaaagcatctagcatcaagtcagccacacagcaagtgctaaataaaccaatgtcctcttgcctatctcggcagccagcatccgcttgttgaaggccaccaagatttgtgtgacgggcaaaagcaacttccagtcctacag

SEQ ID NO: 38719 - DNA, 601 bp, Human
gtggttatgggctgtggtgcatgagtgagttgggctttaaaagagtgaaacttgaagaggtagataatgggaggaaaggaccttcagggagaagaatcagcatggataaaggtgcaatcggaacaggtgtggtttggtgatgacagtcttggagggtctttgtgggtctccctgaggccagcctcttcctcttaaaagagacccagaatagtgcagagctatagccacctttgcaggcatcctatgaaattcaagctgacctatgaggaggagggagcttgggctttggaatctgaattcrtatctgctacttgctgatgagttttctaagtttaagcagagctccctgaaacttcctaagcctcacgaaccccatctgtaaactggagacagtggtgcctacctttcagtactattgtgaatatgaaccgagacataaaataaagcatgctagtaaagcatctagcatcaagtcagccacacagcaagtgctaaataaaccaatgtcctcttgcctatctcggcagccagcatccgcttgttgaaggccaccaagatttgtgtgacgggcaaaagcaacttccagtcctacagctgtgtg

SEQ ID NO: 38720 - DNA, 601 bp, Human
accccatctgtaaactggagacagtggtgcctacctttcagtactattgtgaatatgaaccgagacataaaataaagcatgctagtaaagcatctagcatcaagtcagccacacagcaagtgctaaataaaccaatgtcctcttgcctatctcggcagccagcatccgcttgttgaaggccaccaagatttgtgtgacgggcaaaagcaacttccagtcctacagctgtgtgaggtgcaattacacagaggccttccagactcagaccagaccctctggtggtaaagtaagcacttttttrttttttgttttgttttttgagatagcatcttgttctgtcacccaggctggagtgcagtggtgcgatcatggctcactgcgacctcaatcttctgggctcaagcgatcgttctacttcagcctcccaagcagctgggactacaggcatgagccaccagacctggctaatttttgtagtttttgtagaggggggtttcaccgtgttgctggtcttgaattccagtgctcaagcgatctgcctgcctcagcttcccaaagtgctgggattacaggtatgagccactgtatccgggcatagaca

SEQ ID NO: 38721 - DNA, 601 bp, Human
taatttttgtagtttttgtagaggggggtttcaccgtgttgctggtcttgaattccagtgctcaagcgatctgcctgcctcagcttcccaaagtgctgggattacaggtatgagccactgtatccgggcatagacacttttatgtatttggctaattgttgctgaaagctatgccctttgtttggggagcatggatgatgtgctgctcacacgggctggtaaatagctatgactcagagcttagagcaagatcccttggttcaaatcccattttcggctacttctctgttttgtgcctttygtaagtcagcatctctgggcctcagtttttccctaccagccaatggaagagaattggacttaaattatatcctggctttaaaactttatacttctctgattctgtaaattgtttagtgcccattccctaagtagacattggttggagacctaagttttcacagagtgagtaatgaaatacaaactaaaagggcaacacactaaggtatactgtttctgtactgcagtgttttgggaattgagagttccttgctttgcctttcagtggacattttcctacatcggcttccctgtagagctg

SEQ ID NO: 38722 - DNA, 601 bp, Human
tattatttatttatttatttattttttagacggggttttgctcttgttgccctggctggagtgcagtggcaccatctcagctcactgcaacctccgcctcttggatttaagtgattctcctgcctcagcctcccaagaagctaggattacagtcatgagccaccacacccagctaatttttgtatttttagtagagacggggtttcactatgatggctaggctagtctcaaactcctaacctcgggtgatctgcctaccttggcctcccaaagtgctgggattacaggagtgagccaccgyacccagccttattttggaataattttagatttacagaaaagttgcaaagatagtacagtttccatatacctctcacccagcttctcctattaacgtcttgtattaccatgatacatttgtcaaaactaagaaaccaacattagtacgtgtctgttaactaaactccagactttatttggacttcacctgctttttcatgaatgtcctctttctgttccagttgcatttagtccctgtgtgtctctcctctggtctgtaacagtttcttagtctttgtttttcagaacgttgacagtcttg

SEQ ID NO: 38723 - DNA, 601 bp, Human
tgtggggactgccagacttctccatgtaaatctactgtttttcccaactctcgtttttggaaacaagtcactaattctaccccaccctggggtgaggataggggagtgttaggcttcatgtccttgaaggggcagcatctacagatattaccaaatgtccttttcaaatgatggatggttttcgagtcctctcttagggatcaaagatactgttttgataaaggctgtatttaaattagactctggttatcacgtaatgggcagatgttctctgtttagcagtaaaatgttagagccccayaaaaaattagccgggcgtggtggcgggcgcctgtagtcccagctactcaggagcctgaggcaggagaatggcgtgaacctgggtggcagagctagcagtgagctgagattgcgccactgcactccagcctaggcgacagagcaagactccggctcaaaaaaaaaaaaaaaaaaaaaaaaattagagccccatttgaatttgccatcttacatctggaatgttttggcaatttgttacaggtgtggtatgcgtatgtgtgtgtgcacttggcaaagggggtggggcagagatacctttttc

SEQ ID NO: 38724 - DNA, 601 bp, Human
ggctcaaaaaaaaaaaaaaaaaaaaaaaaattagagccccatttgaatttgccatcttacatctggaatgttttggcaatttgttacaggtgtggtatgcgtatgtgtgtgtgcacttggcaaagggggtggggcagagatacctttttctaaaatgtaaaaactttcattcaaatttccaggctgcctagaccacataatgaaatataaaaaaaagtgtgtcaaggccggtaagtaaatacggcatttgcttttattatttgaagaaacttgtaacttgaggcagcatagctctcttcayctttgcacagaagaactgagccctaggggagagttgaatatccaagcacccccgatggtggtggcagaagcacctatggctcctgatctccagccagtactttgcccactgagtgcagcagcctgtccagaaaggggtagaccctcagtacatttatatagtggagcaacagtcacaaagaaccacccccatccacttggttaacaacattttagcccaaatggctcagcagtgccaatcaaaggctcttcctgattgatgggagtcctacgagcccttccacctgctcagatgctagca

SEQ ID NO: 38725 - DNA, 601 bp, Human
tgagtgcagcagcctgtccagaaaggggtagaccctcagtacatttatatagtggagcaacagtcacaaagaaccacccccatccacttggttaacaacattttagcccaaatggctcagcagtgccaatcaaaggctcttcctgattgatgggagtcctacgagcccttccacctgctcagatgctagcaccacccacctgtggccatggggatcctaagaaccttctgtttggattagcaaacattcgaggtgggagtgtgagttcgctaaaggactggcccacaattacgctctcaayttgtgtcctcaaagaggatcacttttcacaggctagtgaattttaccccttgaattttgtagtaatcccctttaggattattagtccctagtgcccagtttccaagggtttgtgtaaatttctgagtaatatagtgttggaatgctaatgaggctagtggtatttggatcagcccagaactcttaggcacccttcactgcacaaggcatccctggtaccctttcagacagccgtccatgctgtccttgctagaaggcagatttggacgctgagcttcccaccaagggtacagagaacact

SEQ ID NO: 38726 - DNA, 601 bp, Human
cttgctctataatcttagacatgttttccaacctgtagctctttctccccatcctgggaagtagaaaatactgaccctatcccttaactcaaaagagaggttgaaaacagcagtgagtagcagaaccaatccgtgcctcccaccatactcagcccagggaagctgtttttagcaaagcagcgatgtacggatccccaaactgtcttgggcagcaagtactttgagactttggaaacaatgataaaaagttcactatgtagcagcgtccctatctcttggacattgttcctgagaacttggrtttgtttccataaagccctgtggggaacttaaatgagggaagagttagcaagttcatctacatggttctctctcaactcacaggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgaggtactttttctcttcgtccccttcacctcgtcctccagctttccttagtgtgttgaaggaaaatggggacagtg

SEQ ID NO: 38727 - DNA, 601 bp, Human
cttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcacgtgggtctcgggtcactggttttgactttagggctttgttacagatgtgtgaccaaggggaaaatgtgcatgacaacactagaggtakgggcgaagccagaaagaagggaagttttggctgaagtaggagtcttggtgagattttgctctgatgcatggtgtgaactttctgagcctcttgtttttcctcagctgactccatattttcctacttgtggcagcgactgcatccgacataaaggaacagttgtgctctgcccacaaacaggcgtccctttccctctggataacagtaagtgcccagtaacttcaaccagatgatcaaagtggctcacacacagtcactgccccccactcagtatgtggaagggttgtgtgtatgtgggca

SEQ ID NO: 38728 - DNA, 601 bp, Human
gagcatgactggattacacatgccaggtgaaagcagggtcaggacttccagatcttctgactgtcccgtttttatttttaccattgagccttctaccagtactgaaatgggcaaaagatggctgataacaaattacactttacctgtgatggttactctatgctagttcctgttttttaaaaaatagttcttatgaggtgttaagaaaagctttcgcttggattcatacacagttgacccttgaacaacacaggtttggactgcgcagagccacttacacctggattttttcaatacatayattggaaaattttttggagatttgtatcactttgaaaaaacttagatgaaactcggatgaacttttcaattaaaatattgaaaaaaatgaagaaaaaggtatgtcataaatgcagaaaatgtatacagatactagtctactttatcatttcctaccataccaatagttaactattttaactattaaaagttaaaaatttatcaaaacttaaacacacacataccaactgtacatggcaccattcacagttgagagaaacgtgagcataaagatgtggtattaaatcataactgcatacaa

SEQ ID NO: 38729 - DNA, 601 bp, Human
ttggactgcgcagagccacttacacctggattttttcaatacatatattggaaaattttttggagatttgtatcactttgaaaaaacttagatgaaactcggatgaacttttcaattaaaatattgaaaaaaatgaagaaaaaggtatgtcataaatgcagaaaatgtatacagatactagtctactttatcatttcctaccataccaatagttaactattttaactattaaaagttaaaaatttatcaaaacttaaacacacacataccaactgtacatggcaccattcacagttgagasaaacgtgagcataaagatgtggtattaaatcataactgcatacaattaattgcagtgcgtactgtcctgctgtgaataatttcctagccacctcctgttgctactgtggtgagctcaagggttgcaagtatcgacttaaaacaccctgtgatgctaaccatctccaaacgagcagttcctgtctccagtaaattacatatcacagtaaaaagtatctccagtggttctctggtatttttcgtgtttagtgcaatatcgtaaaccttcaataacaccttaggacccatacgaagtgccact

SEQ ID NO: 38730 - DNA, 601 bp, Human
taaattacatatcacagtaaaaagtatctccagtggttctctggtatttttcgtgtttagtgcaatatcgtaaaccttcaataacaccttaggacccatacgaagtgccactagtaatgctggcagtgctcccaagaagcagtgtcatgaaaaaaagcaaaaaaaacttttttttttcattacaagaaaaaaagccaaattgcttgatatgtaccataaattgagggtctgcagctgtgattgttcaccatttcaagataaatgaatccagcgtaaggaccatagtcaaaaaagaaaaaamttcatgaagccatcactacagctacaccagcagacatgaaaaccttgcacattttgcagaataccttttaatcttgtattgaaaatgtagcttttatgtgggtgcaggattgctgtaagaaaggcatatctgtagactctaatatgatttgagaaaaagcaaagtcattatatgacaacttaaagcaaaaggaaggtgaagcatctaaagctggagaatttaatgccagtaaaggatggtttgataatttttaaaagtggtttggcttaaaaactgtcaagataacaggagaagcagctt

SEQ ID NO: 38731 - DNA, 601 bp, Human
aggcatatctgtagactctaatatgatttgagaaaaagcaaagtcattatatgacaacttaaagcaaaaggaaggtgaagcatctaaagctggagaatttaatgccagtaaaggatggtttgataatttttaaaagtggtttggcttaaaaactgtcaagataacaggagaagcagcttctgctgaccaagaggcagcaggtgagttcccggatgccattaagaaaatcactgaggagaaaggatacctgcctgaacaggttttcagtgcagatgaaagtgtcctcttctgggaaaaaaaygctacaaaggacattgattagtaaggaagagaagcatgcatcaggatttaaggcaggaagggacaggctaactggactgctttgtacaaatgcaattgggtttatgatcaggactggccttatctataaagctgctaaccccctggccttgaagggaaaagataaacaccagctgccaatcttttggttgtacaataagaaggcctggacactgagaaaacttttctggattggttccactgatgctttgtccctgaagtcagaagtaccttcccaggaagcgactgccttttaaagttc

SEQ ID NO: 38732 - DNA, 601 bp, Human
aacaacatggaagtctggaagaattacatcactgaagatgccatcattgtgacagagcaagccatgaaagccatcaagcctgaaacaataaattcctgcaggagaaaactgtccagatgatgtgcatgacttcacaggatttacaacagagccaatcaaggaaagagattgtagatgtggcaaaaaaggtggggggtgaagggtttcaagatacggatcttggagaaattcaagagctaacagataaccacactagaggaacaaagagaagacaacctgctggagacgagtgcttccccakcagtgtgaggtgatgatgaagacgacacagaagcagcagcatcagaaaacaaatcgacattaaacaatctggcaggtttctgattagtcaagactgcttttcacttcttttgtaacacagacccttctatgatacaagcattaaacctaaagcaagtggtggaggaaggattggtaccatatacaaatatttttagaaaaatgaaaaagcaaaaaagccagaaattatgatgtctttctgtaaagttacactgaggcgcccacctctcctgcctcctcttccaccgcttctgcctctgcc

SEQ ID NO: 38733 - DNA, 601 bp, Human
tagatgtggcaaaaaaggtggggggtgaagggtttcaagatacggatcttggagaaattcaagagctaacagataaccacactagaggaacaaagagaagacaacctgctggagacgagtgcttccccatcagtgtgaggtgatgatgaagacgacacagaagcagcagcatcagaaaacaaatcgacattaaacaatctggcaggtttctgattagtcaagactgcttttcacttcttttgtaacacagacccttctatgatacaagcattaaacctaaagcaagtggtggaggaaggaytggtaccatatacaaatatttttagaaaaatgaaaaagcaaaaaagccagaaattatgatgtctttctgtaaagttacactgaggcgcccacctctcctgcctcctcttccaccgcttctgcctctgccacccctaagtcagcaagactaaccccttcctcctcttcctcgtcagcctactcaacaagatgatgacaagaataaagacctttctgatggtccacttccatttaatgaattagtaaatatattttctcatgattttaattacatttttttctctagcttactttattataa

SEQ ID NO: 38734 - DNA, 601 bp, Human
acccttctatgatacaagcattaaacctaaagcaagtggtggaggaaggattggtaccatatacaaatatttttagaaaaatgaaaaagcaaaaaagccagaaattatgatgtctttctgtaaagttacactgaggcgcccacctctcctgcctcctcttccaccgcttctgcctctgccacccctaagtcagcaagactaaccccttcctcctcttcctcgtcagcctactcaacaagatgatgacaagaataaagacctttctgatggtccacttccatttaatgaattagtaaatatmttttctcatgattttaattacatttttttctctagcttactttattataatacagcacataatacacataacatgcaaaatatgtgttaattggctgtttatgttattggtaagacttccagtcaacagtaggctattagaagttaagttgtgggaaaatcaaaggttataggagattttcaactgcatgcagggccggtgcccctccccactgtgttgttcaagggtcagctgtactctctaagggctttgctaacttcaaaacatggagtatttgaatacagaaaccagagcatttac

SEQ ID NO: 38735 - DNA, 601 bp, Human
tctgacctgtattcgttacagtagtttcaaacatggtttgttttacagcaccgtatagggcagaattccaggttaagttccaggggctgaaaaggggtgccacttaactttgggaactataaagaaactctaccacctgcaggtagaagacagtacaagcaactacctaattgacccgactcaaaatgtgaagtgcagaggtcaagtgtccctgttcatatacagcactaaaagtactgaggttacaatcacacacctcaaagtatttttttttttttttttttgagacagggtctcactytgttgcccaggctggagtggaatggtgtgatcttggctcactgcaacctctgcctcctgagctcaagtgaacctcccaccttagccgcctgagtagctgggaccacagatgcatgccatcaagcccagctaatatttgtactttttgttgagatggggtttcgccatgttgccctggctggtctggaactcctggactcaagtgatctaccagccttggcctcccaaagtgctgggattcctggtgtaagccaccacacctggccaacaaagtatcttaaacctaaagtttctatgaatt

SEQ ID NO: 38736 - DNA, 601 bp, Human
actcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagyagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaa

SEQ ID NO: 38737 - DNA, 601 bp, Human
cacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaayaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaa

SEQ ID NO: 38738 - DNA, 601 bp, Human
aaagggaggcagtaggctgcgggcttcccaacccaggggtgaagaacaaagagataggacagcagcacaaggacccagtgtgcctgcttcccagccctgcgctcgtccactccacagagagggcgacacgctgaaaacctccggccacacaccagcaatctcagcagcagctgcagcctcctcccccgaggacggctgatgcaggagcaacaagaacaaaccccagtaacaacaacctccactctcacctcccaggtgcttccaaggagccaggctgagggcaccacaagttcgcttcagsctcacgaccacctttgaggcagccactcttactaccccccgttttcagataaggtaactggggcacagagaggtgagtggacctgcccacagtcgcacagctgggaagtgacagggcccggcttttggccactcactatgccatcttaaaagctaatgtctgcattggccatcagacaaagaaagggactcaccagctagacgcaggcacaccccaggcccacgggtgcttgtgagcttgaaggcggttgctactcgaagggagagctgggctcgtgtgggagaagagtggtctccccgc

SEQ ID NO: 38739 - DNA, 601 bp, Human
ctcaaacaagcagctcaggaaccccaaaatgcagtgtgaataagacccaggtcatacccatgcctggctgtcccagggatgtctatggtctccaagaataagctaagaataagaataggggctgctcgttaggcagcccagcaagagagcacctgttagccggagcctcccatgaacctttcggcaatgttctttgtcagcggcgttgccttttcctctgacgggtcccagtccaaccaaacccagccaacaggaagcagcctggattgtgctatcattcagtcagtcgacaaacgctgartctatactgcacactctgcacctgattccctactggaaaccaagcttcttccagggaacggggtgggacaggaactgaggggtcatgtgccctgggctgggccggggaacagggtcaggacagccctccactgccaggcctggagtgtaccctgcacctaagcccgtggtgatgcacctgtcaccgcaaaacattctacagtgatcaggggaacttctaccgtgatttaggcaaacgagtgttggctgtgtgatggagatggtgattctggtttacacaagactcacaaactcatcaatc

SEQ ID NO: 38740 - DNA, 601 bp, Human
ggggctaggcataagacctgaacctgaagcacctctcgctcaaacaagcagctcaggaaccccaaaatgcagtgtgaataagacccaggtcatacccatgcctggctgtcccagggatgtctatggtctccaagaataagctaagaataagaataggggctgctcgttaggcagcccagcaagagagcacctgttagccggagcctcccatgaacctttcggcaatgttctttgtcagcggcgttgccttttcctctgacgggtcccagtccaaccaaacccagccaacaggaagcagcckggattgtgctatcattcagtcagtcgacaaacgctgaatctatactgcacactctgcacctgattccctactggaaaccaagcttcttccagggaacggggtgggacaggaactgaggggtcatgtgccctgggctgggccggggaacagggtcaggacagccctccactgccaggcctggagtgtaccctgcacctaagcccgtggtgatgcacctgtcaccgcaaaacattctacagtgatcaggggaacttctaccgtgatttaggcaaacgagtgttggctgtgtgatggagatgg

SEQ ID NO: 38741 - DNA, 601 bp, Human
cagggcctgggggccaatcagaataggccctctcacccaaggggctaggcataagacctgaacctgaagcacctctcgctcaaacaagcagctcaggaaccccaaaatgcagtgtgaataagacccaggtcatacccatgcctggctgtcccagggatgtctatggtctccaagaataagctaagaataagaataggggctgctcgttaggcagcccagcaagagagcacctgttagccggagcctcccatgaacctttcggcaatgttctttgtcagcggcgttgccttttcctctgacsggtcccagtccaaccaaacccagccaacaggaagcagcctggattgtgctatcattcagtcagtcgacaaacgctgaatctatactgcacactctgcacctgattccctactggaaaccaagcttcttccagggaacggggtgggacaggaactgaggggtcatgtgccctgggctgggccggggaacagggtcaggacagccctccactgccaggcctggagtgtaccctgcacctaagcccgtggtgatgcacctgtcaccgcaaaacattctacagtgatcaggggaacttctaccg

SEQ ID NO: 38742 - DNA, 601 bp, Human
ctttggaagcctggggggccgggtgctagtcttccctttctgaagataacaccccgtcaaggaccgttcacagtgcggacagccctggcagcacttaaaaggcaccagaagcgaatgagaagcagaatcgttgatgcgtctgagcacgtgcacaaagcagacacggttctcaggactcgcattccttcacccacttcattcccacaacatccctaagagggaaatacttcaccgatgaggagaccgaggcacagagcagttatggcacgtccccgaggtcacacagtcagagatggaaccyggacttgaccccaggcaggctggctccagagcatctccagtgctccaccacgatgctggaggtctggggctctttctcagcagttcaactcagacccagactccacagcagggcctgggggccaatcagaataggccctctcacccaaggggctaggcataagacctgaacctgaagcacctctcgctcaaacaagcagctcaggaaccccaaaatgcagtgtgaataagacccaggtcatacccatgcctggctgtcccagggatgtctatggtctccaagaataagctaagaataaga

SEQ ID NO: 38743 - DNA, 601 bp, Human
gcgtggctcacgcctgtaatcccagcactttgggaggccaaggcaggtggatcacctgaggtcaggagttcgagaccagcctggccaacatggtgaaatcccatctctactaaaaaaaatacaaaaattagccgggcgtggtgtcgggcgcctgtaatcccagctactcgggaggctgaggcaggagaatcgcttgaacccaggatgtagaggttacagtgagctgagactgtgccactgcactccagcctgggcaacagagtgaaactctgtctcaaaaaaaaaaaaaaaaaaaaaaaargaagcagcagcagcagcagcagcagcagctgcacacatggggaaataagagcaatcagacccttctaattgccatttccataggaagttagggagattactgttccagcagtggctacattccggaaaacagccgcagaagaaatgagaggcttctcaagtcctgcattttctttttttttttttttgaaatatataatcaggcaatctcccaagccagaatggctcagagagactcccaagtcctacattttcaagttaaaattcaggcagtgaaactccagagcacacaactgggcca

SEQ ID NO: 38744 - DNA, 601 bp, Human
gcggcgacagagtcctgggacagcagcctgtgggccagaaaacacgctcgtctcataccctggcctcccctcggccctgaggccttcggagcttgtcaagggaacacgactaaatcccaaggcaaaccaaaaaggggaaaaatgatataaaagctgcccctcagtctaggtgactgtccagaaaagcaatgtaacagggacagtggagggcatgtgtccccattctgtccccaccctgtctatagacaccatctagaaagtcaccctcctactcccagaccactggcttctctgcctgctygggagctcgggaggcaggagcctggtggggacggagggaggtggaggcaggggtgtagacagcccctctaagggaaaaggtggcctcacactccccagaagtcagccagcctgtggccctccctgccctgccttgcagctcactggagctgtgctgtgctctccaaaagcctcctgcccttgagcttttagacttcaagtccaagtgtctgtggctggtaggcattgcgggcgtggacacctagacccagcacagacaccagcccccgtgactgcacatcccacgaggtcacgtgaggaa

SEQ ID NO: 38745 - DNA, 601 bp, Human
cggcttcaaagatactcctgcgatcatagagcctgagggtcttctcggtgctggcggcgacagagtcctgggacagcagcctgtgggccagaaaacacgctcgtctcataccctggcctcccctcggccctgaggccttcggagcttgtcaagggaacacgactaaatcccaaggcaaaccaaaaaggggaaaaatgatataaaagctgcccctcagtctaggtgactgtccagaaaagcaatgtaacagggacagtggagggcatgtgtccccattctgtccccaccctgtctatagacrccatctagaaagtcaccctcctactcccagaccactggcttctctgcctgctcgggagctcgggaggcaggagcctggtggggacggagggaggtggaggcaggggtgtagacagcccctctaagggaaaaggtggcctcacactccccagaagtcagccagcctgtggccctccctgccctgccttgcagctcactggagctgtgctgtgctctccaaaagcctcctgcccttgagcttttagacttcaagtccaagtgtctgtggctggtaggcattgcgggcgtggacacctagacc

SEQ ID NO: 38746 - DNA, 601 bp, Human
cagagacccccaggaccaggagaaatcaagccagcagatgggagaggcagggaccccctaggattaggagccaccaacgcagtggctgggacagggagtaaggatcccagagaagcaaggaggcccagggacaaccatgcccccctgcttcccggtgctgcgggctgagccatgcccggccccgccgccctcctcacccttgtagtagctgtccgtgtagctggcgttgacaagctccttcaggctgtccgtttgccgcgcgatctccaggagcagggggatggtggtgttctgtccgtcrtgcaggttgagcatggctttcagcagacaggtcttccctgtctcagggtctgaaagacataagggagggtcagggcaggccagggctggggccctccccgagcccagcgctggggccacctttgaactcgttgtctgtgaggtgcttcttgctcttctgcaggaagagcagcaggctctccagatcctggcagttattctgagcaacggcttcaaagatactcctgcgatcatagagcctgagggtcttctcggtgctggcggcgacagagtcctgggacagcagcctgtgggccagaaa

SEQ ID NO: 38747 - DNA, 601 bp, Human
gttggtcaggctggtctcgaactcctaacctcaggtgatccacccacgtcggcctcccaaaatgctgggattacaagagtgagtcaccgtgcccagcccaacagctattcttctgttccaccctaggcagtccctcctccattgcccagcaccctaccccaccccatgtcttgttgctgatactcagagctggaaattcaaaatggcacgttggccattgcagggttctgccctgtggctcccaatttctcagacttattctaacagccctacaggctggtatgacagaatcagagtcccrcacacacagatagcgacgccaggctcccgcagtgagtcaggcagtcctctcccatgccatcagccccgcaccgcaccagcctgagccgaagccccctcttaccccgatcttcccggtcccagctgccagagccagcggcgtcattcccttcttgttggtgagctcctccagcttcagcgtcgggtgcagtttggcccccaggatcagaatctcattgtacatgctcgtcacaaacttcgtgttgtcggccgtgttgtcggccacctccaccagggcgtgcagcaccgtgttgcccaccga

SEQ ID NO: 38748 - DNA, 601 bp, Human
ggccccacctaagccccaggcgagtccccacccactcctgaccaccactgagatcaaccagccggccgggcacgggtggctcatgcctgtaatcccagcactttgggaggctgaggcgggtggatcacctgaggtcaggattttgagaccagcctggccaacatggcaaaatcctgtttttactgaaaatacaaaaaaaaaattagccgggcatggtggcgtgttcctgtaatcccggctacttgggaggccgagacaggagaatcacttgaacctgataggcagaggttgcagtgagccragattgtgccactgctctccagcctgggcaacaagagcgaaacctcatctaaaaaaaaaaaacaaaacaaaacacacaaacgtcaaccagccagctgcctcagatactacctgcaccatatcaggcccacaatcccctcacggcgaggccccagctctaccatctcaccatgaaggacagcggtggtccattctcgataacctcaagccagaaagaaagaaagagaatgcaagaaatgagagccagatggggtggctcatgcctgtaatcccagctacttgggaggctgaggtgggagga

SEQ ID NO: 38749 - DNA, 601 bp, Human
gctgggaaggagtccagggcagagcctgggcctggggtcggggaggtctcccgaaatgtccacaccccttccccaccacccacaccctcgcccacgaggcctgagcctctggccgcaccaagccatccacgggcctgtagtaggcagccatggtgaagatgatcatgtacaggcagtagaccaggaagttgaagtagaagatgcgcttgacgaatctgtcccacttgtcctgcaggagtcggttcagcggctccaccaagagcatgtcgtggcgattctagggggtggggagagaagtgargttccctcctgcagcaggaactcctcgcacgcccacaccagcccgtggtgcccctcacagccatgtggcccgcacagtcctcagcccacggagcaggtgagatgggaggtctgagccagccggcagccatagcctggggctggtcccagcactgccgcggctcacggagggacctgccctcttggcctcagtgtccccagaggtgcagtgaatggggtgaaactggacaagctcttaagtgctcacttaatggcccaccgcactgcccgctgtgtctaataactccctcccgagagccca

SEQ ID NO: 38750 - DNA, 601 bp, Human
gagtaggtgggattacaggcaggctccaccacacccagttaatttggtgtttttagtagagacggggtttcaccatgttggtcaggctggtctcaaactccagacctcaggtgatctgcccacctcagcctcccaaagtgctgggattacaggcatgagccaccatgcccggcccctgcatgctttctaaccgagtacaccccgtctacaatcagggacctgagtcaccacacactcagccccacaggacctcaaggttaaaggagaggaactgagaagcgggaagggggcgggtctcctrtacagcctgaggcaggggagatgggcgcagggatacgaggttctccacgttctccatccatcgctcccgcaagctgggaaggagtccagggcagagcctgggcctggggtcggggaggtctcccgaaatgtccacaccccttccccaccacccacaccctcgcccacgaggcctgagcctctggccgcaccaagccatccacgggcctgtagtaggcagccatggtgaagatgatcatgtacaggcagtagaccaggaagttgaagtagaagatgcgcttgacgaatctgtcccacttgt

SEQ ID NO: 38751 - DNA, 601 bp, Human
cctgtcccgagcccaaattcctgcgtgatttttctttttttttttttgagacagagtttcactcttgttgaccagcctggagtgcagtggtgccatctcagctcatcacaacctctgcctccaaggtttaagcgattctcctgtctcagcctccctgagtaggtgggattacaggcaggctccaccacacccagttaatttggtgtttttagtagagacggggtttcaccatgttggtcaggctggtctcaaactccagacctcaggtgatctgcccacctcagcctcccaaagtgctggsattacaggcatgagccaccatgcccggcccctgcatgctttctaaccgagtacaccccgtctacaatcagggacctgagtcaccacacactcagccccacaggacctcaaggttaaaggagaggaactgagaagcgggaagggggcgggtctcctgtacagcctgaggcaggggagatgggcgcagggatacgaggttctccacgttctccatccatcgctcccgcaagctgggaaggagtccagggcagagcctgggcctggggtcggggaggtctcccgaaatgtccacaccccttcc

SEQ ID NO: 38752 - DNA, 601 bp, Human
tggcgtgaacccaggaggcagagcttgcagtgagctgagatcacaccactgcactccagcctggaaaacagagagagactctgtctcaaaaaaaaaaaaaaaaaaggaagtcattatgtggccttaataggtggacagaaatcgggtttcatgcaattatgaagttgagtttttaaagtaaatgtgcagccgggcacggtggctcacacctgtaatccaagcactttgggaggccgaggcaggcgatcacttgaggtcaggagttcaagactagcctggccaatacggtgaaatcccatcwctactaaaaatataaaaataagcttggcatgttggtgggcgcctgtagtcccagctattcgggaggccgaggcagaagagtcacttgaacccgggaggtggaggttgcagtgagcagagattgcgccactgcactccagcctgggtgatagagcgagactccatctcaaaaaaacaaaaattaagtaagtaagtaaacttgtaaagtgccctggaaacaaaagcagcaaattaagtgtcctgggtatcagacacgaaggactaagtccagaagtttgatgaagtcttggctcttggcaga

SEQ ID NO: 38753 - DNA, 601 bp, Human
ccagagctcctcctggctgggagcagagtgatggacagcagggtgatggagaggtggaagcactctcatggaccccacgccatacacatcccgctgccaccccagcccatggccagtctcccacgagtgtcagggactcccactgaccatggagggagagactgtgccacacacacttgtgggtgtcacccttgtgtttcagtggccatttcctggagtgggtcaccatccacatttcctaagcactagttcatcagcttgccttaccagcacatttttctcttaaaaagaagtcactggycgggtgcagtggctcacgcctgtaatcccagcactttgggaggccgaggcgggcggatcacctgaggtcgagagttcgagaccagcctgaccaacatggagaaaccccatctctactaaaaatacaaaattagccaggcgtggtagctcatggctgtaatcccagctacttgggagacagaagaatcacttgaaccccggagccagaggttgcggtgagccaaggtggcgccactgcactccagcctgggcaacagagcgagactctgtctcaaaaaacaaaaaacaaaaaacaaaaaaa

SEQ ID NO: 38754 - DNA, 601 bp, Human
gattccccaaagtggcagcctgcaggtgccaagcggagcatcttacaatgctgtgccgcctcccaagcaatgtcccggcaggcccagagctcctcctggctgggagcagagtgatggacagcagggtgatggagaggtggaagcactctcatggaccccacgccatacacatcccgctgccaccccagcccatggccagtctcccacgagtgtcagggactcccactgaccatggagggagagactgtgccacacacacttgtgggtgtcacccttgtgtttcagtggccatttcctggartgggtcaccatccacatttcctaagcactagttcatcagcttgccttaccagcacatttttctcttaaaaagaagtcactggccgggtgcagtggctcacgcctgtaatcccagcactttgggaggccgaggcgggcggatcacctgaggtcgagagttcgagaccagcctgaccaacatggagaaaccccatctctactaaaaatacaaaattagccaggcgtggtagctcatggctgtaatcccagctacttgggagacagaagaatcacttgaaccccggagccagaggttgcggtg

SEQ ID NO: 38755 - DNA, 601 bp, Human
aaggaggcccctctgtgggcctgattccccaaagtggcagcctgcaggtgccaagcggagcatcttacaatgctgtgccgcctcccaagcaatgtcccggcaggcccagagctcctcctggctgggagcagagtgatggacagcagggtgatggagaggtggaagcactctcatggaccccacgccatacacatcccgctgccaccccagcccatggccagtctcccacgagtgtcagggactcccactgaccatggagggagagactgtgccacacacacttgtgggtgtcacccttgtrtttcagtggccatttcctggagtgggtcaccatccacatttcctaagcactagttcatcagcttgccttaccagcacatttttctcttaaaaagaagtcactggccgggtgcagtggctcacgcctgtaatcccagcactttgggaggccgaggcgggcggatcacctgaggtcgagagttcgagaccagcctgaccaacatggagaaaccccatctctactaaaaatacaaaattagccaggcgtggtagctcatggctgtaatcccagctacttgggagacagaagaatcacttgaac

SEQ ID NO: 38756 - DNA, 601 bp, Human
ccatgaagccatagtccctgcccaggaggcacagcctccatcaggggaaggacacacaaagacagtgtgttattaggggagcgcccgcaaggaggcccctctgtgggcctgattccccaaagtggcagcctgcaggtgccaagcggagcatcttacaatgctgtgccgcctcccaagcaatgtcccggcaggcccagagctcctcctggctgggagcagagtgatggacagcagggtgatggagaggtggaagcactctcatggaccccacgccatacacatcccgctgccaccccagccyatggccagtctcccacgagtgtcagggactcccactgaccatggagggagagactgtgccacacacacttgtgggtgtcacccttgtgtttcagtggccatttcctggagtgggtcaccatccacatttcctaagcactagttcatcagcttgccttaccagcacatttttctcttaaaaagaagtcactggccgggtgcagtggctcacgcctgtaatcccagcactttgggaggccgaggcgggcggatcacctgaggtcgagagttcgagaccagcctgaccaacatggagaaaccc

SEQ ID NO: 38757 - DNA, 601 bp, Human
acaggatctctccagtaactcggaaatagtctccagttttttccatcttaaagggaggctgtgagatgcagagaagttggtaactccatttactcattcgttcattcaacaaacatggaccaggtccatgaagccatagtccctgcccaggaggcacagcctccatcaggggaaggacacacaaagacagtgtgttattaggggagcgcccgcaaggaggcccctctgtgggcctgattccccaaagtggcagcctgcaggtgccaagcggagcatcttacaatgctgtgccgcctcccargcaatgtcccggcaggcccagagctcctcctggctgggagcagagtgatggacagcagggtgatggagaggtggaagcactctcatggaccccacgccatacacatcccgctgccaccccagcccatggccagtctcccacgagtgtcagggactcccactgaccatggagggagagactgtgccacacacacttgtgggtgtcacccttgtgtttcagtggccatttcctggagtgggtcaccatccacatttcctaagcactagttcatcagcttgccttaccagcacatttttctct

SEQ ID NO: 38758 - DNA, 601 bp, Human
gattactcctgcattaaaaaaaaaaaatggccaaggattgcacatgtttgagtttcaggttaaaaataaaacaattccttgctggtgtggtggctcacgcctgtaatcccagcactttgggaggctgaggcaggtggatcacctgaggtcaggagttcgagaccagcctggccaacatggtgaaaccccacctctactaaaaatacaaaaaaattagccggctgtggtggcaggcgcctgtaatcccagctactcaggagaattttttgaacccaagaggcggaggttgcagtgagccgaratcgtgccactagcctccagcctagatgacaaagcgaaactccacctcaaaaaaaaaaaaaaaagattccagtatgcaaggagatttccttcactgctcagagctttaacagattggtttaattaaaaaactaccagtcatgatcctatcacttaagaggcctccactctgcccctgtaatcaaatactccgttccgtggagtggctggagtgtctactttcaagcttgcctgccttgggcctgtggagacgccctgagcaccctcccgccccgcggtgactgactgaagggctctcatc

SEQ ID NO: 38759 - DNA, 601 bp, Human
gaagccgggcatggtggctcacgcctgtcatcccagcactttgggaggccaaggcgggtggatcacctgaggtcaggagttcgagaccagcctggccaacatggtgaaatcccgtctctactaaaaatacaaaacaattagctgcgcgtggtggcgggcacctgtaatcccagctactcatgaggctgaggcaagaaaatcgcttgaacccaggaggcagaggctgcagtgagccaagatcaggccattgcactccagcctgggtgacagcgagactccatctcaaaaaaaaaaaaaaaaattacacagtggatttacaactatacccagaagtacagacaagaaggaaaatcattaaaatgttatcagttgctgtattgaattgggcaaattgttttcttctaattggagctttttcctaatttttttttaagagatcagagtctcactatgttgcccaagctggtctcaaactcctggcctcagcctcccaagtagctgggattacaagcgtgagccacctttttcttaatttttcacatgccgagcatatttttttcttaattttaagtaagcgttaaaataaaaattcttgtaacaa

SEQ ID NO: 38760 - DNA, 601 bp, Human
ctttggccatatctggaaatgttcttgattgtcaagactgggggatggggaagctccaggcgactgggggatggggagctccaggcagctgcgagtagaggccggtgatgctgctatatactctacgatgcacagggcagcccccgccccgccccgccccccaaccaccacaactaagcactacccagtccaaaatatcaacagtgccaaggtcgcacaaccccccgttaaagataggaaactccccaaaggcgggcgccatgtctgtttcatccagtattccagggccaacccctcgaayggcagatggatggacaatgagtgggaaggtgaacaaggtccgtctcactcggactgtaagtcacggcagtttctcgatccctggcccctggcacagagcaggccctcagtattcattcatcccccgagtatgtattcagtgccttccgtcattccctcagcatgttcactgaggtcccactatgtgccaggcccggcgtgagtgagacctcaagtgagaactgattgcggtcacctggggactggactgggaatgagtcaaagtgtcacttacaaaagcatctcactgtagctgtccaca

SEQ ID NO: 38761 - DNA, 601 bp, Human
tagagacggggtttcaccatgttggccagtctggtcttgaactcatgacctcaagtgatccacccgcctcagcctcccaaagtgctgggattacaggcgtgagccactgcgcccggccatccaaactgttctataactgtgctttcactcatctgcttcctcctaaagcggtggttctcaaccgggagtgattccggcaccaccccccaaaacaagtgaggggcctttggccatatctggaaatgttcttgattgtcaagactgggggatggggaagctccaggcgactgggggatggggagctccaggcagctgcgagtagaggccggtgatgctgctatatactctacgatgcacagggcagcccccgccccgccccgccccccaaccaccacaactaagcactacccagtccaaaatatcaacagtgccaaggtcgcacaaccccccgttaaagataggaaactccccaaaggcgggcgccatgtctgtttcatccagtattccagggccaacccctcgaacggcagatggatggacaatgagtgggaaggtgaacaaggtccgtctcactcggactgtaagtcacggcagtttctcg

SEQ ID NO: 38762 - DNA, 601 bp, Human
taccaaaaagatgcctgcactcctgtgtttatcaaagcactattcacaatagcaaagcatggaatcaatccaggtgcccatcaatggtagactggataatcaaaaagtggtacgtatataccatggaatactatgcagccataaaaaagaatgaaatcacgtcctttgcagcaacatggatgtagctggaggccattatcctaagcaaattaacacagaaacagaaaaccaaatcccacatgttcttacttataagtggagcaaaacactgggcacccacaagcacaaagacgggaacaayaaacacttaggattccaaaagtggggaagccgggagggggacaagggttgaaaaactacctatcaggtactatgttcactacttgggtgaccagatcattagacccccagacctcagcatcatacaatatacccacctaacaaacctgcacaagtaccctgaaatctaaattcttttaaaaaaattaaaataagtgttcctttcacaatcatgttaaataaagctaattctagttttacttgtccaaaaaaaaaaattgggttaaaggatgcggtttgtgagtcgtacggacaagctagc

SEQ ID NO: 38763 - DNA, 601 bp, Human
cggagcacaaggtcaggagttcgaggccagcctgaccaacatggtgaagccccacctctactaaaaatacaaaaaaaaatttagccaggcatggtggtgcacgcctgtaatcccagctactcaggaggctgaggcaggagaatcacctgaacccgggaggcggaggttacagtgagccaagatcatgccactgcactccagcctgggagacagagcgagactccgtctcaaataaataaataaacaaataaataaacaaataaataaataaaaagtacataaaaggatatatagtggccasgcgtgatggctcacacctgtcatcccagaactttgggaggcagatcacttgaggtcaggagttcaagaccagcctggccaacacagtgaaaccctgtctctactaaaaatatgaaaattacctgggcaaggtgcacccctctaatcccagctactggggacactgaggcaggagaatcacaatgctatgtagaaaactgcttctcttaggcaggtaaatcagtgtggtaaacctacagaccttgcctcttgagtttgcctttcggggctaaagtataggtatctcaagattagggggaaa

SEQ ID NO: 38764 - DNA, 601 bp, Human
aaaaaaaaaaaaaaaaaagttgaaaaaacaactgagccaaaatgctatgtggcagccacagcacttccagcctggaaaattcttaaagcattttatataacacgtggccaagtcctggagctcatttcagtgtgtcctctgtccaccctctcagtcacctgcagacatgcacctgcctacccagtgccttctcattcagctcctggcagagtcttcagaaggctcagccaagcaggacccctgccctcccccagcgctgaccaagctcattacctgtggaaaacccgaacaagaagacgaygtagacaaacatgaaacggcacaggtctctcaggatcatctgcaggagacagcaggctcatcagagccgaggccaggcccaggaggagctgagggaagggccgggccgcatcggcctggggatgcgtcttgagaacgtgcagggcggtttgctttgctggttctcagctcaggggtcatgagggagtcacccacccttcccccatagcctttgttctggtcgggagatggaggcctggtgtgcagggggggtcaggtttcaggggacccccctacacatacctgggtcagggccagattg

SEQ ID NO: 38765 - DNA, 601 bp, Human
tcgtgccactgcactccagccttggcgacagagtgagactccatctcaaaaaaaaaaaaaaaaaaaaaagttgaaaaaacaactgagccaaaatgctatgtggcagccacagcacttccagcctggaaaattcttaaagcattttatataacacgtggccaagtcctggagctcatttcagtgtgtcctctgtccaccctctcagtcacctgcagacatgcacctgcctacccagtgccttctcattcagctcctggcagagtcttcagaaggctcagccaagcaggacccctgccctccyccagcgctgaccaagctcattacctgtggaaaacccgaacaagaagacgatgtagacaaacatgaaacggcacaggtctctcaggatcatctgcaggagacagcaggctcatcagagccgaggccaggcccaggaggagctgagggaagggccgggccgcatcggcctggggatgcgtcttgagaacgtgcagggcggtttgctttgctggttctcagctcaggggtcatgagggagtcacccacccttcccccatagcctttgttctggtcgggagatggaggcctggtgtgcaggggg

SEQ ID NO: 38766 - DNA, 601 bp, Human
gcttcttgatattctggccaaaaatgcatgcctggctataatcgtgaggaaacatcagacacacccaaattgagaaacattgtcaaaaccactggcctctactcattacaaattctgaggtcgcaaatgacaaggaatgatgcaggaagtgccctggattaaagaagactaaggtcaggcgcggtggctcaccctgtcatcctagcactttgggagccgaggcgggcagatcacttgaggtcaggagctcaagaccaacatgacaaaaccccgtctctactaaaaatacaaaaaaaaaaaatagccaggtgtggtggcgggcatctgtaatcccagctactggggaggctgaggcacaagaatcacttgaaccctggaagtggaggttgtagtgagctgagatggcgccactgcactccagcctgggcaacagcatgagactctgtctcaaaaaataattaatggccaggcactgtggctcatgcctgtaatcccagcactttgggaggccaaggtgggtggatcacctcaggtcaggagtttgagaccagcctggccaatatggtaaaaccccatctctattaaaaatataacaactagc

SEQ ID NO: 38767 - DNA, 601 bp, Human
agctttacagtggaaaagtctggcagatccaccaaaaccaagtcatcaaagctaacgtcaccagaagtgagacggacatcatgtgactcccaataaaacacacagcagaagacacacatggcttcttgatattctggccaaaaatgcatgcctggctataatcgtgaggaaacatcagacacacccaaattgagaaacattgtcaaaaccactggcctctactcattacaaattctgaggtcgcaaatgacaaggaatgatgcaggaagtgccctggattaaagaagactaaggtcaggcrcggtggctcaccctgtcatcctagcactttgggagccgaggcgggcagatcacttgaggtcaggagctcaagaccaacatgacaaaaccccgtctctactaaaaatacaaaaaaaaaaaatagccaggtgtggtggcgggcatctgtaatcccagctactggggaggctgaggcacaagaatcacttgaaccctggaagtggaggttgtagtgagctgagatggcgccactgcactccagcctgggcaacagcatgagactctgtctcaaaaaataattaatggccaggcactgtggctc

SEQ ID NO: 38768 - DNA, 601 bp, Human
gcctgggccaggtcctggctctgccacttaccagccatgtggccttgagcacagatacctaacttcactacgcctcagtgcctcattcaaaaacagaacagtatagccaggcacagtggctcacgcctgtgatcccagcactttgggaggccaaggcaggcagatcacctgaggtcaggagttcaaaaccagcctggccaacatggtgaaaccccatctctactaaaaatacaaaaattagctgggtgtggtggtgggtgcctgcaatcccagctactagggaggttgaggcagaagaacygcttgaagccgggaggcagaggttgcagtcagccaagatcatgccaatgcactccagcctgggtgacagagtgagactccatctcagaaaaaaaaaaaaaaaaaaaaaggaacagtaatagaatccacttcacaggactgttgtgaggattaaatgagatcaggtgagacagacacttagtacagtccctatcacagagaaagtgcttcttcataagaacgaaacttattattagtagttggggatgcagatgtggcccacggggccagaaatgtagctgtcagggccctgcctcatggt

SEQ ID NO: 38769 - DNA, 601 bp, Human
gccacgagtgagactgcctgggccaggtcctggctctgccacttaccagccatgtggccttgagcacagatacctaacttcactacgcctcagtgcctcattcaaaaacagaacagtatagccaggcacagtggctcacgcctgtgatcccagcactttgggaggccaaggcaggcagatcacctgaggtcaggagttcaaaaccagcctggccaacatggtgaaaccccatctctactaaaaatacaaaaattagctgggtgtggtggtgggtgcctgcaatcccagctactagggaggytgaggcagaagaactgcttgaagccgggaggcagaggttgcagtcagccaagatcatgccaatgcactccagcctgggtgacagagtgagactccatctcagaaaaaaaaaaaaaaaaaaaaaggaacagtaatagaatccacttcacaggactgttgtgaggattaaatgagatcaggtgagacagacacttagtacagtccctatcacagagaaagtgcttcttcataagaacgaaacttattattagtagttggggatgcagatgtggcccacggggccagaaatgtagctgtcagg

SEQ ID NO: 38770 - DNA, 601 bp, Human
agctcaggacggccccaatccctacagctggcattgggagagccccctgtgctcatgaccagcccctcatggaggccctgaggcaggctctgtgtccacaggggagccccaaagctcccaagccctgattcaggtggagcttgggcattacctgaagcaccaccggtagtcgtccttgccatcaggtgtgtaccccacctgcagcagcttgcctgagcggaaggccttcctcatgcacttaaggaagctcttctccgtgtccaggatggtgatggctctctgcaggaagacaccaagggtmgaggagctgaggggcagagggtgcatcccggggccaccctggctgccagtatccagctccccaggggctctcccaggcctagatgcctccagggtggttgtccagtgccctccacgctagctttgtttctgtagcctggcgggggtacactgtatacaaggggcacagcccagccagcccagacctgtccaggtgccactggtgcctgccgggcctgggcagggcagccccgggagtgatacggaggccccagaccctgccctgaggagctcacaaggggcaacatagggtagggctgag

SEQ ID NO: 38771 - DNA, 601 bp, Human
atgaggaacccggcaaggcgtggggaacctgcaaagctccccctgcccaacatcaggccaccagccaaggaggcgccaagcaccggccctcacgcctcacctctgcttgaccgcagggagaagctcagggtgcgcttgacgccctcacagttgcccgggtcttcgttgatgatgcccacgttggtgttccaggtggtccagttcacctcgtccaccctgcagggtaaggggtcgggagagcctgagagctgtgcccagcttcccgggccaagggctctgcccacaggccaagcccaagaarcccacccatcaggatggagatgtggtgggtcggggagggcagagaggacttgatttttggacaccatcctcaaagatgtgatctctgagcacactgtgaggcccagggggacttcacatattggatgccaggctctgacgctgctcactagacggccccttctggacacctcgaattttccagaatttagtgtctgggccccaccagatgagatctaagatggtcccctgtgcacgcccacagctgagctcaggacggccccaatccctacagctggcattgggagagccccctgtgctc

SEQ ID NO: 38772 - DNA, 601 bp, Human
acagagtgagactccatctcaggaaaaaaaaaaaaaaagttctggaaatagatagtggtgagtgttgtacaataatgtaaatgtacttaatgacactaaactgtacacttcaaaaggatttaaatggcaagttttaggagatagatattttaccacaattttttacaattaaatacaaagtaattcaaaaacaaagtgttcagggttgtaattataactcaaaatttgtccactataaactatgcctctttcatttctaggtaaacgtcctcaattagacatttatttaatgttttctatkaaatgtttaccagtaactgttaaacagctttctttctggtagtaatttttctcagggtttttctatttgttcttttttttgagacagagtctcgttctgttgccccggctggagtgtagtggtgcgatctcggctcactgcaacctccgcctcccaggttcaaccgattctcctgcttcagcctcccgagtagctgggattacaggtgcctgccaccatgcctggctaatttttgtattttttttagtagagatggggtttcacgatgttggccaagctggtctcaaactcccggcctca

SEQ ID NO: 38773 - DNA, 601 bp, Human
cggcatggtggctcacacctgtcatcccagcactttgggatgacctgaggtcaggagaccaacctggccaacatggtgaaaacccgtttctactataaaaatacaaaaatgagccgggcgtggtggcaggcacctgtaatcccagctactcgggagactgaggcaggagaatcgcttgaacccgggaggcggagggtgcagtaaacccagatcacgccactgcactccagcctgggcaacagagtgagactccatctcaggaaaaaaaaaaaaaaagttctggaaatagatagtggtgagkgttgtacaataatgtaaatgtacttaatgacactaaactgtacacttcaaaaggatttaaatggcaagttttaggagatagatattttaccacaattttttacaattaaatacaaagtaattcaaaaacaaagtgttcagggttgtaattataactcaaaatttgtccactataaactatgcctctttcatttctaggtaaacgtcctcaattagacatttatttaatgttttctattaaatgtttaccagtaactgttaaacagctttctttctggtagtaatttttctcagggttttt

SEQ ID NO: 38774 - DNA, 601 bp, Human
attagccgggtatagtggcaggcgcctgtagtcccaggtactcaggaggctgaggtgggaggatcacttgaacccagaaggcggaggttgcagtgagccaagatcgtgccactgcactccagcctgggcaacacagcaagactccatctcaaaaataaaataaaataaataaaaactgcaattcccaagagaagtgaaattcacaaggggagccctgtgatctccctaactttctgcctagggacatttccccaactacaacgcggtgagctgcagtctaagaagagcatggaattgcctytgagttaaagaagaagaaatcaaaagctgggcagcggaagcagctagaatctgtggatcagagcacaggggaagaggaggaaggattcatgggggtggaagcccagaagtctttggggcagatgagttccccacaggtccttgctaagagctgagctgtgctagctcatggtgtgactgcatgagggtgatcagagagtggctcagagtatttaaagggtgttaagaaggtctctgggcctctgaggcccccagtactactcaacctttaacgtctctgtcccactttcataaagataga

SEQ ID NO: 38775 - DNA, 601 bp, Human
actgtcgcagataaacttcctcgggctgagcagactgcctatctcgagcacttgcctctcttaaaagggggaccagggcaaagttcttccagtgtctgcctgaaactgaagggtaacactattactaccttggatgcaacaaaacaaacattcacttcttggcctcccaagtctccagataaaaggaggtccaagacaggcacgatggctcatgcctgtaatcccagcactttgggaggccgaggcaggtggatcacctgaggtcaggagttcaagaccagcccggacaacatggtgaaamcccatctctactaaaaatacaaaaaaaaaaaaaaaaattggccgggcatagtggcacatgcctgtaaccccagtacttgggaggctgaggcaggagaatcacttgaacctgggaggcacaggctgcagtgagccgagatcgtgccactgcactccagcctgggcgaaaagagcaaaactccgtctcaaaaaaaaaaaaaaaaaaaaagaagaagaagaagaaagaaagaaagaaaaaacgaggcccaggcatgcgagtgcttcctgaggcacctggatcggtgcaatgtcctcctccctc

SEQ ID NO: 38776 - DNA, 601 bp, Human
ggtgggcggatcacctgaggtcaggagttcgagaccagcctggccaacatggcgaaaccccatatctattaaaaaaatacaaaaaattagccagacatggtggcacgtgcctgtaatcccagctacttgggaagccgaggcaggagaattgctggaatccaggaggcggaggttgcagggagccaaaattgtgccactgcattccagcctgggtgagaagagtgaaattctgtctcaaaaaaaagaataaaatcaaagaaaacaagggcctaacatgtcccagtagagactgaccatccamactgtttagtaaagtgagtaaaaacctgaaagtctgttaggagattcacttggggacagtgacggttggatgtacatcactccccatgcttccaagaacgcttcccacagcttgtccagcacagatttgggaacatgctgggcaggcacagaccaggccaggctgctgacagagcactggtgttccctcagcagccccccgtggcaacggggtctcctaaggcccagtgttgacagtgctgtctgcgtgacgtcctcacttctccccggaagcggcaggactcttgaagacctcagcgtc

SEQ ID NO: 38777 - DNA, 601 bp, Human
cacagaaaaaaaaaaaaagaataaaatcaaagaaaacagccaggtgtggaggctcacacctgtaatcccagcactttgggaggccgaggtgggcggatcacctgaggtcaggagttcgagaccagcctggccaacatggcgaaaccccatatctattaaaaaaatacaaaaaattagccagacatggtggcacgtgcctgtaatcccagctacttgggaagccgaggcaggagaattgctggaatccaggaggcggaggttgcagggagccaaaattgtgccactgcattccagcctgggygagaagagtgaaattctgtctcaaaaaaaagaataaaatcaaagaaaacaagggcctaacatgtcccagtagagactgaccatccaaactgtttagtaaagtgagtaaaaacctgaaagtctgttaggagattcacttggggacagtgacggttggatgtacatcactccccatgcttccaagaacgcttcccacagcttgtccagcacagatttgggaacatgctgggcaggcacagaccaggccaggctgctgacagagcactggtgttccctcagcagccccccgtggcaacggggt

SEQ ID NO: 38778 - DNA, 601 bp, Human
tttttttttgagaaggtttctcgctctgtgtcccaggctggagtacagtggcgtgatcttggctcactgcatcctctgcctttcgggttcaagcaattctcctgcctcagcatcccaggtagctgggattacaggcatacatcaccatgcccagctaatttttttgtatttttagtagagacgggtttcaccatgttagccaggctggtctctaactcctggcctcaggtgatccgcctgccccggcctcccaaagtgctgggattacaagtatgagccaccacgcccagccaaggcttcyaaattttgtgaacttacctgtggctcctctgacttagagccatttttattttattttattttattttatgtttttgagaaagggtcttttgctttgtagcccacgctgaagtgcgcttaggtgttcgcagctcattgcactctctaccacccaggctcaagtgacgcatgtaccaccaccacatctggcgtttttttcttgatagagatcgggtttcactgtgttgcccaggctggtctcaaactcctgggctcaagtaatctgcctgctttggcctcccagagtgctgggatcgtatgc

SEQ ID NO: 38779 - DNA, 601 bp, Human
tcactgcatcctctgcctttcgggttcaagcaattctcctgcctcagcatcccaggtagctgggattacaggcatacatcaccatgcccagctaatttttttgtatttttagtagagacgggtttcaccatgttagccaggctggtctctaactcctggcctcaggtgatccgcctgccccggcctcccaaagtgctgggattacaagtatgagccaccacgcccagccaaggcttctaaattttgtgaacttacctgtggctcctctgacttagagccatttttattttattttattttrttttatgtttttgagaaagggtcttttgctttgtagcccacgctgaagtgcgcttaggtgttcgcagctcattgcactctctaccacccaggctcaagtgacgcatgtaccaccaccacatctggcgtttttttcttgatagagatcgggtttcactgtgttgcccaggctggtctcaaactcctgggctcaagtaatctgcctgctttggcctcccagagtgctgggatcgtatgcgtgagccactgcacccggcccttacaagccattttaaaactggtccccaagaaggcagtggtc

SEQ ID NO: 38780 - DNA, 601 bp, Human
ccaggttcaagctattctcctgccttagcctcccaagtagctggaattacaggcacctgccaccatgcctggctaatttttgtatttttaataaagacagcgtttcaccatgttggccaggctggtcttgaactcctgacctcagttgatgctcccaccttggccttccaaagtgctgggactgcaggcctgagccaccgcacctggcctttcacaggattttagataattttactagagcataggaatgtacctaaactgttgtcaggtaaatataaaccagttttttttttttttttttaggagctcatttataaaataccaatccgcagctttttgaaagcacgtatcttgtaatttggtaccttggtaccttactctaatttagttcagctctcagtgagacatccccctttaaaaacacatcgcctgaccatgttttatattccaaatataattgtattgggtagtgtgggtgttacagaaattacctcaatttgtgggagtttgtgaaacatcaataatagttgtaaagcaggaattgtaaaacaagactgctttataatcagtgtaataatagttcttttttttttttttttag

SEQ ID NO: 38781 - DNA, 601 bp, Human
tttaaacacttctgtaattcagcattgcaagtttgtgttcttccagacttttatttttcttacactattttaatatcttaagcttattacttttttttttttttttttttttgagacagagtctcgctctgtcaccccggctgtagtgcagtggtgcaatctcagcttactgcaagttctgcctccccggttcatggcattctcctgcctcagcttccccagtagctgggaccacaggcacccgccaccacgcctggctaatttttttttttttttttttgtatttttactagagacgggkttcaccatccacaggatggtctcgatcccctgaccttgtgatccgcccgtctcggcctcccaaagtgctgggattacaggctgagccaccgcgcccagccagcttattacttttttgcagagtgtatatagatggcttagtatttggcactaaagtgattcttggggattttgtaaatctgacaggttggttttttggtttttggttttttctgagatggagtcttgctctgtcgcccagtctagagtgcagtggtgccatcttggcttgctataaactccgcctcctgggttcaagcag

SEQ ID NO: 38782 - DNA, 601 bp, Human
tgcctcagcttccccagtagctgggaccacaggcacccgccaccacgcctggctaatttttttttttttttttttgtatttttactagagacgggtttcaccatccacaggatggtctcgatcccctgaccttgtgatccgcccgtctcggcctcccaaagtgctgggattacaggctgagccaccgcgcccagccagcttattacttttttgcagagtgtatatagatggcttagtatttggcactaaagtgattcttggggattttgtaaatctgacaggttggttttttggtttttgkttttttctgagatggagtcttgctctgtcgcccagtctagagtgcagtggtgccatcttggcttgctataaactccgcctcctgggttcaagcagttctcctatgtcagccttccaagtagctggtactacagtaggcacactccaccaggcccagctgatttttgcatttgtagtagagatggggtttcaccatactggtcaggctgttctcggaattcctgacctcaggtgagccacccgccttggcctcccaaagtgttgggattacaggtgtgagccactgcgcccagccctgata

SEQ ID NO: 38783 - DNA, 601 bp, Human
aaaaaagccctttggtttcaggggagatgtgtgaaggttgacctgtctgagaaatataaaaaactggttctgagggtatgtagtatttgatttgtcatcatttaacagcttgtttttacatatttaaagccacaacattcttttaaacatttttgtatgctaaaaatacaggattattgaaacctattgaaataagttattgaaagagaacaacctttttttctggtctttaatggcagaagtttttaaacgagtcttccctaaaggacaccttcattgctcttatctgtttaagtttttmatagcgttctgctaccagaatgttttattttccacttctctgttggtatggtcatgatgaatgtctgtaggcagcttaggttctcaaataaggttacgggaattgaataagctgagttgattatagggattgtctccaattattaattcactggataattgtgtattctgcaaatgtgttaacttctgcaaaacttttgtcttttagattccaaacagaggcattgatttactgaaaaaagataaatcccggtaatttcattttgtttttcatatgtgtgagtatattcaactttacttt

SEQ ID NO: 38784 - DNA, 601 bp, Human
gtagagcgaaatgagatttttgccatcctattccatattccattggttccttttatgcaacattcaactcaaaaccaatatttacctcagtttttatttgatggcttggtcaaataacttcattaatttttctcactagagctgatcattatgtttacatttgtaaatgctaataattactgatgtttatggcatttaatgccatacgtttttctaagtttaaatttattaatttaatcctcacagtaaccatatgcatctcatactgtgatctccagtccataaatgaggaaaattgaartatggagaagttaaataatcccatactgcttataagacacagagccaaaatttaaacttgggcagtcattcttcagagcatgattgttttttttttttttttttttggagacggagtcttgctctgttgcccaggctggagtgcggtggtgtgatctcagctaactgcaacctccacctcccaggttcaagttctgctgcctcagcctcccaagtagctgggattacaggtgtccaccaccacacgaggctaattcttgtatttttagtagaaacgaggtttcgccatgttggcctggct

SEQ ID NO: 38785 - DNA, 601 bp, Human
tgcaacctccacctcccaggttcaagttctgctgcctcagcctcccaagtagctgggattacaggtgtccaccaccacacgaggctaattcttgtatttttagtagaaacgaggtttcgccatgttggcctggctggtattgaactcctgagatctcagggtgatccgcccacctcagcctcccaaagtgctggaattacaggtgtgagccaccatgcctggcccagagcttggttttttagccattacactgtttgagtatttgctctaaagagtaggtatttgcagtatactgtcttasaaaggatattgctcaacttttaccaaatcaagttttttacacattgcctagcagcattgtagtctcagaaaagataaaatatgaatattcctatctcatttaacttctgctctttgtgtgaggcagaccttccattttttagttttaaaataagctaaattatttttcaaattatcagtaattttttggaagaaaggaagaagttactattttgagccaatgaataaagacaaagacgcggccgggcacggtggctcacgcctgtaatcctagcactttgggaggccgaggtgggtggat

SEQ ID NO: 38786 - DNA, 601 bp, Human
tgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatrtggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatt

SEQ ID NO: 38787 - DNA, 601 bp, Human
caggcatgtaccaccacgcccagctaattttttgtatctctaatagagtcgaggtttgaccatgttggccaggctggtctcgaacttctgaccttgtgatgcacctgccttggcatcccaaagtgctgggattacaggcgtgcgccactgcactcggcctgctctgtgtgtttctttttcctgtagtcagattctggggtccagggtggttaggaaagaaacttgttttctttctttctttttttttttgagatggagttttgctctgttgcccaggttgaagtgcagttgtgtgatctcrgctcactgcaacctccaccctcctgggttccagaaattctcctgcctcagcctcctgagtagctcaaattacaggtgcgcaccaccacgcctggctaatttttgtatttttagtagaggcagggttttgccgtgttggccaggttggtcttgaactcctgacctcaagtgattcacccaccttggcttcccaaagtgctgggattacaggtgtgagccaccacacccagcctgaaacttggtttcttagctccgaaatagtgaaatcaagatcagagcccactaagccagccgctcttct

SEQ ID NO: 38788 - DNA, 601 bp, Human
ggagttttgctctgttgcccaggttgaagtgcagttgtgtgatctcggctcactgcaacctccaccctcctgggttccagaaattctcctgcctcagcctcctgagtagctcaaattacaggtgcgcaccaccacgcctggctaatttttgtatttttagtagaggcagggttttgccgtgttggccaggttggtcttgaactcctgacctcaagtgattcacccaccttggcttcccaaagtgctgggattacaggtgtgagccaccacacccagcctgaaacttggtttcttagctcckaaatagtgaaatcaagatcagagcccactaagccagccgctcttcttggtttttggttctcatgtcctggagtccctctcaccttgaccaaaccaaagacctcctgaagcatcacttgggctcaccacttccactgaggtggatttgagtcattgatctgggcagagccttctggagtcggggattctctcgtctcaaggcagaggtcctacagaagttagtggtcttggccaagcggacattgatgcaactgtggcaaaatgggacctataagtcagagctgatgacctactcgtggaa

SEQ ID NO: 38789 - DNA, 601 bp, Human
taggtcacagtgaggagttcaggccttccctgctgctgttgagaaggcattccatggccttaaccaaggaataacatgaagaacaggagcacaggttttcgtgacatccttggggtgttaactaggatcaaacagcagaagttcagtgctgtaacaaagtgtatcccagtgtaatgacttaaatatgtttcatcctgcgatgcctgaattgtgtgactgattgggactgctgtgaaggcgggagacttgctggtggggtgcacataggacgagcataggaccgtgtgttcctgccagcacsgctccggcctcctgttcgtggctggaccgctctagctttagtttcattttctttcctcctatactgtcagtggatgttaccttggtatgtttatgcatccttgtaagttcattaagaataaggtacagaattaaatattttgtagtttaatgtttgcgttactggggtagtgatgtgtccttgtttctatcgagtcaacacaaaatgaatgatctttcttttagattgaagatggatacgtgacaatcccagggaccgctgcactgacttcatttccttagacaagacacagtgtagggc

SEQ ID NO: 38790 - DNA, 601 bp, Human
tcgtgacatccttggggtgttaactaggatcaaacagcagaagttcagtgctgtaacaaagtgtatcccagtgtaatgacttaaatatgtttcatcctgcgatgcctgaattgtgtgactgattgggactgctgtgaaggcgggagacttgctggtggggtgcacataggacgagcataggaccgtgtgttcctgccagcaccgctccggcctcctgttcgtggctggaccgctctagctttagtttcattttctttcctcctatactgtcagtggatgttaccttggtatgtttatgcayccttgtaagttcattaagaataaggtacagaattaaatattttgtagtttaatgtttgcgttactggggtagtgatgtgtccttgtttctatcgagtcaacacaaaatgaatgatctttcttttagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggac

SEQ ID NO: 38791 - DNA, 601 bp, Human
ctggttttgtttatttatttatttattttgagacggattctggctctcgtccaggctggaggcaattttcttaattttaagtcttttaggctttctcttccttaaggaaagaaagctcagtagattttatggctcagtagatagcgtctggaagcacttaattttttcctttcttttaatactatatttatttatttatttatttatttattttttgagacggagcctcactctgtcgcccaggctggagtacaatggcatggtttcggctcactgcaacctccgcctcctgggttcaagygattctcctgcgtcagcctccctagtagctaggactacaggtgcgcaccaccacacctggctaccttttttgtctttttagtagagatggggtttcactatgttggtcaggctggtcttgaactcctgaccttgtggtccgcctgcctgggcctcccaaagtgctggaattacaaatgtgagccaccgtgcctggcctcttttaatactttagaaaaactgaagtaatatctgtgcgtacacacataccttgcttgctttttatttttgaataaggttgttgtactagtgctcagaagtg

SEQ ID NO: 38792 - DNA, 601 bp, Human
atttgtgtgtgtgtgtgtgtgtgtgtgtgtatttttagtagagacggagtttcactgtgttggccaggctggtcttgaactcctgacctcaggtgatctccccgccttggcctcccaaaatgctgggattacaggcatgagccaccgtgcacagccttaaaattgtttttacatagattcttgctatcttttatgacccatcacattgtttatgggatatttgatatgaaatttgagatcctgcaaatgttcagccattcacacaaatgggtcatgttactgcacatttcttgtctacagragactggtagcctcgagaggaaaaataagcataacaaatcactcctgccttcggggtcgaggtgggtagatgatatcagtccatcaaaagtgcactgcagtgtaaacagtacagactgttcatgcataaccaccatggacaccagccgggtgtcagatactgtgctggcacctgggaactcaaggaggaacttgtgttcctggtgtcccctgaggttggccccatctggcaccagatggggtgtgtgagcacagtgacaggaaagtgcagagaaaccatggccccagatgcggaccctct

SEQ ID NO: 38793 - DNA, 601 bp, Human
ccctgaggttggccccatctggcaccagatggggtgtgtgagcacagtgacaggaaagtgcagagaaaccatggccccagatgcggaccctctgcaggaggagcaggtgagcacctcggagttaaggcaagtgaatgagggtgagtgaggcacagtcgtcgccagtacagagcctcacagggtggccatggaagtagatggagcctatggcaggcgatactggagacatcctggtgagtgcgtggtttgggcggtggcaggaggaggttgggggccggtgtgatttgggtagaacttaccmaggaagaagggttggaaccatgaatagtttgaaagagcccctccagtgacctggctactgagttcccttggcgagcaaatgactgaatatgaagctgctggtctaagtgtgggtcattttgggaacgatgctgtgacctgggaccccatcagcatcctgtacgcagcttgcagttttccagttttctctttgtgggcgttatttccataagagtgcagacttctgggatgcaggtcagggctgtgacttccctgggtttctctggagtgagatcagtgtggagtggagaggtgtgtgctg

SEQ ID NO: 38794 - DNA, 601 bp, Human
attaactcttcacatttcatttcaatcccatgtcacttaaccatccggaactgacagccataggttcttctggtctgtgggtttctcccctgtcccattcagtttggaggctccaggcttgttttggatcctgcttcctctgctcttcttcctgagtgttcactgtgcctcagcaatgctgagtgcggtgaagcatgtggtcctggcccaccttgaggtggccccaaccacaggtgggagtgtttcatttgcacctggggttggggtgaactaagtgcttggtatgtttgtggaaagccgmactggcggtctctgaaggcgtgtgtgtgcatgagggtgccgtgatgcacatgcgagagccctgaggtcccctctgagacctgggaaggactcccgtgacagttgtatgaggcaggctgggttactccattccgctggcctttctcttctaattgtcctcacattaattttttcagtccagacttagaatagatgctctttgactcaggatggggttacatcccaataagcccaccataagttaaaaatattgtgtcagaaatgtgcagcctcccgaacatcatggtatatagcctggcct

SEQ ID NO: 38795 - DNA, 601 bp, Human
ataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagyttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacggag

SEQ ID NO: 38796 - DNA, 601 bp, Human
catggacaaaatgagacgcgacagggacaagagcattttgctctgcttccaggaaacatcaagtgagtccgctcctcagttctcaccaggaagcctgatcaggctgaggcgagttcctcgggaaggaagggcgcgcgggatgctgggtgggctcgagtagtgaggcctcagagcacccgccgggagctgtgcgggcgggggcgtccaggagagcgctgggccccgcctgtctgcgccggagagcaggtctcctggctcccccacccgagagccttccttcccgggtctctctgacgcccgyggctccccacaggcctttcccctcgcgtcctccctccctttccagcaccttcactcggcctgtttttcttcctcctcctcggcactgagctgagacgcgctgagcagtttgctctcctttttccacttcatgcgtcggttctggaaccatatcttgatctgcctctccgtcaggcacagggcgtgcgcgatctcgatgcgccgccgccgcgtcaggtagcgattgtagtgaaactccttctccagctccagcgtctggtaacgtgtgtatgtctggcggcctcgccggccgctgggccca

SEQ ID NO: 38797 - DNA, 601 bp, Human
acatggacaaaatgagacgcgacagggacaagagcattttgctctgcttccaggaaacatcaagtgagtccgctcctcagttctcaccaggaagcctgatcaggctgaggcgagttcctcgggaaggaagggcgcgcgggatgctgggtgggctcgagtagtgaggcctcagagcacccgccgggagctgtgcgggcgggggcgtccaggagagcgctgggccccgcctgtctgcgccggagagcaggtctcctggctcccccacccgagagccttccttcccgggtctctctgacgcccktggctccccacaggcctttcccctcgcgtcctccctccctttccagcaccttcactcggcctgtttttcttcctcctcctcggcactgagctgagacgcgctgagcagtttgctctcctttttccacttcatgcgtcggttctggaaccatatcttgatctgcctctccgtcaggcacagggcgtgcgcgatctcgatgcgccgccgccgcgtcaggtagcgattgtagtgaaactccttctccagctccagcgtctggtaacgtgtgtatgtctggcggcctcgccggccgctgggccc

SEQ ID NO: 38798 - DNA, 601 bp, Human
gctcggttggacctttagcctcaaactcccgtggtggaaacagttaggattggtggacgctgcacccagcatcctgcaaacagaattctgaaaactgatatctcatgcaaacaggatatcaacttttgtcagaaagatcaaaaagagcttgaggtttttcttcacagcctcagccttgcctctccccctcttgctttatctcctcatttctgtgtgcaggcgagcttcttggcctaagggcaggaagagatggcagcgggggagacgcagctctacgccaaggtctccaacaagctcaagrgccgcagcagcccctcgctcctggagcccctcctggccatgggcttcccggtgcacaccgcgtgagtactgcccagagaccccggggcccagccagtaaggctggtgccagaccctgctgcggcccccggcatggagctgcaggggtgtagggtacggcttcctgccaaagcagtgcaccttgcagggtaagacactgcctcttcacagggccctcttctgcttctcgtaaatgaggtgatcttgaccaagcttgtccaacccacatgaggcccaggacagctttgggcttaagccatca

SEQ ID NO: 38799 - DNA, 601 bp, Human
ccgagccaggggcacgttccgcagggtgggtccatttgatctaggcagtggggggggggggggcaggccagggagagggattgcaggagcgggcggaggtcaggtcctcagccctgagaccccgtgccaagggctgaagcgggtagccagggaaggacagtgagggggaggtgtgagctggtcagcattgtccaaaaccacgatggcagcactcaggggacaggcgctagaacttccagctggaagttcagcatcaggccctcttcagagcaccccccaaagatcctgggtgtgcaaggcyacaccctgcctctctgacccttttcccaagaatgggcgacgtgactttgtgtctgtgtctgctcttctgcaggctgaaagcgttggcagccacggggaggaagacggcggaggaggccttggcctggtgagtgcagctgcttctgtagacccaggggcgtttgggctgaattccctgtgcctaaggactccctcccaccagggctgataccaggaagagccgggcgcctctgggtgggatggggccactgcggaagtgaaacaaaataacctccctgcctacccatagtgcactgaggga

SEQ ID NO: 38800 - DNA, 601 bp, Human
gtggggggggggggggcaggccagggagagggattgcaggagcgggcggaggtcaggtcctcagccctgagaccccgtgccaagggctgaagcgggtagccagggaaggacagtgagggggaggtgtgagctggtcagcattgtccaaaaccacgatggcagcactcaggggacaggcgctagaacttccagctggaagttcagcatcaggccctcttcagagcaccccccaaagatcctgggtgtgcaaggccacaccctgcctctctgacccttttcccaagaatgggcgacgtgactytgtgtctgtgtctgctcttctgcaggctgaaagcgttggcagccacggggaggaagacggcggaggaggccttggcctggtgagtgcagctgcttctgtagacccaggggcgtttgggctgaattccctgtgcctaaggactccctcccaccagggctgataccaggaagagccgggcgcctctgggtgggatggggccactgcggaagtgaaacaaaataacctccctgcctacccatagtgcactgagggaggggcacagggctttggttaaccatggaaagagaaagagagaactct

SEQ ID NO: 38801 - DNA, 601 bp, Human
ccccaaagatcctgggtgtgcaaggccacaccctgcctctctgacccttttcccaagaatgggcgacgtgactttgtgtctgtgtctgctcttctgcaggctgaaagcgttggcagccacggggaggaagacggcggaggaggccttggcctggtgagtgcagctgcttctgtagacccaggggcgtttgggctgaattccctgtgcctaaggactccctcccaccagggctgataccaggaagagccgggcgcctctgggtgggatggggccactgcggaagtgaaacaaaataacctcyctgcctacccatagtgcactgagggaggggcacagggctttggttaaccatggaaagagaaagagagaactctgaacaaggctttcttcacttacaaacctgattcaatccaatttgactgccaagaagaacaggttcatgtgctttgttgagtaaatggggaagacatgattgttgtgttgtgataagcacgtaaatgagggtaattgttagaataaagtaattaggttaaaaatggtaacatttgggtttatattagtactgctaatattcagcctatttcagtaattgaagagcagg

SEQ ID NO: 38802 - DNA, 601 bp, Human
gcgcctctgggtgggatggggccactgcggaagtgaaacaaaataacctccctgcctacccatagtgcactgagggaggggcacagggctttggttaaccatggaaagagaaagagagaactctgaacaaggctttcttcacttacaaacctgattcaatccaatttgactgccaagaagaacaggttcatgtgctttgttgagtaaatggggaagacatgattgttgtgttgtgataagcacgtaaatgagggtaattgttagaataaagtaattaggttaaaaatggtaacatttgggtttatattagtactgctaatattcagcctatttcagtaattgaagagcaggctgggattttgcatacttgtgtttgattatgtcctcctcaactgcctactacgatggataagattgagatagataggaggatgtttgtgtttattgatggaaagatttgagacataattgacatctttgctgatagagactagcggccaccatgctctcgggctgcctctgaggggaagggagtttactggtggtcatgaagccaggtgtgtgggtctaagggtgccaggtgtgtgggtcgggtgagggc

SEQ ID NO: 38803 - DNA, 601 bp, Human
cctcctccagaaagtgtaggccacgggcaaaatgggcaaccccttcacagagtccactaaagccagttgccaattttggatcagaaacaagcccactgctgtgaagggcatggccagcacctgcccactgcaacccagtcaataagactaggaaccccaccaaaaaatagggaggcaatggggtcccctagactgtcaagagcaccccaacctctcactagtaaccagggaggtggtgcaaattaagatatcattagagcaaacaaggtaactccaagtgttgatgagggtgagggaagcrgggcctcacacgtcactggtgtcactgaggaaggcagtgctgggtatctgccaaccttggcaatatgcacagcccaccagcctccgtcgtgcgtctaagcagattccctggagaaatgcaaggagcctaaagagacatgtacaaagatcttgattgcagggttatgaaatggttttaaaataaaataatttagatgttcatcaatgcgggaatgaacaagtgcaacattgtatatgtatacatgaactattacacagcctttaacaaattcgcgctgacaaacttcactagacacgtgtg

SEQ ID NO: 38804 - DNA, 601 bp, Human
agttgccaattttggatcagaaacaagcccactgctgtgaagggcatggccagcacctgcccactgcaacccagtcaataagactaggaaccccaccaaaaaatagggaggcaatggggtcccctagactgtcaagagcaccccaacctctcactagtaaccagggaggtggtgcaaattaagatatcattagagcaaacaaggtaactccaagtgttgatgagggtgagggaagcagggcctcacacgtcactggtgtcactgaggaaggcagtgctgggtatctgccaaccttggcaayatgcacagcccaccagcctccgtcgtgcgtctaagcagattccctggagaaatgcaaggagcctaaagagacatgtacaaagatcttgattgcagggttatgaaatggttttaaaataaaataatttagatgttcatcaatgcgggaatgaacaagtgcaacattgtatatgtatacatgaactattacacagcctttaacaaattcgcgctgacaaacttcactagacacgtgtgtatcaacagggattaattgaaaagacatggtagaggaaaaatgccagttgtagaataatttgaa

SEQ ID NO: 38805 - DNA, 601 bp, Human
caatgcgggaatgaacaagtgcaacattgtatatgtatacatgaactattacacagcctttaacaaattcgcgctgacaaacttcactagacacgtgtgtatcaacagggattaattgaaaagacatggtagaggaaaaatgccagttgtagaataatttgaataacagcttatgatttatgtaaaacaagtgctatctataagtccgttacttaaatttctgggagaaggcaaagcagcttcaccctctgggtgaaccctggaaagggggagggtgggaaccacgatggagaggagtggyaacttcttctgtgatttttattgaagagaatatggtcttgcgtaagttctgtttcctctagtgattgaatactactttctaaattgaaaattatatcacaggcactttgctgagtaattagaaattcttccaaaccatgatttctaatgaatgcacggtaaatagatttgctatcagttatggagtttttcttctttcttctaaataaccctaaataaccttctaactttcttctaaatagccctaaatagatggttcatgtgcaaagttttgcctatacagtactttgtgctctttcct

SEQ ID NO: 38806 - DNA, 601 bp, Human
gcaaattgcttcacataaaagttgaaaggtctgtccttaagtcctgctgcatcttttacacattgagcagaacttttatcctttttattgaaaaaatctttgtgaacttgacagatgagaaaaatgccgtctcggagctattttatttccatttttattgttagtgacaatgaactcctatgttgggtcatccgtcgtttttcctttaatttaaaataactgtctgcctgaaatcccagccagtcaggaggctgaggcaggaaaattgcttgaaccggagaggtggaggttgcagtgagcygagattgtgccactgcactccagcctgggtgacagagaaagactccatctcaaaaataaaataaaataaaataaaataaaataaaataaaataaaataaaataaaataaaataaaataaaaactgtctgaatctaaagaaacgcagcagctacctaaattttgtctaggtttttggttttggtttttatatgtaatttgaagtttgaggtaaaatacaaatgtgaggtttttccacaaaattttcccacaccatcaaggagatgctgggcccacggatcattggaagaccaggttttagg

SEQ ID NO: 38807 - DNA, 601 bp, Human
aaagaaacgcagcagctacctaaattttgtctaggtttttggttttggtttttatatgtaatttgaagtttgaggtaaaatacaaatgtgaggtttttccacaaaattttcccacaccatcaaggagatgctgggcccacggatcattggaagaccaggttttaggtcttgctgtcaactttctttcattttttctacctttgactttggaatcagactaaggtgggtctgagagcaggacttacactgaccaggtctgtgccacacacagctgtgccgcagtgcctcccaccagtaggakggctgtgagattaatttatgtcatgagcatatatgatgtcttcagtgtgccctataattctgcattgctgtcattgtcattctgttgtgtatcctcaaaggggaaaactctttttgttgtgacagtgggtgatgccggcttgctctctgttgcaggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagct

SEQ ID NO: 38808 - DNA, 601 bp, Human
tgttgtgtatcctcaaaggggaaaactctttttgttgtgacagtgggtgatgccggcttgctctctgttgcaggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacggtgagtcaacccagtgtgccttcaatgctcacggcagctgraggcatttttctgtgctaactaggccatgatgggacaaagttgacttatttaaatgggatagtccagaactgcatcattagctggcaccttcatatgagctgtcctttattttcctctttgccttcatctggtcaactcctattaatccttcagaacccaactcatttatcctctcccctttttgagtcttctccagctccccaggcaaaaggagttgctgcccattttctcgttcatgtgtctagtggcacttttgtatcatacgggccatgtgtctggtgcagcaccgcatccctcac

SEQ ID NO: 38809 - DNA, 601 bp, Human
aggctgcaaagggtgaagggcctgcccaaggtcctgtggtgtgtagagcggtgtcccctaaaaatgtttgtccaccaggaacttgggaatgtgacctcacttgggaatagggcctgtgcagatgcgattggttgggaggaggtcacactgcattagggtgggttcccgtaagggtagaggccgcacagagacacagagaagccatgtgccgactgaggcagagactggagtgatgtagccacaagccaagggacgcctggggccaccggaaactggaagaagccaggaaggacccttcccrggagctttcggggagagcacagccctgccaacaccttgattttgaacctctagtctccagaaatgggaggcaatacatttctgttgtttgaaaccaatctagtcccctaaccaggctggcggagcagggacctgaacccacctctgtcctgctccatgctgcctgggttcatgctgggcagccccacttcctgtgggagccagcgttgacctcacatctacgccccgaccctaagcaggctgtgtcctgcccttccatggcccatgctctcagcctgacaccgagggggtggaggggact

SEQ ID NO: 38810 - DNA, 601 bp, Human
ccaggacttcctgcttcaccaaaacaaggtgaaccttaaagacactgtgtgttttatagttttgttgcctaaagagttttcttcttgaaactctacgattaaacaaaaagccgttgaactggagctcgggcctgcaagtccaggccactgggtaacgtgcacaccccggggaatggaggagccgtttactctgtgcatctgaatcgtgcattcgggcagctagcctgcaaaccgataggcccccgagaccctgaacccacatctccatatcgtcctctttcctacttcctggaaaaatctrcagggatccagccatctcctttatgatgtgagttctgagcgggccaaatgagctctgagttctgagagcccttgccttgtggaggaagcatggaggtcggaggaaggagacatttaggtaacggtgtcctggcaccctctgtgtttccctgatttcacagactgctccgtgaagccttgcaccaaacagctgcatctgaccttggcccacaagttctacccccaccaccagaggacgctggagcagctggccagagccatccccctgggccacagctgccagtggaccgcagcactctac

SEQ ID NO: 38811 - DNA, 601 bp, Human
ttccctgatttcacagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccaggtgagagagctgagcaggggctcataagaagcagatgaatgggctgggctcggtggctcacgcctgtaatcccagcactttgggaggccgaggcggcggatcatgaggtcaggaratggagaccatcctggctaacatggtgaaacctcgtctctactaaaaatacaaaaaattagccaggcacggcggcgggcacctgtagtcccagctactcaggaggctgaggcaggagaatggagtgaacccgggaggcggagcttgcagcgagtggaggtagcatcactgcactccagcctgggctacagagcgagacgtctcaaaaaaagaagcagatgagtgaacggccactcacctgacagcatgtaccccctggagccctccaagggagatatgttagtagcaaggaaaatttcta

SEQ ID NO: 38812 - DNA, 601 bp, Human
ctcgggaggctgaggcagaagaatcacttgaacctgggaggtggaggttgcagtgagcagagatcgtaccgttgcactccagcctgggcaacagagcgagactggcaaaaaaaaaaaaaaaaaaaaaaaagacagaaaggaaaggactattgtaaagatctatgaatacatgttttgcttattaattcttttttatttatttattttttaaatgtaggggccatgctaatcttctctgcagcattccaattttagttatatgtgctgccaaagtgagcacaattcactttaaagaatgatytgagtgaaacctcattctgggacttcctgcccatgaatcgatgggtttagaaacgaagtgtgtgatgctcctttcagacccagagagcacgtgtgaatgaatccaccatgttctgtatcgtatgaggtgtcaataacctcacaccgaggaaggcggatgtgaaagtctgcttatgccttcagatcttttgtagacaaaaaagtacctagatggatggatgatggatagatcccaaaatgtatctcttttttttttctttttttcttttttttttttttttttttttgagagggagtctca

SEQ ID NO: 38813 - DNA, 601 bp, Human
tatatgtgctgccaaagtgagcacaattcactttaaagaatgatttgagtgaaacctcattctgggacttcctgcccatgaatcgatgggtttagaaacgaagtgtgtgatgctcctttcagacccagagagcacgtgtgaatgaatccaccatgttctgtatcgtatgaggtgtcaataacctcacaccgaggaaggcggatgtgaaagtctgcttatgccttcagatcttttgtagacaaaaaagtacctagatggatggatgatggatagatcccaaaatgtatctcttttttttttctttttttcttttttttttttttttttttttgagagggagtctcaccctgtcacccagggtagaatgcagtggagtgatctgcgcccacttcaaccttcgcctcccaggttcaagtgattctcctgcctcaagcttcccaagtagctgggactacaggcacccgccaccatgtccagctaatttttgtattttcagtagagacggggtttcaccatattggccaggctggtctcaaactcctgaccttgtgatccacccacctcggccttccaaagtgctgggattacaggcgtgagccac

SEQ ID NO: 38814 - DNA, 601 bp, Human
ccatgaatcgatgggtttagaaacgaagtgtgtgatgctcctttcagacccagagagcacgtgtgaatgaatccaccatgttctgtatcgtatgaggtgtcaataacctcacaccgaggaaggcggatgtgaaagtctgcttatgccttcagatcttttgtagacaaaaaagtacctagatggatggatgatggatagatcccaaaatgtatctcttttttttttctttttttcttttttttttttttttttttttgagagggagtctcaccctgtcacccagggtagaatgcagtggagygatctgcgcccacttcaaccttcgcctcccaggttcaagtgattctcctgcctcaagcttcccaagtagctgggactacaggcacccgccaccatgtccagctaatttttgtattttcagtagagacggggtttcaccatattggccaggctggtctcaaactcctgaccttgtgatccacccacctcggccttccaaagtgctgggattacaggcgtgagccaccgcgcctggccccaaaatgtatttctaaatctatccaaagaattctatgctgcgtttcattacattctgtgctat

SEQ ID NO: 38815 - DNA, 601 bp, Human
tgcctcaagcttcccaagtagctgggactacaggcacccgccaccatgtccagctaatttttgtattttcagtagagacggggtttcaccatattggccaggctggtctcaaactcctgaccttgtgatccacccacctcggccttccaaagtgctgggattacaggcgtgagccaccgcgcctggccccaaaatgtatttctaaatctatccaaagaattctatgctgcgtttcattacattctgtgctatatattgccagacaaagctttggatggagtcttggagacacagaacacawtggaggggcagaaagcaggaggtggcaggtgataggcctcctattgctgccattttccaatgtaaatctttgctcgagacgtgaaacccctttgcctcttttctagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacac

SEQ ID NO: 38816 - DNA, 601 bp, Human
attctgtgctatatattgccagacaaagctttggatggagtcttggagacacagaacacattggaggggcagaaagcaggaggtggcaggtgataggcctcctattgctgccattttccaatgtaaatctttgctcgagacgtgaaacccctttgcctcttttctagaccctgagagccctattccagtacaaaccccagaacgtggatgagctgacgctaagtcctggtgactacatctttgtggaccccacgcagcaggacgaagccagcgagggctgggtgattgggatctcacagcrgacgggctgccggggcttcctgccggaaaactacacggatcgagccagtgagtctgacacgtgggtgaagcacaggtgagtgctgcctctggctgcagccccgtcatctctctctgagttactgtgtgagagtgcccacctgccaacagtgtgcttctagaccattccattattggtaaaattgcattctgtatgctgacaaaattattcctgcaggtatatagtaaacatcttggttcgtccctggttttctgatgataacattcaaaaaagaatgaattactctgcattagagtaatt

SEQ ID NO: 38817 - DNA, 601 bp, Human
taatttgagatggtaatccccaaattactgcaaaatactacttctttatcacacacataataaattatactcagaggtcctgagcttgggtttatttattcttctgctccgtgtatgaaatgtaaagtcctaggtcgtattattagttttctatgactgtataataaattaccactaaaacaaagtgcaattattatcttatggtatttatgggttgagagtcagagtccagcttcactgggtcctcagctcggggtctcaaggctgtaatcaaggtgcctgccagggctgggctccccastgaggcttcacaccctcgcctgagcatacacagttgttggtgggagtgatttccttgaagctgtagggctcctggtgagttgcttcttcatcagctgaagaatctcttaattttagcaccttttagcatcatctggtgaggctaaggattttcagaatcatcagatactggttcttttttgttcgatgttcttccctcaatttatctctttcctctcccgcttcactataaataacatgaagaaaccaggtgatacacttaacactttgtttggaaatagccttagctatgtgaccaaca

SEQ ID NO: 38818 - DNA, 601 bp, Human
ataaattaccactaaaacaaagtgcaattattatcttatggtatttatgggttgagagtcagagtccagcttcactgggtcctcagctcggggtctcaaggctgtaatcaaggtgcctgccagggctgggctccccactgaggcttcacaccctcgcctgagcatacacagttgttggtgggagtgatttccttgaagctgtagggctcctggtgagttgcttcttcatcagctgaagaatctcttaattttagcaccttttagcatcatctggtgaggctaaggattttcagaatcatcrgatactggttcttttttgttcgatgttcttccctcaatttatctctttcctctcccgcttcactataaataacatgaagaaaccaggtgatacacttaacactttgtttggaaatagccttagctatgtgaccaacatcatcgcttacaagtcctgctctccatggacaatttcattaaactctctggcacacatgggaaggatcctccttgctccgatttcctggaacacctgtcacattcctttctgagttctccccggaggattcacctttagcatccctatttcctctagcagtct

SEQ ID NO: 38819 - DNA, 601 bp, Human
ttgctccgatttcctggaacacctgtcacattcctttctgagttctccccggaggattcacctttagcatccctatttcctctagcagtctgttcatggtgatttgggctttctctgctgtgctactcaaaagtctcttagcctctactcgctgccaagtcccaaagttgtttccacattttaagttcagaaggtttccaacttacaatggtttggcttaggatttcataatgttacgaaagtgatatgggttcaatagaaactgtacttcaagtgcccatacaatcattctgtgctacaytttcagtacaacattcaacgaattacatgagatactcaacacttgattataaaatcggctttgtgttagattattccgccctatcataggctactgtaagtgttctgagcgtgtttaaggtaagctaggccaagctgtgatgttcagtaggttaggtgcattaaatgcattttcaatttatgatgggtttgttggaacataaccccatctgaagttgaagaacatccactgtttgttagagtagcaccccattcctgataccaaatttagtaaaagtttaaccagagatgcagaaccagt

SEQ ID NO: 38820 - DNA, 601 bp, Human
atacatagtattttatattatatacacatgtatcacacacatatatatatggaaaggtatatatgtatacacacatctatattgatttactacaatgaattgccttatggaattactggggctagctaagcaagggcagacaggcaggaagggaggagcctacttaggctgaaaacccatgggcaagctgaagcttgttgtccacatgtggcagttggaaggaccacccgggtgatgggagagcagtcacagacacagctgctattgaagtctctgagtgtgaggaaagcctaagtttttaaaaaaaaatgccttccaactgcataagtcagacctgctcagaataaccttgcttttgattaatttaagctcaactgattaggggttctagtcacatttgtaaaatctccttccagcagcacctagactagcatttgatgggatagctaggaaggctgtgtgtgatgcttaggatggctactgcctcccttccatcctccagctctcatgagaatgcctcttgtagcccaccctgatcagacatgtgctaaaaaggaagtctaggaactgtcgttcagtctggccaagttgccacaccata

SEQ ID NO: 38821 - DNA, 601 bp, Human
ctaggaaggctgtgtgtgatgcttaggatggctactgcctcccttccatcctccagctctcatgagaatgcctcttgtagcccaccctgatcagacatgtgctaaaaaggaagtctaggaactgtcgttcagtctggccaagttgccacaccataaagccattgcaaagtgttaaggtggctcttgtgagctttttcactctcttctcccaggttccagttaggagagtggagagagcaggcagaggtcagagtacacatggtgaaaaaagagaaaagctgctcagcctcatgggtgtgcmtgttggggtggagctcttgcaggtgtcaagactgatggttggaacaactgaatgatgagagtgggaggagaagggcagaaatacacagaaaaaccctatgttgtggttctgggcttcctggcaccttcagagctgtgtggctggggaagagagcctggaaaaacaccatcgtggccatccctctgtctccaggcaggaggtcttaaaaccattttatatttcactcatttgtttaattctctcctaaaatgctccacagcttctctagggttcccctcaccaccctgacaaataaataaa

SEQ ID NO: 38822 - DNA, 601 bp, Human
aaaggagatttggtgactatggctgatttctttaagtattatatttctttttgctaattattcatacactgagatttgtataacaagccagggacagtacctatgtccctgggctcccccactaaacataatagccacttgacattcaaggagagcagattccagccaaagccccacagctgtgcatacatgacattccatatcatcttctcttgaggccatttaacttcttaccctaatgaataagaacttaggaccacaaaatgcaaatgtgggatgaaaaatgcagccgtagtcacaygtctttatttattgatgtgttgactcctaatccacttaaatctattttaaggcagcttaagagatgtccaatagctttgcacactaacatcaccccctgtgcctggctctgtgccatgcatttcccttactaactgatttacttctccaataccccctggataggcacttttattgatccattttatagttgatgaaactgagacacaaagagatcaactcacttgcctgtgttcacacagcaagtgagcagaggaagccggattccagtcttatacctaatcccacgcttgggctttca

SEQ ID NO: 38823 - DNA, 601 bp, Human
tagttgatgaaactgagacacaaagagatcaactcacttgcctgtgttcacacagcaagtgagcagaggaagccggattccagtcttatacctaatcccacgcttgggctttcaactatgacctcaactgcctatagaagagatcattaaaatttaaaaataagtccataaattaaattatgacacatccatacaataaaatatttgcagctttaaaataattaaaagggagaattttatatattgatttgaaaaaatatgcaagatttattgataaatgaaaaaaataagttgcagaacratgtgtatggcatgatatacttgtgggggaaggggagagaaacacataactgtctgtaaatacatgtgcacaatatgtatttctatacatgtgtatgcctaaaggttccctggaagggagagtgtctagaaacttctaaccatggttaccggtgggtgttgggagtgggagccaggagaatggaacagaaatgggagggagtcttttcaaacacgaccatttcataatgtttaaatgtatgaagcatataaatgcattacttactcaaaacataaattaatccattttaaatttcaagaa

SEQ ID NO: 38824 - DNA, 601 bp, Human
tttgtccattgctttgaagatcagagatggcctggagagactggtgatggaggaccgtattcacaaaccacagcagcttccaatcctctgtccaggagagcagaggggagcacccctgtgggacaaacaacaggggggcttgagtgtgagggctcgggagaataagtgccatcccccagtcaagatgaggactttcccaacactgaagacagacacagcagattacttcaaaaacctcagagcaagtttacagcaaatatctcagacataagaaaggtacaattaagggctaaattgcatyctgccaacattcatatgtggaggtcctgacccctaacacctcagaatgtgaacttatttggagacagggtctttaaagaggtgactaagttcaaatgagggcattagagtgggccctgatccaatatgtctggtgtccttataagaagaaatgaggacacagacacacacagagggacagcctgtgaggaaacgaggagaagtacctgtctacaagccaaggagagaggcctcaagagagaccagcctcaatggtggcttgacctcagactcgcagcctccaggactatgagggcatctg

SEQ ID NO: 38825 - DNA, 601 bp, Human
gcaaatatctcagacataagaaaggtacaattaagggctaaattgcattctgccaacattcatatgtggaggtcctgacccctaacacctcagaatgtgaacttatttggagacagggtctttaaagaggtgactaagttcaaatgagggcattagagtgggccctgatccaatatgtctggtgtccttataagaagaaatgaggacacagacacacacagagggacagcctgtgaggaaacgaggagaagtacctgtctacaagccaaggagagaggcctcaagagagaccagcctcaayggtggcttgacctcagactcgcagcctccaggactatgagggcatctgtggctgtcgttgaagccgctcagctgtgggactttgttatggccgccccaggaaatgaacacagggacgtagtgatgcaacccccagatggcagctatgtccttttaagaaccagggagaattcaaacacatctgtttcatggtgtaagttactgtcaagaggctctcttaagtcaaagagaaaaatggaaatgtgaaaatgctaagctcttttctttctccttccgtcacccatgttcacagcataatctt

SEQ ID NO: 38826 - DNA, 601 bp, Human
aggacacagacacacacagagggacagcctgtgaggaaacgaggagaagtacctgtctacaagccaaggagagaggcctcaagagagaccagcctcaatggtggcttgacctcagactcgcagcctccaggactatgagggcatctgtggctgtcgttgaagccgctcagctgtgggactttgttatggccgccccaggaaatgaacacagggacgtagtgatgcaacccccagatggcagctatgtccttttaagaaccagggagaattcaaacacatctgtttcatggtgtaagttacygtcaagaggctctcttaagtcaaagagaaaaatggaaatgtgaaaatgctaagctcttttctttctccttccgtcacccatgttcacagcataatcttgattgtatttcatttgaaagactagcaaaatgcactccgtttctctctgtaaacctcacagatgtcatcagttgatagcaaagccctactgtctgcagagcgagccgcagggaggctgtgggtgccctcgccttgccctcaggaaggggaaaccaaccaatatttcctgtgctaatgtggggctatgaattgtgcctcactg

SEQ ID NO: 38827 - DNA, 601 bp, Human
ttgcacacgctacttcattttgtgctcatgggaacctttctgctgaggttgtcccggacattctcaagtacatacatgaccagatgctgggtctccatggcaacaacatggtctcacttctgttcaagccgtgctttccttcccctgcaggatgtacaccttcagtctagccacagacctgaactccagaaaggatggtgaagccagcagcagatgcagcggggaatttcttccacaaacggcaaggagtcttagcagcttacaggccttgcaggtaatagaacattcccttttttctttkaagtaaactaagcaaaactacactttgtattaacttcacggtggacacagcttcgtaggtgtagcttttgttccatagacacatcctccctgccctagagcgtggtcagcaagggggcctcccaggtctgagggtgccgggggtcctgccctggtctgtctgctctgggcagacagggagccaccccttcatggcagagtgccccaccttgagctcctcaaggcagctgaatcccgagttctcatcccattccctcattcatgagccaagaggtccccaagacgtcacctgccccggtgc

SEQ ID NO: 38828 - DNA, 601 bp, Human
atttttaaaaaataccttcacagtgacatctaaaataacatttgacccaatacctgggtactgtggagaagtacccaggtattgggtagggggagagcctggaatggaagtctctgctcgtagctcagcctgtgtctaaaccgtgctttcaatggctgaaaacagaacatgcatctgcctgtgaactggcccccctcacacggtcttctctatagggatttcaccccttccctacagtaagaaaagacaactggccacaggtctggtagaatcatggccccagagatgatgccctaatccygggaacttgtgcatgtgaccttattaggaaagagagtttctgcagatgggattgagtggagggtcttgaaatgaggaaatgatcctgggtcatccaggagggccctaaaccccatcacaagtgtgctgatgagagaaaagcagaggggatctgatacagcagcagaggaggccatgcagccagagaggcagagactggagcaatgtggccacaagccaaggaacacctggggccaccaggagctggaagaagcaaagaataaattctcccctagaatgtcagagggagcatggccctgcc

SEQ ID NO: 38829 - DNA, 601 bp, Human
acagtgacatctaaaataacatttgacccaatacctgggtactgtggagaagtacccaggtattgggtagggggagagcctggaatggaagtctctgctcgtagctcagcctgtgtctaaaccgtgctttcaatggctgaaaacagaacatgcatctgcctgtgaactggcccccctcacacggtcttctctatagggatttcaccccttccctacagtaagaaaagacaactggccacaggtctggtagaatcatggccccagagatgatgccctaatcccgggaacttgtgcatgtgascttattaggaaagagagtttctgcagatgggattgagtggagggtcttgaaatgaggaaatgatcctgggtcatccaggagggccctaaaccccatcacaagtgtgctgatgagagaaaagcagaggggatctgatacagcagcagaggaggccatgcagccagagaggcagagactggagcaatgtggccacaagccaaggaacacctggggccaccaggagctggaagaagcaaagaataaattctcccctagaatgtcagagggagcatggccctgccaacaccttgactttggact

SEQ ID NO: 38830 - DNA, 601 bp, Human
ccaggtattgggtagggggagagcctggaatggaagtctctgctcgtagctcagcctgtgtctaaaccgtgctttcaatggctgaaaacagaacatgcatctgcctgtgaactggcccccctcacacggtcttctctatagggatttcaccccttccctacagtaagaaaagacaactggccacaggtctggtagaatcatggccccagagatgatgccctaatcccgggaacttgtgcatgtgaccttattaggaaagagagtttctgcagatgggattgagtggagggtcttgaaatgrggaaatgatcctgggtcatccaggagggccctaaaccccatcacaagtgtgctgatgagagaaaagcagaggggatctgatacagcagcagaggaggccatgcagccagagaggcagagactggagcaatgtggccacaagccaaggaacacctggggccaccaggagctggaagaagcaaagaataaattctcccctagaatgtcagagggagcatggccctgccaacaccttgactttggacttccagcctccagagctgtgagagaataaatgtctcttgcttggcaccgcccagcc

SEQ ID NO: 38831 - DNA, 601 bp, Human
gtcccttcctccctgagggtgtttggatgttaaagccatttgcattttcctctctaggatttggagggaatcagggcgatgctggggctggtgtatgagggtttatgcagacaaggcttacctctcctcacctctcttccttaccctgctcagtaggaaaacacacacaagagctgccctctcattttagcccagagagagctgtgtggccaagagggagcagggcagggatagtgcctgtctgagctgcctcctgcccaggggtcctccctaccccgtccatccctggtcgcctgggctscaggcaggatttggtccccagaaggccccacagcccacctcccgtggcaggccgtgttcgctctgcccccaccatctctgttaatgactcatctttccatgttcatcccttggcccagggagacctgcagctccctaaagcagggatgctgtggactgcagcttcatggaccagcatgtgacatgctcccccctgcggtgccatgtcacagggaggttgaggcatgagtcctgggtgccagagggcagcaccactgggcctgtgttgctgcagggttccccacctcttgctctgaaatgg

SEQ ID NO: 38832 - DNA, 601 bp, Human
gtagaaaaacggatgtgtcatgataggggccaatcctgtctcttttcattttcttgatgttagaatgcccagaaaataaaacattggaagaaattgaagagattgtcaatttcatgtcctctttcattctaatgatttgggcaaaatgggctgagctattgactaacgaaggaaaagattccctcgcagttgctgggtgactgggagagctgccattggtgcaagtccagtgagttggatgttaaactgcatgtgccttgcttcctgccccaccccccaggctaccgttgcaaggaagagygtgctggtggttcgccacggggagagagtggatcagatcttcgggaaggcatggctgcagcaatgctccactcctgatggtaggtcacactcaggcgggtctacggacagaaacactgtagatctaaccaatgagatctccttcttaatgaccttacatggcaccagatcccctgaggcaccattctgtagaatgaccatgtgtagactgtatgtgtggaaaacgtgcctgctacatcttcctccaggggtgttccatgtatgcatttgagtgtctgtgttggaacctctccaacctaat

SEQ ID NO: 38833 - DNA, 601 bp, Human
ctgtgtgaggataatcagtcatcctgacgtggtgacatgagaccagtgccccgactcgttgaccactccctcttgagtcagactctgggctatgggtgttacctcactgacacctcgcaatcgctactctttccctgttttttactgataagagagatgaagtcatttatttctggctgcacagtgaggagatggtgatgccaggatttgctaccagactgtcagatcttagaactcaaggtcaaactccacgtgaaccctggcaccgggcagcctctggtgggagacagtcccagtgagcccacttccagcctggcttcaagcaattgactaaagaatgcacaacacaggcatctccagctcaagcactctgtcccctgagcaagaaggatacgtttaaagctagggggatggatcattgatgccaacttcagattcttaccgagttacactaaactagtcatagagacactttatcaggttcttcatcaggaaaatgtaagagtgaatcttcatggggcattttgggaggacaaagagggttgcatagttcctggggctgaaacctaagttgtctgcatttgagaaaatgttgtgtgca

SEQ ID NO: 38834 - DNA, 601 bp, Human
tgtgtgaggataatcagtcatcctgacgtggtgacatgagaccagtgccccgactcgttgaccactccctcttgagtcagactctgggctatgggtgttacctcactgacacctcgcaatcgctactctttccctgttttttactgataagagagatgaagtcatttatttctggctgcacagtgaggagatggtgatgccaggatttgctaccagactgtcagatcttagaactcaaggtcaaactccacgtgaaccctggcaccgggcagcctctggtgggagacagtcccagtgagcacacttccagcctggcttcaagcaattgactaaagaatgcacaacacaggcatctccagctcaagcactctgtcccctgagcaagaaggatacgtttaaagctagggggatggatcattgatgccaacttcagattcttaccgagttacactaaactagtcatagagacactttatcaggttcttcatcaggaaaatgtaagagtgaatcttcatggggcattttgggaggacaaagagggttgcatagttcctggggctgaaacctaagttgtctgcatttgagaaaatgttgtgtgcac

SEQ ID NO: 38835 - DNA, 601 bp, Human
tgtgaggataatcagtcatcctgacgtggtgacatgagaccagtgccccgactcgttgaccactccctcttgagtcagactctgggctatgggtgttacctcactgacacctcgcaatcgctactctttccctgttttttactgataagagagatgaagtcatttatttctggctgcacagtgaggagatggtgatgccaggatttgctaccagactgtcagatcttagaactcaaggtcaaactccacgtgaaccctggcaccgggcagcctctggtgggagacagtcccagtgagcccgcttccagcctggcttcaagcaattgactaaagaatgcacaacacaggcatctccagctcaagcactctgtcccctgagcaagaaggatacgtttaaagctagggggatggatcattgatgccaacttcagattcttaccgagttacactaaactagtcatagagacactttatcaggttcttcatcaggaaaatgtaagagtgaatcttcatggggcattttgggaggacaaagagggttgcatagttcctggggctgaaacctaagttgtctgcatttgagaaaatgttgtgtgcacag

SEQ ID NO: 38836 - DNA, 601 bp, Human
agcactttcttctcaaattgaagccacgttgcagagaatgttcagaaacaacacagttgacaataatttcaataataacattgctgttagagtgggtcttggtcttgggagttttgtggaacaaatctgtactaacttgatgaaactgaacgtctgatgcttatttatacttcagggaaatactacaggccagacctgaatttcccctgcagtctgccaagacggagtcgtgggatcaaagactttgaaaacgatcccccattatcatcgtgtggcattttccagtccagaattgcaggtmtgtttgaggactgtctagtaggaaaggtaacaataacagcaacactgattatggctagcaggcatccagcctgagccctagctacacaccctttgatacagtgttagctttgtctccagtctgctgaggaggctggggcacagagaggttaagcaacttgcccaaggtcacacagcaagaaagtggcaatgtagaggtttgatctaggaatggatgattcaggaagttggcaggaatgaaagaaaggcatggaaagaacaagagaggggaggaaaaatcaacaaccaaggagctccaagg

SEQ ID NO: 38837 - DNA, 601 bp, Human
gtgttagctttgtctccagtctgctgaggaggctggggcacagagaggttaagcaacttgcccaaggtcacacagcaagaaagtggcaatgtagaggtttgatctaggaatggatgattcaggaagttggcaggaatgaaagaaaggcatggaaagaacaagagaggggaggaaaaatcaacaaccaaggagctccaaggagctcacttttcaaatggaaaaccacatcctctcattcgttggttttatttcaaaatctgtcactttgggcttttgtttcatgtctggcggttctgcttcyacgtgactgagtttatgtaaacagaagagaccattgagttcatcgagtcttcatttcctaaattcagaaaatggaatccagagaagcaagttacaccaatggttaactgcagagacccccacggcccactcgcccagggccccactcagaggtgtgctcagaaatgtttacccacctgctccaggcagggtgggaagtccgagttatagagttatagagttagttatagagttatagagtcatggagttatagagttagttatagagttagaatcatagagttatagagtcatagagtta

SEQ ID NO: 38838 - DNA, 601 bp, Human
ttatagagttatagagttagttatagagttatagagtcatagatttatagagttatagagttagttatagagttatagagtcatagagttgtagagttatagagttatagagttatggagccatagagttatagagtcatagagttatagagttagttatagagttatagagtcatagaattatagagttagttatagagttatagagtcatagagttatagagttatagagtcataaaattatagagttagagttacagagtcatagatttatagagttaattatagagttagagtcatagagttatagagttatagagtcatagtgttacagagttatagagttaattatagagttatagagctatagagtcatagagttatagagttagttatagagttatagagctatagagtcatagagttatagaattagagttatagagttataaagtcatagagtcatagagttatagagttagttatagagctatagagttagagtcatagagttatagcacttgctgagtgcagtggtgagaatactgcactccccgacaactgattccagactcccagtgtgagctcccaggacactgag

SEQ ID NO: 38839 - DNA, 601 bp, Human
agttatagagttatagagctatagagtcatagagttatagaattagagttatagagttataaagtcatagagtcatagagttatagagttagttatagagctatagagttagagtcatagagttatagcacttgctgagtgcagtggtgagaatactgcactccccgacaactgattccagactcccagtgtgagctcccaggacactgagtcgggaggagatggtggtcccaggcctctgtccctggcttgcaggtgacattttctgtcttcctcttctcttctctgcatgtctctgtgyacagatttccccttttagaagggcactgtcacactggattagagcccaccctaatttaattgattgaggtgcatacccttattttaacttatcactctgtaaaaatcctgtttccaaatgagtcacattctaaggcaccaagggtgaggactctaacatgtttttcaagggaggggatacagttcaacccagaagagcctccactgaaacctcgctcatcagctttcaggctgtgcaatttttgtgctgtagggactcccatatttccctgagagcagggcttccagtatcacaggggga

SEQ ID NO: 38840 - DNA, 601 bp, Human
actctaacatgtttttcaagggaggggatacagttcaacccagaagagcctccactgaaacctcgctcatcagctttcaggctgtgcaatttttgtgctgtagggactcccatatttccctgagagcagggcttccagtatcacagggggaaaggcagagtacaggcttttccttccacgagcttcagtgggtcttgagttttctcaaacgaccacaaatgtgaagccccgcccatttctgagctcacagtggtgcagatccaaagcccaggcccacgaggctgcttctctgctgaaggtyttaaagcctgaagtcaaggtctctgctgggctgagttttcattgggagctcaagtctccttccagactcattctgctgttggccaaattcagatccttgcagtgggaggactgaggtctgttccttgctggctgttagctgggggctgctcccagccctagtagaggctgcccacattccttgccatgtggtcccctccatctttgcagccagcaatggagaatgttttgctgaatccttctcacttcacacttctctgacttttttccatgactggctggagataatcactgcttttaa

SEQ ID NO: 38841 - DNA, 601 bp, Human
tttgggagggacgagggtggcaagatcagaaatgtgaaggggcagggtctccgagtatctggggacccttcagtgtgagggtggctcttaataactatgatggaataaagcaaaattgatatatagcaatttcatccctggttgtttaggatcaatgtatttataattaaccaaacacctataatcataagatgtgaaccaagcaagaaatgcacacaaatatatgacaagaggggaacaggcctgtgcctcagtttcccctcttctcccctgtcgctggtctttgcaccccaccactcartgagcgcattttgttggaaaccacctaagatgctgctgttcttccactaagtttcagaatcactttggtttctgccactggctggccgcccactagcaggccgtgcgagagtccccaggtcgcctgtgcctgccaggccagcaacaacagtctcctctcactggggcttttactgcctcagcctgcaagtttcccttctagtgaaaaccttcgtctttctttccctacccaacctctctcaccacgataacaacaacgaataaaaaaggaatctcttggccagcctttgtaataaaagaa

SEQ ID NO: 38842 - DNA, 601 bp, Human
aattcagaaaaacaaggacacccagtcttctttacaaggcctcagacatgatcaacctgcttatcagatggtgtctgagatgctaaggtgctcaactttgtttaaattcaatgtcagagaatgtccacatgaaccatttcacagccaagtccacaaaacactggcctgcaagaggtcttcaaaggaaagagacccatggccacacctgtctgggaagctctcacactgttccttcatcttatttgttcacaatggaaatgagctcttcacaggcttgggggagatttcgggggcctggttwatcagggaggacttgggggcccagttgatgggggaggactcggggacctggttgatggaggaggacttgggggcctggttgatgaaggaggactcgggggcctggttgatgggggaggactcaggggcctggttgatggaggaggactcgggggcctggttggatgggggaggactcgggagcctggttgatgggggaggactcgggggcctggttgatgggggaggacttggaggtctggttgatgaaggaggacttgggggcctggttgattggggagaacttgggggcctgattaac

SEQ ID NO: 38843 - DNA, 601 bp, Human
catgatcaacctgcttatcagatggtgtctgagatgctaaggtgctcaactttgtttaaattcaatgtcagagaatgtccacatgaaccatttcacagccaagtccacaaaacactggcctgcaagaggtcttcaaaggaaagagacccatggccacacctgtctgggaagctctcacactgttccttcatcttatttgttcacaatggaaatgagctcttcacaggcttgggggagatttcgggggcctggtttatcagggaggacttgggggcccagttgatgggggaggactcggggrcctggttgatggaggaggacttgggggcctggttgatgaaggaggactcgggggcctggttgatgggggaggactcaggggcctggttgatggaggaggactcgggggcctggttggatgggggaggactcgggagcctggttgatgggggaggactcgggggcctggttgatgggggaggacttggaggtctggttgatgaaggaggacttgggggcctggttgattggggagaacttgggggcctgattaacttgctttaactctcttttctaagcatgcttgatgaaagagctcctt

SEQ ID NO: 38844 - DNA, 601 bp, Human
cagtgaaaacattcaggtctttttttccactcaaaaagagatggccttactttatggctcttcctttaatcaaaatataaaatgcttgggaaatgtgagttgcagggagtcagaatattccagaagatggctccttccattcttcacctcttgccccgtctgtgtaagtgtttatcaggaaagtgcctcatgaggccaacattcttcatgatgggtcacatcttgtccattgatcattggatctgccatgttggaggatgcagccggtgggctggtttcacggtggagctgtgctgggtgmtcaggtgagccccagcctaagcctgctgcctgggacactcaccagctcctggaagactctggcccttcctggcacacagggggccatcactcctctgataccttcccactgctcgtcagttttgacttcagaaatagcacagctatgcctaatcacagaacggtatttgccaagaagaaaatcacactgtttaaaaggcatgatttagacgtgtgtgtgacggtctgagatctaaaaggagacttatttatgcaaagtcagggtggatgttgaggatgataaacacttgtattctgttga

SEQ ID NO: 38845 - DNA, 601 bp, Human
tgggtcacatcttgtccattgatcattggatctgccatgttggaggatgcagccggtgggctggtttcacggtggagctgtgctgggtgatcaggtgagccccagcctaagcctgctgcctgggacactcaccagctcctggaagactctggcccttcctggcacacagggggccatcactcctctgataccttcccactgctcgtcagttttgacttcagaaatagcacagctatgcctaatcacagaacggtatttgccaagaagaaaatcacactgtttaaaaggcatgatttagacrtgtgtgtgacggtctgagatctaaaaggagacttatttatgcaaagtcagggtggatgttgaggatgataaacacttgtattctgttgaatccagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggtatgctgttctaaagttctctgccactggggcttttccagttattgttaaagaaaaatt

SEQ ID NO: 38846 - DNA, 601 bp, Human
agtaagaatgtgtgctggagattgactgtcagtgctttgccagttttcagcacaaaactggagcctgcctgttgaccatgagcctgccttgaggcagagccatcctggaagaacgttctccttccccagctaactgcagctgagccttcctaatccctacgaaagtgccagggcagcagcctctccttctcatccttccaggcccgcgtttcccctgtccgccctcatgccggccgagagctaccaggagtacatggacaggtgcacggcgagcatggtgcaaatcgtcaacacctgtccrcaggacagtaagtgcctcaccatcctcagtatgaacagcccctggggcttggggaattatctctgagatggaaattggccaattttctgaacctatgaatgcccctacttctcctgcctgcccccgcccccattctccagcaacaaagttttcatcactgctgctgctgctgcagtaaccgggtgcacagacacacactcccctgccgcccaggccctgggaccccccatcctgggactgagtgctgatgggaggggaatgatctctgagatggaaattggccgattttctgaacctatg

SEQ ID NO: 38847 - DNA, 601 bp, Human
ctgcccccgcccccattctccagcaacaaagttttcatcactgctgctgctgctgcagtaaccgggtgcacagacacacactcccctgccgcccaggccctgggaccccccatcctgggactgagtgctgatgggaggggaatgatctctgagatggaaattggccgattttctgaacctatgaatgcccccacttcccctgcccgccccccaccattctccagcaacaaagttttcatcactgctgctgctggtgcagtaaccgggtgcacagacacacactcccctgccgcccaggccytggaaccccccatcctgggactgaatgctgatgggacccaggccagcagggtcagcacaatccacccatgtccaagggatttgagtcagcttcctgggaaacaaaagagacagagagagaaagaacaaccaacttccaggtggcgcccccttccctgacccatcacacgggtctcctaaccctcccgtgttgctttgtcctggatgaagcatgcacagaagcgctgacttcccacgccttcccctgagctggcagggacaagcgtgtctcctgagggagacccactcggcctgtggtctc

SEQ ID NO: 38848 - DNA, 601 bp, Human
cagtaaccgggtgcacagacacacactcccctgccgcccaggccctgggaccccccatcctgggactgagtgctgatgggaggggaatgatctctgagatggaaattggccgattttctgaacctatgaatgcccccacttcccctgcccgccccccaccattctccagcaacaaagttttcatcactgctgctgctggtgcagtaaccgggtgcacagacacacactcccctgccgcccaggccttggaaccccccatcctgggactgaatgctgatgggacccaggccagcagggtcagcacaatccacccatgtccaagggatttgagtcagcttcctgggaaacaaaagagacagagagagaaagaacaaccaacttccaggtggcgcccccttccctgacccatcacacgggtctcctaaccctcccgtgttgctttgtcctggatgaagcatgcacagaagcgctgacttcccacgccttcccctgagctggcagggacaagcgtgtctcctgagggagacccactcggcctgtggtctccaggtgttcttatctaaagcaggagtcgtagcaggctcgtgtgacaaaataaccg

SEQ ID NO: 38849 - DNA, 601 bp, Human
cccactcggcctgtggtctccaggtgttcttatctaaagcaggagtcgtagcaggctcgtgtgacaaaataaccggctgacctttctaaagtgaatcaggtctggcttgggcgtcagccaccgctacatcccagtctgtggctgacggggcccaggcagccagcgaccacagggggtggctcagctcacttcctaggcctccctgaggctggtgggcagctgctgcgtgcagaggaatccatgagcgagggtgggacgcaggcatcactgagcggttaccagccacactacttctagcccrggggtctcgccaggcttcggggcactctgagatagctctgccccccaccactttggggaccccagtctaataaaaggtgctctctggggctgctttgacctggaggtgttcttgttttccacagcgggtgtcatcctaattgtgagtcacggctccactctggactcctgcacgcggccactgctcgggctgccgccccgggaatgtggggattttgcccaactcgtgagaaaggtacgcgcccactcttggctctttgggccacaaaatcaagcatcccgaagacacaggtttatctca

SEQ ID NO: 38850 - DNA, 601 bp, Human
taaagtgaatcaggtctggcttgggcgtcagccaccgctacatcccagtctgtggctgacggggcccaggcagccagcgaccacagggggtggctcagctcacttcctaggcctccctgaggctggtgggcagctgctgcgtgcagaggaatccatgagcgagggtgggacgcaggcatcactgagcggttaccagccacactacttctagcccaggggtctcgccaggcttcggggcactctgagatagctctgccccccaccactttggggaccccagtctaataaaaggtgctctctkgggctgctttgacctggaggtgttcttgttttccacagcgggtgtcatcctaattgtgagtcacggctccactctggactcctgcacgcggccactgctcgggctgccgccccgggaatgtggggattttgcccaactcgtgagaaaggtacgcgcccactcttggctctttgggccacaaaatcaagcatcccgaagacacaggtttatctcatccacttctcggaatgaaaacaagtgtccggctgacccagggccaccaggatccacgtgcccccggagactgtgcccaccggctct

SEQ ID NO: 38851 - DNA, 601 bp, Human
atgccatgaccccttgcagctctcgtagaaaaacagacggtccaggaaggagtaagcagtttagatgaggagggaagaaacgactgtgggactcgattctggcctcttctggggacctggggcagggcggctgatggatgaaaaggagccccttgatcctcttgcccttggagtcacccagcatggaagaagcttgagctggttgtagctgccagagtgctcaggctctggcaagggccttgtgaatgacaaacagaggataacgcacacgtgacatcttggacaaccttgattatcactyagcaaagccagagggtgatgtccagtccatgggtgaattgaggcaggcaaactcaggagtgcagatcccaccccagtcccagcccttccctgcagatctactcaaggctggactcaccacagtcctgacctttttatgaaattcatcagtccactggtcagtgcccaggcagcacgtgcagcatagacaatgcctgtcatcggaggtgcttgaggccctgacctggtttcttcacatagcactgccacaggaccacactggccacagcttgtttgccataagttgtgggcagcagtgggg

SEQ ID NO: 38852 - DNA, 601 bp, Human
cagctctcgtagaaaaacagacggtccaggaaggagtaagcagtttagatgaggagggaagaaacgactgtgggactcgattctggcctcttctggggacctggggcagggcggctgatggatgaaaaggagccccttgatcctcttgcccttggagtcacccagcatggaagaagcttgagctggttgtagctgccagagtgctcaggctctggcaagggccttgtgaatgacaaacagaggataacgcacacgtgacatcttggacaaccttgattatcactcagcaaagccagagggygatgtccagtccatgggtgaattgaggcaggcaaactcaggagtgcagatcccaccccagtcccagcccttccctgcagatctactcaaggctggactcaccacagtcctgacctttttatgaaattcatcagtccactggtcagtgcccaggcagcacgtgcagcatagacaatgcctgtcatcggaggtgcttgaggccctgacctggtttcttcacatagcactgccacaggaccacactggccacagcttgtttgccataagttgtgggcagcagtgggggttgctgagtcccccc

SEQ ID NO: 38853 - DNA, 601 bp, Human
cccagcccttccctgcagatctactcaaggctggactcaccacagtcctgacctttttatgaaattcatcagtccactggtcagtgcccaggcagcacgtgcagcatagacaatgcctgtcatcggaggtgcttgaggccctgacctggtttcttcacatagcactgccacaggaccacactggccacagcttgtttgccataagttgtgggcagcagtgggggttgctgagtccccccaagaggtcaggggcttcagaggagcccaactcccgggcccagcccagtgacaccagccaggwgcctgcaggagggcttagctctctagctacgcctgcctcagcagccagatgagaggttacgcacatgaagagcatgcctgccgtgggtcattgtcactcagcaattaggcatcagacacccgaatctccctttcttgctccattttcctctgcacctgagtagaaacatgcttcccctgcaaaatgtctccagggtggtgtgtcccaattatgatccagacatttccgagcgccctggattcttgagccaccaggtgagcattgtccaaatagggcagctcaacccccctgggccacact

SEQ ID NO: 38854 - DNA, 601 bp, Human
cagggtggtgtgtcccaattatgatccagacatttccgagcgccctggattcttgagccaccaggtgagcattgtccaaatagggcagctcaacccccctgggccacactggtagaggtctgcatggattttcctggggactgtccggggcagccccggcaccacctgctcccaaaatgttgctcttgcttctgcaaatgggtctcccacacatgcgctctgatgcattcctcctgtccctgccccgcttcccacagtcccatatacacataccaagcctccagccccaggcgctcctggsgatccacgtaaccaagggtggcagcactgcacacaccagctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctc

SEQ ID NO: 38855 - DNA, 601 bp, Human
gggtggtgtgtcccaattatgatccagacatttccgagcgccctggattcttgagccaccaggtgagcattgtccaaatagggcagctcaacccccctgggccacactggtagaggtctgcatggattttcctggggactgtccggggcagccccggcaccacctgctcccaaaatgttgctcttgcttctgcaaatgggtctcccacacatgcgctctgatgcattcctcctgtccctgccccgcttcccacagtcccatatacacataccaagcctccagccccaggcgctcctggggrtccacgtaaccaagggtggcagcactgcacacaccagctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctccc

SEQ ID NO: 38856 - DNA, 601 bp, Human
ggtggtgtgtcccaattatgatccagacatttccgagcgccctggattcttgagccaccaggtgagcattgtccaaatagggcagctcaacccccctgggccacactggtagaggtctgcatggattttcctggggactgtccggggcagccccggcaccacctgctcccaaaatgttgctcttgcttctgcaaatgggtctcccacacatgcgctctgatgcattcctcctgtccctgccccgcttcccacagtcccatatacacataccaagcctccagccccaggcgctcctggggayccacgtaaccaagggtggcagcactgcacacaccagctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctcccc

SEQ ID NO: 38857 - DNA, 601 bp, Human
gctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctccccgaccagcccatcaccgcccctcgcccacagcctctrcaagcgtgaggaaagaatcaccctagggtcaacaccagcctcactcagacccccctgccagttggcatttttgtaaatttcatctgcctgaggaatttctagacattagaaagaggaaggaaagaaagaaaagaaaagacaaaaacaaaaaaggcttcaccacaaagctctgttctcacacatccatttcacagatgaagggatggaggtctaaaggttcactttgtgcttttcttttgggtctgaaaactcaatgtctgtgtctttttgtgatgctgaatatgagaatatgagtcactc

SEQ ID NO: 38858 - DNA, 601 bp, Human
gtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctccccgaccagcccatcaccgcccctcgcccacagcctctacaagcgtgaggaaagaatcaccctagggtcaayaccagcctcactcagacccccctgccagttggcatttttgtaaatttcatctgcctgaggaatttctagacattagaaagaggaaggaaagaaagaaaagaaaagacaaaaacaaaaaaggcttcaccacaaagctctgttctcacacatccatttcacagatgaagggatggaggtctaaaggttcactttgtgcttttcttttgggtctgaaaactcaatgtctgtgtctttttgtgatgctgaatatgagaatatgagtcactccttaagtggtggatggcaatctccacctcagcc

SEQ ID NO: 38859 - DNA, 601 bp, Human
aatttcatctgcctgaggaatttctagacattagaaagaggaaggaaagaaagaaaagaaaagacaaaaacaaaaaaggcttcaccacaaagctctgttctcacacatccatttcacagatgaagggatggaggtctaaaggttcactttgtgcttttcttttgggtctgaaaactcaatgtctgtgtctttttgtgatgctgaatatgagaatatgagtcactccttaagtggtggatggcaatctccacctcagcctgcagacctttgtggtgggggctgttctactcattgtaggatrtaccaccttgtaggacctctacctgctaggtgtcggcagcacctccatcctcagttgtgacaatcagaaatgtctccggaattacccagtgtcccctggctaggggacatcccccacggggcaccgccagggcagatgttggtgccattcaatggtggcagtgccagcctgggcagtcgcagaccctccaaagtagaggtgtgcctgacagttggctttggagctagtctgaaattgatggacttgctataagatattaacaagtgatttaaaactctgttccagatcccttccctgggc

SEQ ID NO: 38860 - DNA, 601 bp, Human
atgtctgtgtctttttgtgatgctgaatatgagaatatgagtcactccttaagtggtggatggcaatctccacctcagcctgcagacctttgtggtgggggctgttctactcattgtaggatgtaccaccttgtaggacctctacctgctaggtgtcggcagcacctccatcctcagttgtgacaatcagaaatgtctccggaattacccagtgtcccctggctaggggacatcccccacggggcaccgccagggcagatgttggtgccattcaatggtggcagtgccagcctgggcagtygcagaccctccaaagtagaggtgtgcctgacagttggctttggagctagtctgaaattgatggacttgctataagatattaacaagtgatttaaaactctgttccagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcag

SEQ ID NO: 38861 - DNA, 601 bp, Human
tggttctacactcagggttcattcatgtagatgcaaatacagatggtatcataacttccaacctctctgttcctcatcacagctgttcagtctcgcttgaagacagattacggaaggacgaggccaaatccagattttgtggtgtgaaaatttaccctggtgtgttatcactaccaggggatctgacctcagccaggagcagtgagagcctcctctccccagccatgctgagcgctggcctaggactgctgatgctggtggcagtggttgaatttctcatcggtttaattggaaatggaakcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgag

SEQ ID NO: 38862 - DNA, 601 bp, Human
gctgttctctcagcttctctctactatccccttagcttccatgcctgctgcccgcctcctctttctcgagtcctaacacatagtgggcacttgaagatcttcctcccaccctcccaccctcattaatctattttttacccgaatctgggatccctactcccgtccctttttacaacctaatctacctttttctgaaggaattattctggtcctgaccctcacccccatctctcaatagcctgccctcgccccctgtacgctagccggctctactctcccaccactgctcccctagataccmgaggcttcacccagttagcccgtgagctctaaggctgttctgatctcttcatctgtcccttcacctggcccctgtacccccttcccctttggaccccttgaaccctcccaggacccccgctcagccccttcccgcccccaaccgactcttcccgaacgtcccttaccaaccgcgagagccccctactgcgctttggccacaccccctacgcctcgctcccggccccgcctctgcccctgaccgcgcctgcgcaaggcgggcgccctaaagtcctatttcactctgttgggaggaggggga

SEQ ID NO: 38863 - DNA, 601 bp, Human
gggaatccaggccgcctagatccccaggcagaaaagccagcgtcctgacatcttattcaaatctttcctgcggctgttctctcagcttctctctactatccccttagcttccatgcctgctgcccgcctcctctttctcgagtcctaacacatagtgggcacttgaagatcttcctcccaccctcccaccctcattaatctattttttacccgaatctgggatccctactcccgtccctttttacaacctaatctacctttttctgaaggaattattctggtcctgaccctcacccccatstctcaatagcctgccctcgccccctgtacgctagccggctctactctcccaccactgctcccctagatacccgaggcttcacccagttagcccgtgagctctaaggctgttctgatctcttcatctgtcccttcacctggcccctgtacccccttcccctttggaccccttgaaccctcccaggacccccgctcagccccttcccgcccccaaccgactcttcccgaacgtcccttaccaaccgcgagagccccctactgcgctttggccacaccccctacgcctcgctcccggccccgc

SEQ ID NO: 38864 - DNA, 601 bp, Human
gagaggggctctgaggctttactcatactttcaggattctgggcagtgcctttaccctcctccttaagtttctatggtccctgctgctcctggccagaggtgagaaaggaggtacacagtgcaggggtcttgagcgccatctccagagttctctccatggctcagcaaggcctgagggaagcccatccagacaccagcaggccatgactcttgggtccttccctgttaaagtgctggcccaaggcctggccccagctgaatgtggccacatgcagggctagaccctccccaagaccttggraatccaggccgcctagatccccaggcagaaaagccagcgtcctgacatcttattcaaatctttcctgcggctgttctctcagcttctctctactatccccttagcttccatgcctgctgcccgcctcctctttctcgagtcctaacacatagtgggcacttgaagatcttcctcccaccctcccaccctcattaatctattttttacccgaatctgggatccctactcccgtccctttttacaacctaatctacctttttctgaaggaattattctggtcctgaccctcacccccatctc

SEQ ID NO: 38865 - DNA, 601 bp, Human
ccgttcccacatggtcacttgaggtctctgggtgtctagccgcctctctgagacatcttgatggcctgggggttggaccaggggaatgtctgagagccaggtgggagccattcttggcagagttgaaaggggccgagcttgaaagtgggaggggggaatcagcccagtggaacctgaagaattacaaaaacaaagatggtcagtttcccaggcagagacaaccaccactccccttgtctggtcccactgacctgaaggtggaaacatctccacattatttgaaggctctagattctgtctycagccatctatgttcccctggacaagaggagaaacaaagacactccaattcaattttcaggccaccttccaaagagaaagcccctacaataacaaagtcataatccttgaattatagccaggtccacccgatgcttagctcttttcctacttccccaaagtaggagataccccaaattcacttgcttgtctcaacctggttcctcatggaacccaagcaactaactatcaagtggagagaatttactgaaagagacagactgagaggggctctgaggctttactcatactttcaggattc

SEQ ID NO: 38866 - DNA, 601 bp, Human
gctgggcgcggtggctcatgcctgtaatcccagcactttgggaggccgaggcgggcggatcacgaggtcaggagatcgagatcatcctggttaacacggtgaaaccccatctctactaaaaatataaaaaactagctgggcgtggtggcaggtgcctgtagtcccagctgcttgggaggctgaggcaggagaatggcgtcaacctgggaggcggagcttgcagtgagccaagatctccccagtgcactccagcctgggcgacagagtgagactccatctcaaaaaaaaaaaaaaaaaaaaaggcatttattgagtgttaggtatactttatgaggagtctgagagaacagtacataaataacacagtgccagcctttagagaaatcgtctaccaatgtcacgtgaagtttaatccagcttggaacatggctcctgaggcagctctctgagacccaggactataagagattgttgttgttgtcgtttttagagacagggtatcactgtgtcacccaggcctcaatgcagtggctggatcataggtcactgcagtcttcaacttctgagctcaaggggtcctaccaccttagcctcctgagta

SEQ ID NO: 38867 - DNA, 601 bp, Human
ggggtgctgaagctggggtatggggatgtctgcattgacatcatcatcattcatcaaagccctattgagcatgttgagtccagtgcctggactcacaggacctaaagtctggctgagatcgtggaacatgatctccctagagagagctacatacaggaggattcaacatcaaatgtgtatatcattaggccacacattctttttgttttttggtggtttttttgtcttatttatttttttatttttaggccacacattttaagtggaaaggttggaagaacacacagggacttctcaattstaatttaagggcaagaagtttgagggaggaatgggcatagagaggtcgtaagcttccagtatcaatatggtgaggccaggtgctagttaaaaggcatttattggctgggcgcggtggctcatgcctgtaatcccagcactttgggaggccgaggcgggcggatcacgaggtcaggagatcgagatcatcctggttaacacggtgaaaccccatctctactaaaaatataaaaaactagctgggcgtggtggcaggtgcctgtagtcccagctgcttgggaggctgaggcaggagaatggc

SEQ ID NO: 38868 - DNA, 601 bp, Human
acctgttctttgcttggaagctactgcccagctctccgttatgaatttgaatcctttctacccctgcattcacctgctcttggtgcagcctctgaacctcttccagctcccgctgcctcccctcttccaagttcttccggacaacctcagccccagccaaagcagcacgcaggccctcagcctcagctcggccggccttctccgcccgtgccagagcctctagctccatggcctgggcctctagcctcatcttctgctgcagcgaggtctcccgcaggagccggacctcctcctccagccrccgcagctcttgcagctgccgaacgatcacctcagcctgctggctcagggcctgtgacccctccagcccccaggaccttcaaagacaggttagtgcaggtgagacttgtctccagtgctggaaggatagttgagggcataaacatagccaggagaaggaaaagaggacccctctgcttccgtgtggggaggtgaagggggtgctgaagctggggtatggggatgtctgcattgacatcatcatcattcatcaaagccctattgagcatgttgagtccagtgcctggactcacaggaccta

SEQ ID NO: 38869 - DNA, 601 bp, Human
gagggtcttttctgcaatacctgttctttgcttggaagctactgcccagctctccgttatgaatttgaatcctttctacccctgcattcacctgctcttggtgcagcctctgaacctcttccagctcccgctgcctcccctcttccaagttcttccggacaacctcagccccagccaaagcagcacgcaggccctcagcctcagctcggccggccttctccgcccgtgccagagcctctagctccatggcctgggcctctagcctcatcttctgctgcagcgaggtctcccgcaggagccrgacctcctcctccagccgccgcagctcttgcagctgccgaacgatcacctcagcctgctggctcagggcctgtgacccctccagcccccaggaccttcaaagacaggttagtgcaggtgagacttgtctccagtgctggaaggatagttgagggcataaacatagccaggagaaggaaaagaggacccctctgcttccgtgtggggaggtgaagggggtgctgaagctggggtatggggatgtctgcattgacatcatcatcattcatcaaagccctattgagcatgttgagtccagtgc

SEQ ID NO: 38870 - DNA, 601 bp, Human
aaattctccatctttctagcccatgtgtgtttattttcaccaaaggtctcatcactctactactcactactcatggagggtcttttctgcaatacctgttctttgcttggaagctactgcccagctctccgttatgaatttgaatcctttctacccctgcattcacctgctcttggtgcagcctctgaacctcttccagctcccgctgcctcccctcttccaagttcttccggacaacctcagccccagccaaagcagcacgcaggccctcagcctcagctcggccggccttctccgcccrtgccagagcctctagctccatggcctgggcctctagcctcatcttctgctgcagcgaggtctcccgcaggagccggacctcctcctccagccgccgcagctcttgcagctgccgaacgatcacctcagcctgctggctcagggcctgtgacccctccagcccccaggaccttcaaagacaggttagtgcaggtgagacttgtctccagtgctggaaggatagttgagggcataaacatagccaggagaaggaaaagaggacccctctgcttccgtgtggggaggtgaagggggtgctgaa

SEQ ID NO: 38871 - DNA, 601 bp, Human
ttcctactagaaagggaagcagggcttcaagtggtgggaggccacctgagtcttgggggaaaagtgcaacctgaattaagataaaagtacccaaattctccatctttctagcccatgtgtgtttattttcaccaaaggtctcatcactctactactcactactcatggagggtcttttctgcaatacctgttctttgcttggaagctactgcccagctctccgttatgaatttgaatcctttctacccctgcattcacctgctcttggtgcagcctctgaacctcttccagctcccgctgsctcccctcttccaagttcttccggacaacctcagccccagccaaagcagcacgcaggccctcagcctcagctcggccggccttctccgcccgtgccagagcctctagctccatggcctgggcctctagcctcatcttctgctgcagcgaggtctcccgcaggagccggacctcctcctccagccgccgcagctcttgcagctgccgaacgatcacctcagcctgctggctcagggcctgtgacccctccagcccccaggaccttcaaagacaggttagtgcaggtgagacttgtctccag

SEQ ID NO: 38872 - DNA, 601 bp, Human
ctgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggctgtcagttccatccacgaaggcaggactcaggctaatttggtcactgagtcttagagatggcagagtaagtactgagtttgaggactgaataatctctctctcccagtccaccatagcccccttatacccmccttcctcactgccctccacaatacccctgatgaattggtacctggagtaaagtagggaggcaaactatttcctactagaaagggaagcagggcttcaagtggtgggaggccacctgagtcttgggggaaaagtgcaacctgaattaagataaaagtacccaaattctccatctttctagcccatgtgtgtttattttcaccaaaggtctcatcactctactactcactactcatggagggtcttttctgcaatacctgttctttgcttggaagctactgcccagctctccgttatgaat

SEQ ID NO: 38873 - DNA, 601 bp, Human
aaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgattctcctgcctcggcctcccaagtagctgggattacaggtgcgcaccaccatgcctggtgaatttttgtatttttagtagagacagggtttcgccatgttggccaggctggtcttgaactcctgaccttgtgatctgcytgcttcggcctcccaaaatgctgggattacaggcgtgagccactgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggctgtcagttccatccacgaaggcaggactcaggctaatttggtcactgagtcttagagatggcagagtaagtactgagtttgaggactg

SEQ ID NO: 38874 - DNA, 601 bp, Human
atgttataaagtcaatggatcaattttttcctttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgattctcctgcctcggcctcccaagtagctgggattacaggtgcgcaccaccatgcctggtgaatttttktatttttagtagagacagggtttcgccatgttggccaggctggtcttgaactcctgaccttgtgatctgcctgcttcggcctcccaaaatgctgggattacaggcgtgagccactgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggctgtcagttccatccacg

SEQ ID NO: 38875 - DNA, 601 bp, Human
gctattcctaatgttcatgttataaagtcaatggatcaattttttcctttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgattctcctgcctcggcctcccaagtagctgggattacaggtgcgcaccaccaygcctggtgaatttttgtatttttagtagagacagggtttcgccatgttggccaggctggtcttgaactcctgaccttgtgatctgcctgcttcggcctcccaaaatgctgggattacaggcgtgagccactgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggct

SEQ ID NO: 38876 - DNA, 601 bp, Human
ttgtgccctgggtcctgggctctgcagcacactcagtgcccctcatctctgtgccccagccttctggcctcctgtccccgccttcacctgttgtcccaccaagtgtcttccagctaccactggacttcacacgcctcttcactggccaactcctattcagcacaaacggtagcttgttgtttttttagtctcgctctgctgcccaggctggagtgtgatgtcagctcactgtaacctctgtctcccaggttcaagcaattctcctgcctcagcctcccaagaagctgggggattacaggckcccacgactatacccggctaatttttgtatttttttgtagagttcttcatgttggccaggttggtctttaactcctggcctcaagtgatccgcccacctcggcctcccaaagtgctgggattacaggcatgagccactgtgcctggcctagcttcttgtttctaagtttctttcataaatctcctttgtccattttctgattggattgctggtctttcccttaccaatttctaggcacacattttatattagggatattacccttttcttgtgatctgagctataaatatagcttttttt

SEQ ID NO: 38877 - DNA, 601 bp, Human
ccatgttggccaggctggtctcgaactcctgacctcaagtgatccacccgcctcagcttcccaaagtgctaggattacacatgtgagcaaccatgcccagccctaatttcttccataaaatagagatgggggtctcgctttgttgcccaggctggtctcaaactcctgggctcaaatgatccttccaccttggcctcccaaagtgctaggattacaggtatgagccactgtgcccagcctgctcattgctcttatgggaaagtagcaagttctgaagtggccaaagccttgtgccctgggycctgggctctgcagcacactcagtgcccctcatctctgtgccccagccttctggcctcctgtccccgccttcacctgttgtcccaccaagtgtcttccagctaccactggacttcacacgcctcttcactggccaactcctattcagcacaaacggtagcttgttgtttttttagtctcgctctgctgcccaggctggagtgtgatgtcagctcactgtaacctctgtctcccaggttcaagcaattctcctgcctcagcctcccaagaagctgggggattacaggcgcccacgactata

SEQ ID NO: 38878 - DNA, 601 bp, Human
gcgggcgcctgtagtcccagctactcggaagaatgacatgaacccgggaggcggagcttgcagtgagccaagatcgcgccactgcactccagcctgggcgacagagcgagactccatctcaaaaaaaaaaaaaaacaacctttcaacggttgcttattacttgaaaaaacaatttttttttgtttgtttttttggagatggagtttcactttgttgcctagactggagtgcaatggcacgatctcagctcactgcaaacgctgcctcccaggttcaagcgattctcctgcctcaccctccygagtagctgagattacaggcatgagccaccacgcccagctaatttttgtatttttagtagagatgaggttttaccatgttggccaggctggtctcgaactcctgacctcaagtgatccacccgcctcagcttcccaaagtgctaggattacacatgtgagcaaccatgcccagccctaatttcttccataaaatagagatgggggtctcgctttgttgcccaggctggtctcaaactcctgggctcaaatgatccttccaccttggcctcccaaagtgctaggattacaggtatgagcca

SEQ ID NO: 38879 - DNA, 601 bp, Human
gatgtgtgtgaggctctgcacccgcacctgcagcagctccgcggtggcatgcaggctgtcccggtcctcctgcaagtgctgcgggcagaggaaagcagcccctctgtagggcctccatgccgccttaggtaccaccttctctcccggaggctgtgctctacacgctcctccaagggccacgcttgcctcccaacctgatccctaagtctgcacacagatacattcctgcaccctcacctgcatggtttccagaagcttctgtcgctccagttcccatgtctggctgtggacctcagaaggsacttgttccccaacatattttcttagattctcaaccagggtcacctgagcctccaagtcttcctgggtcttgctagggttggggtgggaatgggacagccatcagtggggcgccctgcagatccaccacatcactaattgctgggctcccgtcggcgtccgcccacctacctcagctgcttccgaagcagctcggcctccctctgagcctcggccagctccttggcttcccctgctcttctggtttccagactactcagagacttctccaagccctcagccttgctggtcaaactggaaa

SEQ ID NO: 38880 - DNA, 601 bp, Human
ttgttcagggctgtgtgcccagcatgtggcaaccactcaataaacactggttgaatggatgccaccttcatggaaggagcaaggtgctgggagggaataccgggagaaaagagagtgcagtgacctgtcccttcagctgcttaacagagtcactgtgttccagctcctgggcctttagctgcaccatgagggcaaacaccttctcccgccagcggttcagcagggactggcacttcctggtaaactcaggctccagggaatctgaaggttgaacctgagggagaaggagtgggagaaaagygtgggctcctgggggaggagaggaaggaggtggcatctttgtttctcctctgtcctgcctgggcaacatgagctacagcaagaggagttcacaggaaggagatctaagcaggttctggggcacattgacccctcctgcccacagggagggaggcaggggacagtagatgcaggatgcggctgagggtgaggggtctgggggttgggctgtaccttcctggtcagctcctcctcctgcagggcgaggatgtgtgtgaggctctgcacccgcacctgcagcagctccgcggtggcatgcagg

SEQ ID NO: 38881 - DNA, 601 bp, Human
aggtgatcctcccacctcatcctccagagtagctgggactacaggaatgagccactatgcccggctaattttttgtatttttagtagagacgggatttcacatgttgcccaggctggtctcgaactcctgacctccagtgatccacctgcctcggtctcccaaactgttggcattacttgactgggcacggtggctcacacctgtaatcccatcactttgggaggctgaggcaggtgaatcacctgaggtcaggagttcgagaccaaagtgatcgcattataggtgtgagccactgcaccyggcttcaatctttctatcgcacatataattacccaacattatctgtttacttgcgtgttctgtgtctctgttctagaatgcaagctccacattttagttttgttcagggctgtgtgcccagcatgtggcaaccactcaataaacactggttgaatggatgccaccttcatggaaggagcaaggtgctgggagggaataccgggagaaaagagagtgcagtgacctgtcccttcagctgcttaacagagtcactgtgttccagctcctgggcctttagctgcaccatgagggcaaacacct

SEQ ID NO: 38882 - DNA, 601 bp, Human
gatcacagttcactgtggcctcgcctcgacctcccagcctcaggtgatcctcccacctcatcctccagagtagctgggactacaggaatgagccactatgcccggctaattttttgtatttttagtagagacgggatttcacatgttgcccaggctggtctcgaactcctgacctccagtgatccacctgcctcggtctcccaaactgttggcattacttgactgggcacggtggctcacacctgtaatcccatcactttgggaggctgaggcaggtgaatcacctgaggtcaggagttcragaccaaagtgatcgcattataggtgtgagccactgcacccggcttcaatctttctatcgcacatataattacccaacattatctgtttacttgcgtgttctgtgtctctgttctagaatgcaagctccacattttagttttgttcagggctgtgtgcccagcatgtggcaaccactcaataaacactggttgaatggatgccaccttcatggaaggagcaaggtgctgggagggaataccgggagaaaagagagtgcagtgacctgtcccttcagctgcttaacagagtcactgtgttc

SEQ ID NO: 38883 - DNA, 601 bp, Human
actgcactccagcctgggtgacaagaacaagactccttctcaaaaaaaaaaaaaaaaagaaaagaaaagaaaaagaatgaatgccacgcagggagacagaagcttaggttctgaggatggaatctgagcccagtgttccatgttccacattccatgtgcccactcgaagatgggaatagcccttgacacaccccacaagacccaccaactgaccatgccactctcctcagatgctgtcacctcctcagagaggctgtctctgagcatcctacctgaggctgactcaccccacagtctctcygtcacattatcttttgaatttttcttactactttctttttttttgagaaaagatctcgctttgtcacccaggctagagtgcagtgatgggatcacagttcactgtggcctcgcctcgacctcccagcctcaggtgatcctcccacctcatcctccagagtagctgggactacaggaatgagccactatgcccggctaattttttgtatttttagtagagacgggatttcacatgttgcccaggctggtctcgaactcctgacctccagtgatccacctgcctcggtctcccaaactgttg

SEQ ID NO: 38884 - DNA, 601 bp, Human
ttactagactgaactgcaggaggaagcaaggcctcacctccagccaaacatgcaacgggaaattcataacaagcaatcaggtatgaatgcagaaggggcttccccaggaaaagaaacgaacacaggaacattgatagagctaaatctgcccagccctgtagcctccagtggccactttccagcccctcttgcctgaggatcctcagcaacaaggtgcccaggaacctgaggtagcagaaacactactccacccacccctccatccctgatacctgctgacagcattgaccacaagcctcarctgctcctcggctgaggctgtctgctgctgccaccaacgcctggcctcctgagcacggctcagctccaactgcaggccctggggaggatgcagcaaaggacagggtccctccctaagtcctggctgcagccccggaacaggggctcccttgccctccccgagtctctagtaggctgacaccaaccttggcacccatacgctccacctccacctctgcggctttgtcctgcagggatcgctgcaggatggcctgctcctggctctgggatgtcactttttcctggagtgaggccacctggg

SEQ ID NO: 38885 - DNA, 601 bp, Human
tacactctccatccttgaacaatactgcaagtgaagatcctcccgggtgctctatttagctcaagccattactagactgaactgcaggaggaagcaaggcctcacctccagccaaacatgcaacgggaaattcataacaagcaatcaggtatgaatgcagaaggggcttccccaggaaaagaaacgaacacaggaacattgatagagctaaatctgcccagccctgtagcctccagtggccactttccagcccctcttgcctgaggatcctcagcaacaaggtgcccaggaacctgaggtrgcagaaacactactccacccacccctccatccctgatacctgctgacagcattgaccacaagcctcagctgctcctcggctgaggctgtctgctgctgccaccaacgcctggcctcctgagcacggctcagctccaactgcaggccctggggaggatgcagcaaaggacagggtccctccctaagtcctggctgcagccccggaacaggggctcccttgccctccccgagtctctagtaggctgacaccaaccttggcacccatacgctccacctccacctctgcggctttgtcctgcag

SEQ ID NO: 38886 - DNA, 601 bp, Human
aatagtaagcaagttaagtatataataagcaagtaagtatacagctttaaataaatagactaggccaggtgcagtggctcacacctataattccagcactttgggaggctgaggtgggtggatcacctgaggtcaggagttcaagaccagcctggccaacatggtgaaaccccgtccctactaaaaatgcaaaaattagccgggcgtagtggaggacactggtggaggatgcctgtaatccagctactcgggaggctgaggcaggagaatcacttgaaccagggaggtgaggttgcagtgrgccaagattgcgccattgcactccagcctgggtgacagagcgagactttgtctcaaaataaataaataaatagactaaatttttctccagtgaaacggattgcccgtaaaattttagaaaaaaaaaggaagatgaagtgtctacactctccatccttgaacaatactgcaagtgaagatcctcccgggtgctctatttagctcaagccattactagactgaactgcaggaggaagcaaggcctcacctccagccaaacatgcaacgggaaattcataacaagcaatcaggtatgaatgca

SEQ ID NO: 38887 - DNA, 601 bp, Human
cagaccatttctgtgatcacctggtaccaaagtcaaaccctgtccacagtgcatctttctgttctcctggaggtagggggcacccgcgatggattgaacctgggtggtaggtcattataactagtttaattccgtgcaagtttgaaatttttcataatttttaaagctaaattagtccctaaggtacaaacccaagagaaggaagtggtgggcaaggactcatcctgcatcttaatttcgctaaaccaaaaattatctttatctaaattaacccatcaagaagagcctcacgataacaatmaacatttacaagccagagactgtgctaagaactacctgccggccgggcacggtggctcaagcctgtaatcccagcactttgggaggccgaggcgggcggatcacgaggtcagaagtttgagaccagcctggccaacacagtgaaaccctgtctctactaaaaatacaaaaaagtagccgggtgtggtggtgtgcacctgtaatcccagctactcaggaggctgaggcaggaaaatcgtgtgaacccgggaggcagaggttgcagtgagctgagatcgtgccattgcactccagcctgggt

SEQ ID NO: 38888 - DNA, 601 bp, Human
aagcctggaggactttcggcaaatgcatcattacacagaccatttctgtgatcacctggtaccaaagtcaaaccctgtccacagtgcatctttctgttctcctggaggtagggggcacccgcgatggattgaacctgggtggtaggtcattataactagtttaattccgtgcaagtttgaaatttttcataatttttaaagctaaattagtccctaaggtacaaacccaagagaaggaagtggtgggcaaggactcatcctgcatcttaatttcgctaaaccaaaaattatctttatctawattaacccatcaagaagagcctcacgataacaatcaacatttacaagccagagactgtgctaagaactacctgccggccgggcacggtggctcaagcctgtaatcccagcactttgggaggccgaggcgggcggatcacgaggtcagaagtttgagaccagcctggccaacacagtgaaaccctgtctctactaaaaatacaaaaaagtagccgggtgtggtggtgtgcacctgtaatcccagctactcaggaggctgaggcaggaaaatcgtgtgaacccgggaggcagaggttgcagt

SEQ ID NO: 38889 - DNA, 601 bp, Human
ttgctgtgccttgtatagacaactccctctaatcctgtcccattatacaagtacagaacgcacagcttccgtcaattatctaaaggacccttgccccaagaatgcattaaatgactatctttttaagcaacctgttaagcttatttctcacaactgtgttttgctcactatcgtgtatcaaagagtaaagttatcctctctggtcaggggcagtggctcctgcctgtaatcccagcactttgggaggccgaggcgggcggatcacctgaagtcaggaattggagactagcctggccaacayggtgaaactctctctacttaaaaacacaaaaattagccgggcatggtggctcatgcctgtaatcccagctactccagaggctgaggcacgagaatcacttgaacctaggaggtggaggttccagtgagccaagatcgcacccctgccctcaagactgggtgacagagcgagactccatctcaaaaaaacaaaagaaaacaaagttatcctctccaagcccaggagtgtcgatctagcaccagtgacgggcaggtccacatgctttaccagctggctgtgccagaagtaggaccaacctgg

SEQ ID NO: 38890 - DNA, 601 bp, Human
ggccctatccaccctggcaaggctcaccggccttggcatgctccctccgagcctcgttcagcctcctctctgtgtctgagagttgctcccgcagccgagtttccacttcagccaccttttcttgcagggctggggtgaaagtgcagacggggcatatcagcaggagctttgattcgcagttcccaccccaccctccaagggaagcacccatttccctctcgacaccttgcccgtagagttcctgctgctgggtcagctcctgccgcagactggcagcctcctctgtgctctcctgctggcmctggcgtgctacctccagctgcagccccaagctagccagggactcctgggtctgctgcagctcctgctccagctgctgggccaccttgctcagctgctgccgctctgcctcccctaaaaggagggggtgctgggtcaggcctctcccagcaccctagacactgggtttttcctcatcctctccaccctctggcaaccaggtgtaccttgctcccgagcccggcccacctcctgctggatgaggcgggcactcagctgcagttctgcatccaggcggttccgttcttcccgcagctgctgc

SEQ ID NO: 38891 - DNA, 601 bp, Human
catgggtgtgttcacgatgtgataattcatctgtgctactcctggataccttcattacttcctgtaatgaagctttgaacacactttgaggggaaaataataaccttatgtcttaacacttccttcttcctggaaggccctatccaccctggcaaggctcaccggccttggcatgctccctccgagcctcgttcagcctcctctctgtgtctgagagttgctcccgcagccgagtttccacttcagccaccttttcttgcagggctggggtgaaagtgcagacggggcatatcagcaggasctttgattcgcagttcccaccccaccctccaagggaagcacccatttccctctcgacaccttgcccgtagagttcctgctgctgggtcagctcctgccgcagactggcagcctcctctgtgctctcctgctggcactggcgtgctacctccagctgcagccccaagctagccagggactcctgggtctgctgcagctcctgctccagctgctgggccaccttgctcagctgctgccgctctgcctcccctaaaaggagggggtgctgggtcaggcctctcccagcaccctagacactggg

SEQ ID NO: 38892 - DNA, 601 bp, Human
tcgacctcccgggttcatgtagtcttcccacatcagcctcacaagtaagcttggggtacaggtgcccaccaccaggcctagctaatttttgtatttttagtcgagacagggtttcgccatgttgtccaggctggcctcaaactcctgacctcaggtgatacacccacctcggcctcccaaagtgcttggattacaggcataagccaccgcgaccggccatatgctgtttcttaatctggtgctggctacatgggtgtgttcacgatgtgataattcatctgtgctactcctggataccttyattacttcctgtaatgaagctttgaacacactttgaggggaaaataataaccttatgtcttaacacttccttcttcctggaaggccctatccaccctggcaaggctcaccggccttggcatgctccctccgagcctcgttcagcctcctctctgtgtctgagagttgctcccgcagccgagtttccacttcagccaccttttcttgcagggctggggtgaaagtgcagacggggcatatcagcaggagctttgattcgcagttcccaccccaccctccaagggaagcacccatttccctc

SEQ ID NO: 38893 - DNA, 601 bp, Human
aggatttgaaaaggtgccacccatagagagagctatgggtgggaccacttctcacaatctccaagagagatggctgcagggagaattcccacagattcccagaaataacatttccaaacaatggctccttctgtagtcgtctttatttagagcagaattcagactcagctggtatcccccagggcaaccccaggatggggaagggctggtctgtccccacccacttctccaggatcctcccagcccccaggctggctttccctccaactgtcagctgcttagctgctcatctggggattgsagctggagcatctgtcaaggttgtctccttgacaaacagcttcctctttggaaatggcttcactcaggtcctgcaggtcatcgagcaggacagagagggaccctgggaaggaagacagcagatgagcaccagacaagggaaggtgctcgtggttacagaggaaacagggctggcacaggaaatgaggaatgggagagaggaggctctttggtccaagctgggcatcgctaaaagaggctaagggcctcgaaggaccgcagagaacaacactcatcatgcgagagtctgaagaggagattc

SEQ ID NO: 38894 - DNA, 601 bp, Human
actataactgagagtagtcttgctattcatgtctattcagagaatacggcaaaacttggcttccaccatctagtgtaaaaattagaataaagacaaacacttctgttatgctgaaagtatatttatatatatagatatagatatttacttctctgtagacagtttttactgatgagtcatttgaacgttcaaagaacaaccgattacaatgctacatgaactataccagaaatgagatggatagcttctcaattcatttcacaaagccagcacaaagctgataccaaaacataacaattawaacacaaaacagagaaccacagatctcacttaaaaacacagatgccaaaatacagaacagaacagtagccgattgaaatcaacaccacataaaaaatgtacaaagctttggcagatacgaaaccaagttgaaaatccaaacgtacactcgtggaactggaacacaaacaccaggaacaaaaatgtccccccaccctgtcagtggcctctggccagggaaacacaggagcgagatctctgctacacctattagcggggagggggcctgctggtggggccgtgggcactgtcaccggtgtca

SEQ ID NO: 38895 - DNA, 601 bp, Human
tatatatataaatattttacatagatgtaatcacagtgtgtattacttttgtgctctatattatcatattgattttttttttttcggagtcttgctctgttgccaggctggagtgcagtggcgcaatcttggctcactgcaacctctgcctcctgggttcaagcgattcccctgcctcacctcccaagtagctggtactacaggcatgtgccaccacgcctttctgattttttgtattttagtagagacagggtttcaccatgttggccaggatggtcttgatctcctgacctcgtgatcygcctgcctcggcctcccaaagggctaggattacagtcatgagccactacgcctggccaattaatttttcatacacacatttttgtagttattagcgtggttgataatagtccctccccttacttgattggtttgttgatgtcctttgctctcttggatacccaggtaatattcctgtgtttttataatatgtactttgcataacatgggtattttaaatatttacaataaaatttgttatagaagatactgtttgtgtcctacacatatatcctgagcctggaggtcacctgtaggaggc

SEQ ID NO: 38896 - DNA, 601 bp, Human
gatgatgggtgcagcaaaccaccatagcccatgtatacctatgtaacaaacctgcatgttctgcacatgtatcccagaacttaaagtataaaaaaatccaaaaaacttgaatttcttaaagtcggaacgtttatgaatcttcctcttttgatacagacagatgaaacaaaaccttcatgacatttaaaatagtgacatttatttcactgtgtgtgtgtttgtataaagaaaaaatacgtcaatgtaaaaaattaaaggaaaaacaatttttaaaataaataaatgttaataaatttttacaaaaaaaaaaaaagaacaggaaaaactactaaatgatgacaaaattcaggatagtgtttaccttggcaagggggctttgtcacctgggtagaccggaagttttctctagtgagggaaatgtcctttatcttggagggtggtgatggtgatgcaacaagactattcatgtgtaaaaattatccaggcatggtggtgcacgcctgtagtcccagctcctctgaaggctgaggcaagaggatcatttaagcccaagagttagaggcggcagtcagctatgactgtgccactgcactccagcctg

SEQ ID NO: 38897 - DNA, 601 bp, Human
gttatataatttaaattctgcttcctagttagattgagaatatgaagtaaggaaaatagaagctatctgtgactttgagtcacagggtttcttggtgatagccagccctcccactatgataattcaccctttgataatacctgtgtatgaatctatgctgtttggaagtttaattcgctttaagtactctgttaaaggcatctttttgactttgaaccacaacagcctgtagtaatgttctgttggcttatcatcgctttcttttactggtggtacagccgtgggctttgcttcatagggaaaaaaaaaaagatgaaacatttgaagaggttaagttagtttagttaaaaacttgaatttcttaaccaaacaccgcatgttctcactcataagtgggagttgaacaatgagaacatatgggcacagggaggggaacatcacacactggggtctatcggggggtgggggacaaggggagggataacattaggaaaaatacctaatgtagatgatgggatgatgggtgcagcaaaccaccatagcccatgtatacctatgtaacaaacctgcatgttctgcacatgtatcccagaacttaaag

SEQ ID NO: 38898 - DNA, 601 bp, Human
cctcctcttacaaactggagtctgggctggataaatagcatatcataaaggtagatgatatcacatatgatgtccgcaataagccagtagtgtatgttgtctgcggtttgatatgggaagacgaggcgcagtggtataaaccagcagttccagttataggcaagagtgacaagcaagagccacaggagatagagtcgatctggaaaaacagcaagtggtgaaatccaaatgacatagaacaaacacagaaagaattctgttgcttagtttggggaggttggggcactaccctctacagagyaatttgccataggaggctctattaaacattcaacaccattctgcctctggactgtgaggctccgggctttacaagagatgttaaatgatcttatcacctcttccgaaagtggagagtttccttccagtctccttaagaagtggcccctctgagtctgtccacacaggtagctgtactatttggatcaggcaacgagaatttcaagaaaagttggaaggactttgcacagacatcactgcagccacagatctttagttcctcagtagttaagttgcaggattgattgcccagggcaggtgg

SEQ ID NO: 38899 - DNA, 601 bp, Human
gacaagacaaagtatacaacccatattcctttactgatgtgtaaattagaattcaaatctgggcactaacttattttggtctgcttaataagggcttatatgttgaattacccacttgcacatacaaggaaacatatcaggtaattattgagaggcagaaacttcaggcttatcattgtctaataaaacttcgtatgtacaaactttgtttatagaaatctatagatgggatttaaagtcaaaatggtaatagatcacgtgagcaactttgaaattgtttgtcacctacctgaaattttgkagaagtcctgtagtgtttccttagctcatttgaatccacctgaaagatatttgtattttcattaattttagccaatttcatcaattatttttttctcacttttaaatttataactgtttctcttggttggttccttccaatctcagccaataaacatcctccatattcccaggtattaaaacaaaaaatgtttggctttagttttcttcttactattgccctattgtttgccacaatcaagcttctcaagagagttgcctacctgctttactctatatccttccctcacattcatcctta

SEQ ID NO: 38900 - DNA, 601 bp, Human
tacttttaagcttttttgttaaaaaccaagacacaagcacacaaattagcctaggcttacacagggtcaggatcatcaatatcactgtcttccacatccacatcttgccccactggaaggtcttcaggctccataacatgggtggagctgtcatttcctataataacaatgccttcttctggaatgcctcctgaaagatttgcctgaggctgttttacaattaacttttaaaaaaattcataggagtacattccgaaataacaataaagagtacaggatagtaaatacataagctagtaayatagttgtttattgccattatccccaatattatgtaccatacatattagtatgtactatacttttatatgactggcagcccagtaggtttgtttacaccagcatcactgcaaacaggtgaataacacattgcactgtaatgttatgatggctgtgatgtcactaggcaatagggatttttcggctcccttataatcttatgggaccatcaccatatatgtggtctgtcattgactgaaatgccattatgctaacacatattaaatatataaattaatttagtccttattcaaactcagga

SEQ ID NO: 38901 - DNA, 601 bp, Human
agatattgtttctattcacaagaagttaacaagctaatagtgaatgatcaggtacaaaaatacagtcatttgtcacttaacaacagggacatattctgagaaatgcattgttaggtgatttcatcatgtgaatatcatagcatgtacttacataaacctagatgtattgcctactacacacgtaggtggtatggtatagacatacaagcctaggcttctaggctacaggcctaggagcatgttactgtacagcatgctctgtatattacagtatattattgtatgttactgtacagcatgwtactgtactgagtactgtagggaattgtaacacaatggtaaatatctttgcatctaaacacatctaaacattgaaaaggtacagttaaaaatatgatacgaaagataaaaaatggtacacctgtataggatacttaccatgaatggagcttgcaggactggaacttgctctgggtgagtcaatgagcgagtagtgagtgactgaaggcctaggacattactgtacactactgtagactttataaacactgtagagttaggctacactaaatttatttaacaattttttctttaataataa

SEQ ID NO: 38902 - DNA, 601 bp, Human
tttctcattgaactgtagaaaattgaattgaagtattgaccaacactaaaccctgtgcaagacaatttgcaaagcatgttggggttgaaataggagtaagatattgtttctattcacaagaagttaacaagctaatagtgaatgatcaggtacaaaaatacagtcatttgtcacttaacaacagggacatattctgagaaatgcattgttaggtgatttcatcatgtgaatatcatagcatgtacttacataaacctagatgtattgcctactacacacgtaggtggtatggtatagacakacaagcctaggcttctaggctacaggcctaggagcatgttactgtacagcatgctctgtatattacagtatattattgtatgttactgtacagcatgttactgtactgagtactgtagggaattgtaacacaatggtaaatatctttgcatctaaacacatctaaacattgaaaaggtacagttaaaaatatgatacgaaagataaaaaatggtacacctgtataggatacttaccatgaatggagcttgcaggactggaacttgctctgggtgagtcaatgagcgagtagtgagtgact

SEQ ID NO: 38903 - DNA, 601 bp, Human
aattaaccagattagctattataaacaaattacttactaaaagtattggcttagaaattgcatcatatcatcaaacctcattgatttcactgtagaggtatcgatctttgtaacaagttaagtgtacagaacgtaattaaaataatgtatttaaaataaaaaagcagatacactgttgacatagtgctaccctaaaacttacagtttttggcttaaatcataacgatctttttgcttgctttctattcaattcctcaactcccctctcaacttctctaggcagacagtcattaatcattgrccatttttggcacagatttgtgtagacagagataatttatttctcattgaactgtagaaaattgaattgaagtattgaccaacactaaaccctgtgcaagacaatttgcaaagcatgttggggttgaaataggagtaagatattgtttctattcacaagaagttaacaagctaatagtgaatgatcaggtacaaaaatacagtcatttgtcacttaacaacagggacatattctgagaaatgcattgttaggtgatttcatcatgtgaatatcatagcatgtacttacataaacctagat

SEQ ID NO: 38904 - DNA, 601 bp, Human
ccaaaaaacaatagatgttggcatggatgtggtaaaaggggagtgtgtatgcactgctggtgggaatgtaaatatgtaaaacttctatggaaaacagtatggacattccttaaacaactaaaagtagatctaccatttgatccagcaatcccactactggctatctacccaaaggaaaagaagtcattatatgaaaaagacacacgcacatataggtttatttcagcccaattcataactgcaaaaatatggaactaacctaagtggccattgaccaatgagtggataaagaaaatttggyatatgtacaccatggaataatatttagacataaaaaggaatcaatgtcttttgcagcaacttggatggagctggaggccattattctaagtgaagtaactcaggaatggaaaaccaaacactatacgttctcacttataagtgggagctaagctctgagtatgcaaaggcatacagagtgatataatggactttgaagaccagaagggggggtgtgtttggggtgggacaaaaaaactgcatactggatacaatgtacactactctggtgatgggtgcactgaaatctcataatttacca

SEQ ID NO: 38905 - DNA, 601 bp, Human
aaatggaaacacatctcatgcttatggattggaaggatcaatattgtaaaaatgacgatactgccaaaagcaatctacagatccaatgcaattcccatcaaaataccaacttttttttcacagaattagaaaaaacaattctaaaattcatatggaactgaaaaagagccctcacagcccaggcaaccctaagcaaaaagcacaaatctgaaggcattacactaccagacttatagttagcaaaacagcatggtactggtataaaagtagtacatagaccaaaggaacagaatagagaacscagaaataaagtcaaatacttatagccaactggtattgaacaaagcatactaaaacataaattggggaaaggacatcttgtttaataaatggtgctgggaaaactggcaagccacacgtggaagagtgaaactagatccctatctctcactttatacagaaatcaactcaagataaatcaaagacttaaatctaagacctgaaaccataaaaattgttgaagataaccttggaaaaactcttctggacattggcctaggcaaagaatttatgactaaagccccaaaagcaaatacaacaa

SEQ ID NO: 38906 - DNA, 601 bp, Human
agtagcactgctatacaccaatacacatacaaaaatgaccaagctgagaagcaaatcaggaactcaatccctttacaacaactgtaaaacaacaacaataacaaatccctaggaatatacttaaccaatgaggttaaagatctctacagagggaactacaaaacactgctgagagaaatcacagatgacacaaacaaatggaaacacatctcatgcttatggattggaaggatcaatattgtaaaaatgacgatactgccaaaagcaatctacagatccaatgcaattcccatcaaaataycaacttttttttcacagaattagaaaaaacaattctaaaattcatatggaactgaaaaagagccctcacagcccaggcaaccctaagcaaaaagcacaaatctgaaggcattacactaccagacttatagttagcaaaacagcatggtactggtataaaagtagtacatagaccaaaggaacagaatagagaacccagaaataaagtcaaatacttatagccaactggtattgaacaaagcatactaaaacataaattggggaaaggacatcttgtttaataaatggtgctgggaaaact

SEQ ID NO: 38907 - DNA, 601 bp, Human
atctgatctctccttaggcgttgcatttactgggatttttattgagctgtcacatatacaatgggcatagttgctaatgttaaaatacgttttaacagtgtttttaacatggggctcttcgactaaaaatcaagtccattcttgattttatttgaaagcattgtactttcattgtagtgatatatttttatgtttcagccaattctcctgtgttcacagttgattatattgtggttcatttaggctcttcaatgctttctactcttgtctacttcgaaccattttgctaccaataaactgytttaaaagtatctatcagagcctgtgcaggctgagagaggagagcaaagaaatcaataatgtttgcaattaatcagcagctctgatgggagaaggtattgaaaatattattatagctaagaaattttcaaaaattgtcatgtattaaaattattttggccttctgttaccctggtcattatgaaatgacaatgtcatacttcatactttcttgatggcaacaacaataagaaattcttttgtgtaaaataattattcatttttattaaattttacatggtcttaatagggtatatgaaaa
